United States Patent 9,487,797 (GENOMIC PLANT SEQUENCES AND USES THEREOF) - sequence listing, part 17

SEQ ID NO: 40133 - DNA, 1501 bp, Oryza sativa
tccaaccgtaccaataccatttctaagaaatattacatggggtgtgttatgttgggcttttcaacctgcttttacttttgcttttgcaaaagttaaaagccaactaaagggctcaaaaatcataagtacttttgctccaaagctgcttttagtgcagtacaaatctaaaagcacccctacccctgctttcattggcttttgagtaaaaaaaaattacccgcctctctcattataaagaaaacggttcgacaaaaataaaaattaattacacagattacgtgtaaattacaagacgaatcttttaagcttaattgcttcatgatttgacaatgtggtgctacagtaaacatttgctaatgatggattaattaggcttgataaattcgtctcgtagtttacatgcggattctgtaatttgtttggttattaaactatatttaatactttaaatgtgtatatgtatatttgatgtgacacagtaaaaaactttacccataaatctaaacacagtcttaatattctacgcgtgtcacagtgtgaaattttttgttatgaactaaacagtttggaagatgaaatggcattcgcacgagcgttgcagattttcatggtacatctggctagcagagaccagagcgtggtctgtaagccagacagcccatatgcatgatctgagcaaaccttgcagtcgttgctgcgttgcgttgacggtcagtcaacccacagacacacgcatcatgcaacgccattgtcagattggccttaacttcactcggtaaggcctggtttaggccatgtttagttccaaaaactttttttcaaaaacatcacatcgaatctttggacatatgtataataaaaaactaattgcacagttatggaggaaatcacgagacaaattttatgagcctaattagtccatgattagccataaatgctataataactcacatgtgctaatgatggattaattaggctcaaaagattcgtcatgcggtttccaggcgagttatgaaattagttttttcattcgtgtcccaaaaccccttccaacatctggtcaaacgtccgatgtgacaccaaaaaattttcttttcgcgaactaaacatacccttaagtttcccaaatttttttccaaaaaacatcacatcgaatctttggacacatgcatgaaacattaaatatagattaagaaaaactaattgcacagttagaggaaaatcgcgagacgaatcttttgagcttaattagttcataattagccataagtgctacagtaactcacatatgctaatgacagattaattaggctcaaaagatttgtctcgcggttttcaggctagttatgaaattcgttttttcattcgcgtccgaaaaccccttcccacatccgattaaatattcgatgtgatacccaaaaattttcttttcgcgaactaaacaggccctaactcgactcattcactcgcgaactaaataggccctaacttgactcattaa

SEQ ID NO: 40134 - DNA, 1501 bp, Oryza sativa
ccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtctgggtaaagtgtaccccctctgcagaggttattaaactgttcgaacagccgtgcccacggtcatggcggatgtgaggtgattcctagcgcagttttgtttgactactgctttgtgaaatttgcggatgtggtttgggattgatgtttggaaaatctgcggctgatgggatcagccaggcccgggtggccgtttgaaagttgttggccgggtgccaacctagatcgattcaaaagactgatacattgcacatactccgaccgaacgagacgcattgtctcatccgtgtcgtttgagaagcactcacttagttgtttcagaaaagagtttaaataaaatcaattgcaaaaacaacagcctttccttgaagtctgcattaaacacttattttccatggcttgctgagtactcctgtactcacccttgctctatataaataattcccccccagttgctaaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatactctgtcttcctgtgataccagcactgtttcctgggactggtatcgattaacaggttaatttggagcgtcacgggctagttccggtcgggactagttcggggcgtggcactaacaagttgagggaccttgcgtgtactttttcctactttttttcaatgcagctaattaatatgtagaatgacttatgtatttaataacaatgaatttcctgactatactgctctatgactgtatcaagtagtcgaatatgttcattttttttcataagagtttttgtccaaactccttttcgtagtagtaatacacattatgcctaaggttgtgttcgtttcccaggttaggaaacaggggcagatctacagtagaatggccgctgtcaggcgacaccgacgactttcagcaaaatctataatgaaattacttatccatatgttataacactatgatataaacataattagcatgctatgacaccgatagacacgttatgacaccaacgaatcgattttctggatccgccactggttggaaacacatttgtagtgcacgaaaaacgtaatggtctattagcgagtgattaattaagtattagtt

SEQ ID NO: 40135 - DNA, 344 bp, Oryza sativa
ggcccaagaaggaaaagggggggaaagaagacttcttttagggtttttctttttataaaccttttccactttgtttatttcttttcaattattatttgtgctctgaaaattccactaaaatttatttacgcattttagccttttaggaaatatgcaaaaatcctccaagcctcatttgacttttacatttgcacattttaattgttggaggctttcacatgaattttaattattctttgcacaatttcgaggatgtattttagagtcgatttgggacgcgacaaacctaccccccttaaacggaatctcgaccccgagattcggaagaactggcgaagagatcg

SEQ ID NO: 40136 - DNA, 1270 bp, Oryza sativa
gatcacaacaggccttggaatgagatggaactacctcgcaacgcaaaagatgtacaactattctaggcttgcactgaaattgttattggaaacgaaaagaaaatcctattctggaaagacaactggctacaaggaatgtgccctaaagatatggccccaaacctctttcaacttgcaagaaggaagaacaaaaatttaataactgaacttgatcacaaccattgggtctactcattcagagaaattgacaatggtgaagtaatccaagagcttgtgcatctcggcagccttcttactcaaacacaactaacgtcagaaaatgaagactacataatctagaagagaaatagcaaaggtatatattcagcccaaagtgcatatcaattccaattcattacctgtcaacatgatcagaccttcaaagccaactggagagcccaggcattacccaagcaaaggttcttcggctggctcatcctgcacaaaagagctctaacagctgaaaatctgctaatccaccattgggaatgtgattggatatatcccctttgtagaagcgcctgtgaagacactgaccatctttttagggagtgtgatttcattagaaccacttggagcctagtggcggtagctcagggcatgcaaactgcgataaattcaaactccaccgctgaatggatgatggctttagctcatggaaccaataaggctgaatcaaaacgaagagtgggaattctgatcaaaacctggtgacacgtttggctacaaataaatgctaaggtcttcaagcaacaagagccatatgcacaacaagcggcccagcagatcggggaagacattcaagaaaatgagtttgtttttcagcctccttgatgaagtctgctctactgctttctttctttctctattgcagtctacctcctatcgtttgtctgctttctttttgcttgctgaaagttgttccgttacgtctctaataatacgctcctaagcgatttgtaactcatactccctccggattgataataccttgtcgttttggacaaggacatggtctctaaaaaaacaactttgatcattatttaaattgttaacaaatatatgatcatattaaagtattttttaagactaatctatacatgtagtcatcatatttgaaagacaaatattttaaaaatgattcataatcaaagattgtaaagtttgacttcacccttgtccaaaacgacaagtattatcagctcggagggagtagtaaatttcaccttaa

SEQ ID NO: 40137 - DNA, 1501 bp, Oryza sativa
tctacggctcgtcctagggtcaagggcggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcgcttgacggcaggcacgagctagacaccaaagccttcatcttcaaggagctcctcttctggacttgggaaaaattgagcaagactgagtacaaccaccgtactcaacaagacacacccacaaatgcagaataaatgcaagggagtacaagggaattataacatagaggggttagggttgcagtaaacagcatttaaagacatttagttgctcagggctattttataaacacgatcttagaactatacaatgttattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacgatatacggacggaagacgtgacatagtttccaacccatcctagccatagacaagagtaccgacccaatcccgcctacggccggaacccccgggacaggcaggcgagactgagcccctagcagcagggcaccaaccctctgccatatgacatctcgactaccgggccgcagctcgtgtagccttcatttgccctggagaatgtccatcgacccccgacttcatccatcttcaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccacttttggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttaatctagggtgaacaaggtaataataataacaataacaataataatatggtcataacaaaggtaaataggcatggctaaataaaacagtgataacgcggg

SEQ ID NO: 40138 - DNA, 1501 bp, Oryza sativa
gaacataaatcaccatttttagtgctatgccacatgggcatggaacgtgctcggcaaaggtgtgtgccaacaggagcaaactggctacttgtttgtgcttctgaaatttgcattttgtctgtcatgatcttatattctgcacttgcacgctcttctgcacctgtcaaatttttagtagtttcatgtatatccattctcagctcaaattttgtaaggtggtaatgttagcagttttactaccagtggtatgtgtttttgtgcctaatttatcctgtgcttggtataatctggtcattacaattgcaacagtatattttgcattagtatatagcgcaggtgagccacatctgatctgtttcggctatgccatttctgctattgtttgtttgcttccgtgggagctagggttccaccccttcaagcgagatccaacgcttagatctgctatcttccctaattttcagctagggagggcgtcatacagttgtagtgaaattgtcgttaaggaaatggcaagtgatcgattagtttgaaggtacaaccaattctgatctggttctcatgcccctgcagtatcgttcttcaagagctgctgtttaactgcctttgcttgtgaggaaagttttctagctctggtatacgtacaaaataatcattacttaacttttaccgatggaacaacaaggtgcttgattcattatgcgcacactccaaaggggggctgatgtctttccatgtgcaataaaaggcttatgttgatttgtttagtgaagaaaacctaagtacatgcaccgatttcttttttcagcctggcatggaaattagtgtgaggccagtgtcattttacaatacatgtatggtctattacatgtttcaactctcaagataagcctaaagcttaagcagcactgcagtaggctaacagttttgtgatttatgatcacaggcttgtaaggctagtttgtcttgagctacattatctgttttcttccagttggatatcttggtgaatcctaatatttatccagaacttactcctttggatatttatgtcctctaatgtatcagatgctttatgtgatcttaaaatgagtttgtagtgccagaacataagtcactgcttttagcgctatggttggccaaaggtgtatgccagcatgagcaagctgtctacttgtttgtgcttctgtaatgagcactttgtctggcatgatcttatattctgcacttgcacactcttctgcaccagcctatccagattttttgttagtttctcgtatatccattctcagctcaaaagtttgtaaggtggtaattagcaattttactaccagtggaatcgtgttatgcctaatttatcctgtgcttggtatgatctgaacattgtaatcacaatattatacatcttgctataatgtttttgctttggctgttctctagtaactgttttccttatcatgtaaaattatattatgttcatgatctatcttttgaacagcat

SEQ ID NO: 40139 - DNA, 1501 bp, Oryza sativa
atagacttttgcggagggatttgatttgggaaggatttggattcgggattgaactcgatgatagatcggggatttgagatctgagatggcacggacactagacaacaagcaaagaaacggatttcgcaaatagggtttttaagagatagtttttcccgctaggcgccacgacagaacgggcgctacagaccaccccccctaacaagaatctcgaccccgagattcagcacctatgggagtagctccgggaactcggtgcagagaagatcttctcgttcccaggttgcctcatcttcagaatgattgctccattggaccttgtagaacttgatagtcttccttcgggtctgacgttctgcctcttcaagaaccttgatcggcctttccttgtaggtcagattcttttccagctcgatattacccaggggaacttgttcttctggaactcgaagacatttctttaactgggatacgtggaacacgttgtgcacatctgcgagaccttcaggtaactcaagctgataagccacttcgccacgtctggcggttatgaggtaggggccgatgtagcggggtgctaacttgccggacatcccaaacctcctcataccacggagaggtgatacccgcaggtacacatgatctcctttttcgaactcaaggtcacgcctccgattgtcagcgtaattcttctgacggttctgcgctgtctttaaacgttctcggatcagcttaacttgttcttctgctgccttgagcatgtcaggaccgaataccagcgcttcgcccacctcagtccagcacaagggagtgcggcactttctaccgaacattgcctcattcggcgacacctgaatgctggcctgataactgttgttgtatgagaactcagcatacggcaaacaacgatcccaagtgccttcgaaatccagggcacacgcacgtagcatgtcttctaggatttggtttaccctttctgtctgaccatcggtctgcggatggtaagctgtactaaaatttagatcggttccgagagcttcatgcaactgcttctagaaccttgaggtgaactgagtgcctcggtctgacacaatcttcttgggacagccaaatctacatacgacatgggtcatgtagagttctgctagtttctttccatcaaaggtggttttcactggcacgaaatgagctgatttcgtgagtcgatccacgattacccagatggagtcgtacccgctaggattaaattttttatagcccgttcaataggattaaattcttctagtctttaataggattatcttaatttgtattaaattcttgctttaacacgtcgatcatattttgttgaaaatcatcatatttccatctttttatattatgtgttttctatgtaagtctaattatttaagatatctaatctcaaaaaaaatatttaagatatctaatatttttaaaatactgattatttagtctcatattcaacttaaacaagccatga

SEQ ID NO: 40140 - DNA, 1501 bp, Oryza sativa
tagaccttattcgttcaatcaaaaaaaaataccgaggatgaaattttcacatcatatatgtgaaataaattctactttcttcattctaaaatgttgcaatatagaacgtgatttaatgataataaatctgaaacaggttacttcctccattctaaaatataataactttaaaaaacggaacacattataatactccatccgtcccaaaataagtgcagctatggttttccgcgtccaattttgatcgttcgtcttatttgaaaaaattttgaaaaaaaattaaaaacataagtcacgagcaaagtactattcatgttttatcatctcatagcaataaaaatgctaattataaaaaaaatttaaataagacggatgatcaaagttaagagtgaaaactcatgactgcacttattttgggacggaggtagtactagaggtcaccccgcgcgttgctggggaaatttaagcaattacaaatgtcaaaattttggatgaaatataatcaccttaaaaggaaaaacctaacccaatttatcactgcgcgtgaggaatatttgtacaaataaaaataatcttcaaccgtaccaagttcatagcctgcaaataatatttttcaaacgtatggcttcgatattggtaccattaattggagggaaactcaactggcactcccttccactcatattatacaaaacaaattaagggaataagtaacaacaaattgctaaaagaaatgttgatccgctggagcatgagcatatatatagcggcaaaataaacgcagcagcatggctaacggaatgaaggattgatcgcaacgatcaagtatagcaactggactctggacaggagggcttgtggtcagcatgtcaatccactgcgatggtgttttcagaggaatcaggaataaaggccgagtattcacctaattcatttagctagaggatggaatatatgcagtgcaagtgcagtggaagatggaaggcctgctgcgtgagccaatgaatgaatatccaacgttttggtttcaatcagaagatgacccgtcaggaacaaacggtttaactgttgaataggcccctttgttaattactgtcgtgcatgatgatcggaattaaaaaaaaaacgaagaggtgcatcccactatcgctctttacaccctcatttgcaatctagcggctaggtggaatctatctgcaatccaacggtcaggtggaatagaggtgatgtggatcactcctggagaaggaaattagttttaattgtagttagtgggatgacctatatagatatatatatatataggatactgttcttattcgcaatattaaaatatatttcaattatttaaaaattgtttatatttctggacagacgaaaacaaacaataatccccgtgtcctcgcagtgaggctcgcaccgcccagcatccttggaaacagagtgagcgtccaaaaccggcggcgacgcgctccccgtttcgccgctttccgctcatctc

SEQ ID NO: 40141 - DNA, 1501 bp, Oryza sativa
ctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccgcccttgaccctaggacgagccgtagatcccaagccttagcaatattttcaaaaataaaaaaaaaatcctttgttatttgtgaaaactgtctagtctctctctgtcttgctgcttcacttatcatcaaaatctgacctttaaaatgttgtttctctttttgtttttgtttgtagatggccggcagcgtcacccgtcgtggtttggacatgactggcttcgttttggagctgcgaggcatgtgcgtggtcctggggtatccacacggagaggactaccaggccaggccgcttccggatcaggagggagatgacgcggagccccacgctgggtgggaggtcaccgcagtgatcctctctggctcccccgagcggacttcgctggcagtcaccgcgggtggagactccttccccgccgcttgccagaacgccgctctcctcgccatcggcacccttcaccagcgctacccggacgagttgcagcactcgccctaccgctaccaccctcgtcgcggaggagcccgcgactacgccaccttctgggatgctagctcggaggatgacgctaccatcgtgcacctggcacgcatggtggaggcgtacgacgcggctcgtatcgacttccatcagatggtacgccgcgggatggtcgagaacaacatgaagatcctggagctgcgtcaggagaacctgcagctcaagaaggacctcgacgcagtggaggcgcagctgcaccagctcaaggtcgcccagggagagatctgccgccccaagcgtcgccgtgtttgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcagtagacgagcagttagtaggcttgcgcgtgtgttctttctcgtttgtcttttttggagtcgtgtggggcatggttatgccggtgtgtggcacaactatgtcggagcctgtcttattttatttgcctaagcaacttgaacattaatgaaccaatttaatagcagtaataaatttaagaataatggtagtcgtgggtggttagttttaattgttagctctctctctgcttgctggctctgtgtggggttttc

SEQ ID NO: 40142 - DNA, 1501 bp, Oryza sativa
cggacgatccgccaccccgtgggtcgccgtcgccgcctccgccgccgtctcggtcgccgtctccttcctcggcttcgacgacgtcgtcgccaccgccaacctgctctacagcctcggcgcgctgctcgagttcgccgccttcctccggctccgcgcgagggaggagagcccctcctcgctcaagcgcccctaccgcgtcccgctgccgctccccgcgctcgccgccatgtgcctcgtgccgtcggcgttcctggcgtacgtggtcgccgtcgccgggtggagggtctccgccgtcgccgccgcgctcacggccctcggcgtcggctggcacggcgccatgagggtgtgcaggtccaggaagtggctcaggttcaacaccgcggttgccgccgaccatcgtctgcaactacaagatgctcctcctcctcctgctggtagagtctgaactctgaacccgttttggcagatttcgtcttgcgaaaagatgaaacacggtaagaaactcgaaatatttgctagtagaagactaattacaagctatactagtacaagactaattacatggttggatgaagctctaaagttggcgttttcatatttgttcctctaattaatcaccgtgtacgattgtggttcattatcagagacgcggtttaaattgaacggtctgtctctctcaaatctgaaatggtcacatttgtagtgaagtggacatccatgaaatggcgacaaggaggcggacatgatcatattcatatccacgtactaacccagctcctcttttgtggcacacgcggctccacactacaaacctccgttccgcgccacaaactgcaaccaccacacatgctccatcgcccgtagtcatcctacaaaccaatagacaccgcgcgcgcggaacgccatcgctgccacatctcatggacgacgtgtggccgtggctggccggcctggccggcgaggagccgccgccgccgcaggccgttgtcgcccttgccgccttcgctgacggcaccacgtccattgtcctgcaggccgaccacgtcgcattggctgaaggtgatgaggaagagaagactctagtagatttctctctcgccttgaacagcaccaatggcggcgcagcgcgcgtgctgtggacgtcgggtcgatttgaggccgcctccggtgtcgcgttgcagcggcagctgctggcgaggctgctcgacgaggtgatcacgctctcgccgtccgtctcttgcttgagcggaaacctcggactcggagtcggcggcgcaccgaagtcgaagttggacgaggagatcgtcgccggcatcgggaatgattctgccgcctcattcttctcgctgactctccttctgcgcctcttctggctgtgcgccaccgaggcacccgccgacaccgggtttctcttcttccaagctctcggcgccgacatccagcgcgctctcgtggactgccgcccagcgctcgccctgttcctggcctccctcggcccgga

SEQ ID NO: 40143 - DNA, 1501 bp, Oryza sativa
cgggtggagggtctccgccgtcgccgccgcgctcacggccctcggcgtcggctggcacggcgccatgagggtgtgcaggtccaggaagtggctcaggttcaacaccgcggttgccgccgaccatcgtctgcaactacaagatgctcctcctcctcctgctggtagagtctgaactctgaacccgttttggcagatttcgtcttgcgaaaagatgaaacacggtaagaaactcgaaatatttgctagtagaagactaattacaagctatactagtacaagactaattacatggttggatgaagctctaaagttggcgttttcatatttgttcctctaattaatcaccgtgtacgattgtggttcattatcagagacgcggtttaaattgaacggtctgtctctctcaaatctgaaatggtcacatttgtagtgaagtggacatccatgaaatggcgacaaggaggcggacatgatcatattcatatccacgtactaacccagctcctcttttgtggcacacgcggctccacactacaaacctccgttccgcgccacaaactgcaaccaccacacatgctccatcgcccgtagtcatcctacaaaccaatagacaccgcgcgcgcggaacgccatcgctgccacatctcatggacgacgtgtggccgtggctggccggcctggccggcgaggagccgccgccgccgcaggccgttgtcgcccttgccgccttcgctgacggcaccacgtccattgtcctgcaggccgaccacgtcgcattggctgaaggtgatgaggaagagaagactctagtagatttctctctcgccttgaacagcaccaatggcggcgcagcgcgcgtgctgtggacgtcgggtcgatttgaggccgcctccggtgtcgcgttgcagcggcagctgctggcgaggctgctcgacgaggtgatcacgctctcgccgtccgtctcttgcttgagcggaaacctcggactcggagtcggcggcgcaccgaagtcgaagttggacgaggagatcgtcgccggcatcgggaatgattctgccgcctcattcttctcgctgactctccttctgcgcctcttctggctgtgcgccaccgaggcacccgccgacaccgggtttctcttcttccaagctctcggcgccgacatccagcgcgctctcgtggactgccgcccagcgctcgccctgttcctggcctccctcggcccggacgtcgaggagcggttcatgcggtcgctcggctacacgctcgccaagctgtgcttgctacgggagatgcaagcggatgcggatcagccggcgccggcggcgacacggcgcccgcgcgcgctccccgcggtgtgcctgtcgtacgccaccgaggtgcacgggctgtgggttctgagaggatacgcgccggtgctcgccatgccccgtgtcacctgcgcggcatcgacgacggcgcccatcacggcgctgccgcacgaggcgccggaggagccggc

SEQ ID NO: 40144 - DNA, 1501 bp, Oryza sativa; identical to SEQ ID NO: 26895

SEQ ID NO: 40145 - DNA, 305 bp, Oryza sativa
acagtaatcatccgttaatcatagattaatatacctggttagattcgtctcgtaaaatagcctaggggttatggaattgattttgtcagtaatttacgtttaatactcctaaataataagatttcggagggctatttaatagcccgaaggatccaaacaaggcccatgtcactaagcataaaccataaagctccaagaagatattatgcaagacactgtaacaccaatacttttcagggcttaaatgatgcttaacatgagtgctaaacgtattaattaaagaccatttcttttcattccttagc

SEQ ID NO: 40146 - DNA, 891 bp, Oryza sativa
atatgtaattgtccattgttaaaaaaatttgctatgtaaagaactaggaaaaggaaaatcgattacttgcctgattcaagaaagatggtagtaccagtgcaaattaaagcatgtgtcaccctctatttcgttgtaatatgtctcccctcaaagtttctccactatagtgagccgatcgatcctctattcttttcgctctatataacttcaaaaaaaaaaaaacctaatatagtacatccttcattgaaaactgtatgccatactttgttttggttaggacaacactactttattatgatataatttttatggcgtaaaattgatcttattacattgggagcgtacgtctagatttttgtcacttttttctacctttgatggtaatcagtgattctcattgcttcttccttttttttcttctaaaaaggttgaataacatatttaaacataacaatatatgaaataaatttacaattcataaactttacaaattatataaaaaatattcaaacctaaataaaaataatgtaaagctaaatatgacaacaaaattatagttaaaaggagtaaaattacacattgcatactactgcaattttagaattattatcaatgtgcgattttaggtgacaaatttacaaatttgtatcccctattagatagatggatttatattcagaagtacttacttataattatgcttttgtatcacataaattatattattggtaaatatattgttaattaaagtttttttctaatgaaacaaaatattcttaataatagaaaacagagtagtagcatctatcattgtacaggcatttaggatcaattttgatattgtaatacacatatccttgacccacacacagcacctctgtctgaacaaaa

SEQ ID NO: 40147 - DNA, 956 bp, Oryza sativa
attcctgcagccctaattagctcccttcatttttaataattaagatatgccttttaaattgttaaatagtacatttctatgtgaaaactttctatataagaatttcctctaaaatatatcaaataaatataatttgaagtatgtaattattgaaacgcaattgatcatacgctaatgctttctcattatgggtgtacttacttagtcctcttgttcgtcttgcgaagagccgagagatttgtcattttgctatgtctaggtgtttcatattataagttgtttattttttttctctagccaaacttctttaaatttaattaagtttataaatgaatatagtagcattttttaacataaaacagacatccaatgctggattttattaaactaatttgttatttttgatattactaaatttttctataaatttagttaatcatcttaaccaagtttgactaagaaaaaaaactacaagtacacttcttttcaaggtacagcagcgtcacggcaaacccgtatttccacaagtatatacggtagtacaaaatacaatagagtagaagcaacaatcatttaatctttcacggaaaaacaataataagtaatatataaaataaaaacaaaataaatgaagcaggcagcaattaactcatgtcacatccgtgccgaaacaatccaacccaaaattcccacatccatttctccagcgacccatccatccatcgcctcctctttccctcccacctccacacgtcccctcctcttccccaatattccacgccaccgccgccgtcaacctccgccatcagcagcagcagcagcggtctcccattcccattctttgctcccacgcgaggctgcgcggagaacagctgcacaggtggggtgggggtgcagaccgagctgaggagtagccggagttggtggtgagagacgcgggtggggcgcggccatgg

SEQ ID NO: 40148 - DNA, 1501 bp, Oryza sativa
acgcggcacgtcgttggagtaaaattaataaacgagacaaacgacgacttcaattcattgacccggcccaacaggcacgatcatactccctccatactcataaagaaagtcgtttaggacaatgtttaagtcaaaccttaggaatataaatcatgaataactctcaagttgttgagtttgaaaatgtaaaaattatatgtatagatttgtgttgaaaaacactttcataaaaatgtacatatatcatttttcaataagtatttttatagaaataagaagtcaaaattatgttttagagaccgtgtcgatgtcctaaacgacttcttttacgagtatggagggagtatcgatttaattaattacttaattagggcatgcatatggctatttaatttgtagcactgaaaatgggtggtagctagagaagagaatctcgatgcgaattctagtagtacagctattgattattaattagtactacgaaattaaataaacggtctgtccgatttttttaatctaaacacatgcagcccttttattacgtatttgagcacaccatattcgtaattccatttctaacatatacatgcacaagaccacgtcaatccctcgatctaatgcctaacaaaataaatggacctttttgcaatcttgttcctagcaacaacgttcacaaagttagcagcccagtaatgtaaacttatttatttgtaaactagtactccctatgtatgacgccgttgactttttaaccaacgtttgaccactcgtcttattaaaaaattttatgcaaatataaaaatacttatgtcatgcttaaagaacatttaatgataaatcaagtcacaataaaataaattataattacataaattttttgaataagacgaaaggtcaaacgtttgtcaaaaagtcaacggcgtcatacattaaaatacggagggagtatcaatttttttagtctattactatattcagattatacttaaaaaatatgtaataacgacttgtaaatgcaaaatagcatattttgaaccatacttaataaatatgtcaaacattaatacaaagtaacataactcaattcaatggcctattattttgttggacattatgttattatatatgcaagtatgcaacaatgcttggacattatgttatgaaataacacctgcactcgagcatcttgtctacatattgaaatatgggtttggcgtgtttatatttagaattaaactgatgcatgtgcttacatgtaaaaaaatcagaataaatatactgggatcaattataccttaaagcgccgctgtacccctcgcacccagcccacgcgaaaatccggcaacatacaattttctttttgaaacttttgcttagagtatattatattttttttctggggaacaatgcaaggctacctattcctgctgtttataatttggcttatagttaggccgtgtttagttccattttagtatttttaagtatatatacacacatt

SEQ ID NO: 40149 - DNA, 1501 bp, Oryza sativa
gttatggagttggtgaagctgtcccgacaaaaggaggaagaacgcaaagttggatcagttgagctgctccattacatggccttggctgatgccaatgtcagacaagcagcaatcagcatggggatgatccaatcactcactcagctgatgaaccctgatcttccatactcatccaaagccagggaggttgctctctcagccattgcattcttctgcctcccttccaaagctctgacagatgatctcatcagctccaattttcttagctggcttcaaacctatctcaacaatgttgactatgctgtcctggaatgcaccctcaacattctggtacggctaacgaggatctccgaggaatacagcaagatggttggcagggcagggttcatgactgccctggtaagctcacttggagccaaatcttgtcaggtcagggagatggcagcacaagtactctgcaacctactgttgcttcactctaaccgtgtagttttcatccaagatggtgataatctgaaccggctgctgcagtcgcttgagcacggtgacggcaagacgatggcgaaggatttggccatttcttgcctcgtgtcgttggcagagaccagtgctggaaggaagaagatcatatcgtctcaacattttgtcagcttgaaaggactcgcagactccggtgaccttcctgccaagaagatcgtgaagaaactctgtgctaacaagttgcaaagcattcttacgagaatccggatcacatgacttccttctcgcgtttacctgatcgctcttcagttttgaaccacagaattcattgattcagcttttgctaccctgcgtggctgcgtgctgttcatagttcctctttgcctgttacattcttgttcagtcctcactactcatccctacaattcttttgtactatccatgaaattcttttgtgtagatcgcacggcctataatcaatcaatcgtttgtttgtcacatccaacttatgatttttgaagctttctgtagtgtttcatactttattgcccccaattcttaggtgcacaaaattgaacacaagtcgttatgccttactgctataaagccacattcaattcatgaccaggtgattttacaaaaccaaactaaaatataacacaagctagtgttccttggtacaaataaataagaactaaacgaaatttcatcttctttgcagcatccagcaaagatgctaacttgtaaacttgctaagaatggaaatcattttttctggttgaccttgaaaccaaggagacgtccctacgatttagggcgctcgcgctcgccatgcacccaccattgccgtcgcgccgttcgccgaggcctcccctctcttaagtactcctctctctcttctcttcctccattgattccctcctccgcgcagctcgcggcttcgatcgatcgatcgaccgatctcccacgtcgccgccgttcgatcgatccgccgccgccgccgccgccggccggccgggca

SEQ ID NO: 40150 - DNA, 543 bp, Oryza sativa
  unsure (1)..(543): unsure at all n locations
acacattgcaataccccgcgcgaatgtccttttataaccacccaaaaaaagggtgtgacaacaaaggaagaaaaaaccccgagagtggagaaaaataggaagaaaggtcaagaggcccagcttgttaaaaggatttgcctcggtcccggtgtccgggcccataaaaggcccggttaattcataatgttcggtcggtcaggctccgttaaaccataattactccgccgccccaggctggcctggtagtcctttacattggtgaacccgtcgaaccagtgtgtatttaccgaccggcagtagcacggtgtaaacggcacacgcacggctttgccccgcgaagatacggacgctccacaggtctcttcttcttcttgagattaaacaaagaaaaaagaagttgagtagaccagctatccacccggctggcgtgggaatcccatccaatccgcgtcgttcgtgcggcgacgccggtagcgggganggggtgccaaatggtgggggatcaggagggaagcgacaatcgtcgncggggttgggggnagt

SEQ ID NO: 40151 - DNA, 1501 bp, Oryza sativa
tttccttttttgaggatattttttgaccagcaagactccagagagaatggggttgagttggagggaatggaaaggaaaggaatttggcgggaaacattggcgccagatgccatggaacaaggatccagccaacagtggttcagcaatcaatccccactatgcactaatagccaacagtatacaaatacactatttacatgctggaacacactaacaatcatacaaaactacaatgtaaattttcttttcaaaactatcactataactttaactggtatttccccaaaactgcaacatagcaaagattttattaaaaaactatgattttatcttcctataagttttatgacatgtgagccaactcataccagaatgagtaacatgtatagtatatatgacaggtgagtgcaaatttatcattcaaatagagttgtagtttattttataaatcatacgatattgctgtagttctcttggaaaattttgagctaacgttgtaacagaatgatagttttttttttttttacaaaaaatagttgtagctatatgaaatatactataaaaattcagattaaaatatacaacgtgtttgcagcttctgttcgtatataaatcaggcccaaatactaaccgggagcagcccaaatatttaagcccatacctactgtctgaacaatcacaggcccagagtgccacatttttttgggcccatatcatcgctatttcgccggtttttggtaggatgtgtggccagaaaaacaaaactgaacactgcagtagatcagaggaccaacagcaacacaagagaaaagaagtcatcacatctacctgctacctaactggagcacaacaaggctaccagcaagcaggcagattgtgcaactgccatctactcaccaaacaccaaactctccctctcgcttctcttgcaaaacaacctttcctgaaccaaaatcaaacaaaccaacacctgttcaacagtctaatcactagtcactagtctgtctgctgaattgttctccttaataacgtaattaatccatccactgtcaaaccaagaaacaccaaaagatggaaaaggaaaccaaaggcagaaaccattattctcgcacagcacaatgtaatctggtccgattggtcataaacatggtctcattctcatacagggtgtgcatatcacaatatcttcagtagacaattaattcaggaggatgcatatcacaattagcagtagtttagtcaattaattaatgcttctcttctacactgatgctgcaggtttgcttttacttagtagatccaatctagaacacagcgagtcatcttctttatattcattccattcctcccaaagacgcaacgtgcacacaccaccaagaccaccaccttcatcttggttggcttcgttcactccgcctacctacctacctctgcagttggtttgctgaaccctcctcaagaacccacgcctctcctctcgcggcggcagctaaccgagcca

SEQ ID NO: 40152 - DNA, 1501 bp, Oryza sativa
agcaagctacagctccaactgtgataattataggagggactaagtattttatgatccgatggttttttttgggagaggttgtttggcatggtgaaaatcctaaacggacagcaccacatagccctgagttcccaaccaaggattccagcgtgatgtttgagaagacacctgtttctggtatttgaccatgtaggttgttgaaagataggttcaagctggaaaggacagtaaaattggccaggtattccgggatggtaccggaaatattgttgtgggatagatccaaagtttctaagctggtaagcacacgaaaagaatctggaattgaattttggaataaattgactgataggttcaagtaggctatcatttgaagttcaattgaatctgggaggatgccagtgaagtggttgctagagagatccatgatattcatttgcttcaaatagcctatatcagccggtaatgcaccacttaagaaattgtgggacagatctagtttaacaagtctatcaagatgaaataagctcggtggtacagtggatgctagttggttatcagataaatctaggtattctaacttggtcatgttactaatgcccatcgatatggagctggagaattggtttgttccaagaaataatctttgaatattcttcagcacgccgatatttgacgggatggggccaaacaagctattttcactgagatcaagccactgtagtatctccaaatccatgattgattctgatattgtactgtgcagttggttatcactaagatctagatacttgagactagttaagttccaaactgtagatggaaggacaccggatatattgtttcgacgtgcgatgaatgcttgcagcgtgcttgatagattgcccacatagtctgggaggtttccggtgaaataatttgagtcgatttcaaggacagaaagcttcctacagttggaaagagcagacaagaatttgagatccccttgtaagctattttcgaaaataacaaagtatgtcaaagagttcatgctgccaactgttgctgggacagatccatccaacaggtttgtgctcaaatccaggcgtgataatgcagataagttgccgagagaagcaggaatgggtcctcttagttgattccttgcaataagcaaatctgaaagttttccaagctttccaatatctgctggaatggttcctgttaggttgcacgtgctgagctctagggaagccagcatggtaatgttgcttaacgcatcagggattgaaccaccatcgaagtgattctcacccaagttgagcttgacgagattcgtcaacttgcccagccatgatggcaaagcaccctcgaataagttctgaatgagggaaaaaacctggagttgctggcacgccgcaaacccctgtggtatcggaccggtgaaattgttggcatcaacggagaaaaaccagagactcgggagtctgaagctttcgttgcctgggatagggccagttaa

SEQ ID NO: 40153 - DNA, 812 bp, Oryza sativa
tctcccattgaaagtgagttccatgtttcctgatattttgggggaagacaagagtactcgggaagcgccggttcaggattttggagatagaaccagtttgcgtgccaacccttgttggatgttttaaaaggcatggagaagtatttttggctcaaggtaccccgtagttggaaacctgctcccccgataacacattgcaacccccatcgtttggctttatccataataagccaaaacggcttattaggaaatacaaatgaatttgtaggtaaaacttttatatgtgttcttggtgatttaaaaaccaatgttgttaaagaaactacgttgaaaatatctcaaaatcaatctcaaaattaagtttgaaaattttaaaattggcttattctttggctgtttaggccatatgatgggagccggcttgtttttatttggttggggtttcaaaaagaagatgcgacggaatagggcgaaatgcggcctaattccctggaaggcttcacatacatgaacaaagtttgcaatatgcacaatggagttcgggttaaggtgatgcaaactgattccataaaattcaagaatcccccaaagaacttcgaagttggaagggcaaaaccaccatagaagtagtgggagaatacaacgacctcatgagtgtcgggggtcgggaaggcttcgccatatgctggacgccatccgatgatttccttcgccgggagaacgccgtgcgccaccatttccttcaagttcttctctgtgacatcggagggtgcccattgactctcaaagctttctctctcctctgccataga

SEQ ID NO: 40154 - DNA, 1501 bp, Oryza sativa
caaccaaccagggatcaccggaaacaacagctaaaactttgagatcaagaagaagaagaagaagagagaatcgaacctgggcggagaggatctggaggtcgataccggcgaggcgcttgaggtgctccttgaggaggcgcttggagtcgtactcccggatcttcttgcgcgccatggctcggttagctgccgccgcgagaggagaggcgtgggttcttgaggagggttcagcaaaccaactgcagaggtaggtaggtaggcggagtgaacgaagccaaccaagatgaaggtggtggtcttggtggtgtgtgcacgttgcgtctttgggaggaatggaatgaatataaagaagatgactcgctgtgttctagattggatctactaagtaaaagcaaacctgcagcatcagtgtagaagagaagcattaattaattgactaaactactgctaattgtgatatgcatcctcctgaattaattgtctactgaagatattgtgatatgcacaccctgtatgagaatgagaccatgtttatgaccaatcggaccagattacattgtgctgtgcgagaataatggtttctgcctttggtttccttttccatcttttggtgtttcttggtttgacagtggatggattaattacgttattaaggagaacaattcagcagacagactagtgactagtgattagactgttgaacaggtgttggtttgtttgattttggttcaggaaaggttgttttgcaagagaagcgagagggagagtttggtgtttggtgagtagatggcagttgcacaatctgcctgcttgctggtagccttgttgtgctccagttaggtagcaggtagatgtgatgacttcttttctcttgtgttgctgttggtcctctgatctactgcagtgttcagttttgtttttctggccacacatcctaccaaaaaccggcgaaatagcgatgatatgggcccaaaaaaatgtggcactctgggcctgtgattgttcagacagtaggtatgggcttaaatatttgggctgctcccggttagtatttgggcctgatttatatacgaacagaagctgcaaacacgttgtatattttaatctgaatttttatagtatatttcatatagctacaactattttttgtaaaaaaaaaaaaaactatcattctgttacaacgttagctcaaaattttccaagagaactacagcaatatcgtatgatttataaaataaactacaactctatttgaatgataaatttgcactcacctgtcatatatactatacatgttactcattctggtatgagttggctcacatgtcataaaacttataggaagataaaatcatagttttttaataaaatctttgctatgttgcagttttggggaaataccagttaaagttatagtgatagttttgaaaagaaaatttacattgtagttttgtatgattgttagtgtgttccagcatgtaaatagtgtatttgtatactg

SEQ ID NO: 40155 - DNA, 1501 bp, Oryza sativa
  unsure (1)..(1501): unsure at all n locations
ccagtgcttcctccagacgtgcgccacctcttcgagcggcacgcacttggtctccgggaggagggtggcgatgaagacggtcatgaggaggacccaggcgccgaagaagtagaagaggccgaagcggaggtggcagaggagggtgaggaagatctggctgatgaacgccgtgaagaacatgttcaccgccaccgtcacgctctgcgccgccgacctcaccgccagcgggtacacctcgctcgggatcagccaccccatcggcccccacgaccacgcgaacccggccacgtacacgcacacgaacagaacgatgcacatcgcgtactgctccgacatcgcccccgtcccgctcaccccgaactgtaatccgatgaatgttcccaccaagatctgcaaagaaatcaaacaagattgttaataaattaaatctttggttttgcagacaaggtgtttgatgaaatgggtgagtgcttgctgaataaattaaatctttggttttgcagtcaaggtgtttgatgaaatgggtggttgcttgcttgcctgggagatgatcatttgggtgccaccttggaggaagagggcgcggcggccgaccttgtcggcggtcatgacggcgacgaaggtggagaagacgttgacgaggccggtgatgacggaggagacgagggaggcgtcctggcggaagccgacggtcttgaagaggacggggnnnnnnnnnnnnnnnnnnnnnnnnnnnnnnnnnnnnnnnnnnnnnngaagaaggggatgagcaccgcgaacgcgagctgcggcttgtacctgccgccgaagaagagctcccgccacgggtgcgccaccgccttgctctcctcgctcgccgtcgtcaggtcctcgaactcggcgcgcacgtcgtcgacgccgcggatcttggccagcgtcgcgcgcgccgcctcgccctcgccgcgcgcgatgagcgacaccggcgtgtccgggatggccagcgaccccagcgcgatcaccgccgccggcaccgtcccgaacgccagccccacgcgccacccccacccgccggcgatcttcgacgtccagtacgttgtcaggctcgccgacaggatccccaccgtgatcatcagctggaacagtatgttcagcatcccccgctgctgcgccggcgccatctccgatatgtacagcggtgacgcctgcaggccaatcaccggcgatcgatcaacaactgatatataattttgagtattttctacaccttagctgtatacatgcggtttaaatggttatataaaattttcaaaaagtttgataagatagattataatgatataagacactatagaaacatgtaagttaaaattcaataataaaattaacaaatttttatgggttgtacattacaattacaatgtactattcactgtttgattttactctttttttttctaattgtagattaaatttaatcttacatgcttatctatagatttatatcatttcaacttatgttatt

SEQ ID NO: 40156 - DNA, 431 bp, Oryza sativa
tcctgcgccccaattatctaaccgcacaaaaaggattttaacagtattgggcaatttcgtcgtgagcaatttttgccaaagcaaaaaatatgcctaagtccctaaggatcacaaccagccacacctaaagtgaagttgggctgaaaatactgttaaggcccaggcccattagtatttcccgataccctagtgaaataatcgcaaaaatagaacgctacttcgtcttccccgccgcgatctcatccattttccccacttctcgctacagtgccaaagttgcgccggcgaaaactagggttcacaaacacacaccaattcgcctcgtccgaagcttcgtgcttttgcgaaaatcttccgcacaaccaccgcatcaatctcccttccaatctccgccaccctcgctccaaatctcatcatccatctcgcatcta

SEQ ID NO: 40157 - DNA, 1501 bp, Oryza sativa
atgccgcaggcaccttgctcagccggcggtgacgacgacgggcacagacgtcagcgtgaacgacggtggcgtcgaccactgtaacgccccgctttccgcgtgacgttaaaagctaatttacgaaaaccctacttgcgaaaattttgttctttgagtgctgagtctaaagtcgtgccgtagatctcagtctaaaactctcctttgtctcaattcccgattgtcaaatcatctactcaaaatctccatccaaaatcaatacttgaacctattgtattcatatctcccttctaaaacctctaccgagatatttcccttcaaataatttccgtttcgttgtttcccctaaggtttgagtccgcactcaaatcctcttcatttactccttcgaaggttccacgttttcaaatcttagaaccggtaaaccctaaaacctaatctacctctcacctttcgttttgaagacagtttcgaagtccgaattcgtatattcggatttcgttccaaaaacactaaccacaaatatcgtcgcatccatgaatccaatctagtccaagcatttacctcgtaaatcctaaacctttcccttgatctccctcccatgatttttccatattcccctaaacctaattcccccaaagtgatcgcccaccgagaatcctcaaaccctaaccctaattctctctaatttcaatcccgtagcagaagtctagttcacctcctctccatccttgggccaacttctctgcgaagtctgttttgcctccctagcttggcccaacactccccagcccatcttcctctctcctttccctctcccacgcgtcctctgccgagcccaccgagctaatttgtttcgcgcgctcgcgcgtggtcgtggccgaccgccaaggatgatgctgccatcaccccttaccgtcactctaccgccttgtcctcgctccgctccacgcccactgcaagagtagaagtgaaagagaggagagagagaggatgacttgtggatcccacattgtacttttcttaataagccgtgatgactagagcatgacatatgtgcaacatcggaccaaaaccatccaaaaacaatgctaggggatatcgtccggcttcaaaaatccataggtatagaatgtctttacgaggataatcaaactaatgcaataattcagggtaaatctcagactttatatatgatggttaagactataattttttaacttgaaataatcgatatactagatctgtagtcaatcagaggtttatctttagttaacttcaatctgtagttaacttggtggatacatgtgactggggtatatctttttatattattgaatcaatcagtaagagatcctcgcaaactatttgattactcgagcggatacctcttgtttgcttaaaaactattcaaatagttatgaaataaaaatttaacaacactcatacaacatatttatacaacttcacaaaatcttaggtccaagctcaacttacatgttga

SEQ ID NO: 40158 - DNA, 1501 bp, Oryza sativa
caacattgttgagataggtttgaagccagctaagaaaattggagctgatgagatcatctgtcagagctttggaagggaggcagaagaatgcaatggctgagagagcaacctccctggctttggatgagtatggaagatcagggttcatcagctgagtgagtgattggatcatccccatgctgattgctgcttgtctgacattggcatcagccaaggccatgtaatggagcagctcaactgatccaactttgcgttcttcctccttttgtcgggacagcttcaccaactccataactgcaccttgttccaccatgaacatcttcacctcctccaccctgctcaggttcttcagcaccgcgaaagcggagctgaccagcttgcccctgctatcgacattggcgcagacgatcaggagcacggtgacaccgccttgtgcgcagacggcccagacgttgtcggagttgctcgtcagctccctcaatgcatgagctgctctctcccttgatgaaacagtagtgctggtgcagcttggactatccagtaactggacaagtggagcaaccacacctgctttcacaagcattcctctgtaagaatcatagcctgcaataagggagacaattcttgcagcctgttcttgaatgcatgcatcccctgattcaagaaagctgatcaggagagtgatgctattatcaatgtcaagagctacaatcttgacatactcgatatcttcagataggagctctccaatggtgaccagggcttgttttctttgagccaaatccccaatcctcaccctcaagaagagatcattgatgtagaacctcttgttgcttaagcttgcaccaatggcaggcctcgttgcgatgacagcttgagaacgcacagaaattctggaggaaaccatctccttgaggtccttcaggtggatatcaagcttggagctgatgctgtccaaatcactcctcagacgaagccttccaccattgtaagattcatcgctgcattgagaagcaatagcttgaatatgacttactgttgctgtagccgtctgaagaaactgaacaagaatcacattttcgttgcagctgccgtcgtctcctggcgcattcaggttggaacagagttgctgaagcttgtacttgatggattgccacttgactgggaactgaacaatcgaataagccattgatgctgaagccgatgcctttaaaatttgcagcttctcactgcattctgctacctccattcctgcactcctgttgggatcaaaactggttcttggagttggagacatggaattgaagatatgcagatagtagtttttctgtttagtaaatgataatgataaggttcttatagctctagtggtctgcaatgtatatgcaaagcccagctggcctggccagatgaatggatcagttggtgaatccatttgatctgtctttttgctgcctccttttggtttcttcgattggaattttgcactgctctgcctgcc

SEQ ID NO: 40159 - DNA, 1501 bp, Oryza sativa
gacgtcccgtcggtcgcccggctcgtcgtctcgcggcaccgcctccgtcatcatcatcgctgcggcgtgttccacaccgtcctcgtctccgtgcagccgctgccggctgtccttgtcgcctactcgccggtcccggtcgtcgtcgtcgtcgtcgtcctctcgtcgttcccggtcgtcgtggcgttcgtccctccgtcgagccgttctcgtccgtcgtccgcgtccgtcaagcaagccgcggcagccccgtcctcgtcttcgtcctcggctccgcgtcgtcaagccttgtccaaggatcgccgccgaagtcgttccctcgccgttcgcctccgtcgttcccgagctgtcttcgccgcgcccgttcgtcgttgtcgttcccacgcctcgtcgcgtggtggtaaggatccgtcctctcgcttccccgccctcgtcctttcggtgtcgccccgtacccgttgtgcggttgtcgacaccggtacccgtgtaccggtgtcggtagtcgttcgcttgtgcgtgtggtgaccgtgttagtgtgcccgctcggtagccgcgtggtttctacgtgtgcagcccgtgtggtgtctagtggagtccgtttgttggccactcgcctcggttgacacacggggtccgcttccgtcgacccgtggaccgtctctgtgtactcggtctaccgtggtcctttaggttacatgtggggtccgcatgtcaacagcgcagccttcctgtctcttccaggctagcgcttacacatgttttataattgcaaagcttaattataataatccgcaaatctccatataacagcatcaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagctttcgtcgttccggaggttcccgaagcgtggttcgcggtcgtcgctgaaggttcggaaggccgttctctctgagcaaggcaagtcacatcatccttgaacatattgaatcccagtttataaaattattttgatttaaattattgcattattgctttatttaaattcccgcgttatcactgttttatttagccatgcctatttaactttgttaagacattattattgctattgttattattaccttgttcaccctagaataaacaaaaccccaactagtgggtactctattcgtggttccactagtataaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttctggtggggtttgggtgcatgccagttgtgggaagtagcaccccggccactataaggattaa

SEQ ID NO: 40160 - DNA, 1501 bp, Oryza sativa
gccataatgccacctaaatccggccaacaatttttgacagtcttattgtcttaggcccaagtgttcaaccttaagatcatccactatcacaagtggaggattaatttgtatgtgtccaggtccataattcttcctcatgccatccaagtttcgttccttttcggagaaggaattatatatattaatttcaccctaagacaacacgatcactatcaaattgcaagttgtgaaactgtgtgaaacttcgcagagcccctgttaattggacatgcaggctgctaatatgaccagatgtaatacagtgtggttgataccgatcgatctcggccgttgagaaacagtgaaactttgcagtaacccagggattcggatcctctgcattaccgcagagaggcactgtagccacagtgatatgtgaggggaacagtgtgtcaatgcacagaacactaccgctacagtgatgatttactgtatctacagggataaaattgataaaagttcgccgcgcgagttacggagtgatttttttttgtcacgaacgcacccaatgcacttcaatatgtccaaaaaatcatgttttggtgttttttaaactttttcattctggtaaaaaacatcgcacccacgtgtgccaatatatatcaatattgactttaattgacaaaggttagccgcgcgggtcacggagtttttttttttttttgccacgaaagcacccaatatactccaatatatccaaaaatcatgtttttgtgatttttgaacttttttatttcaatgaaaaacatcatatccacgtatgccaaatataaattaaacaccataacaagatcttagctaaggtagctaacacggactctttttatatatatcttggacagtacgtactgtcagttaattaatccaattgaatgatgaattaatgaatacacaagatgaataaaaggtttgaaaatggaagtggtgacgcgcgcggcagctccttgctgacggaccaagattacgcaataaaaagcgaggaacgacacaggcctagactggttggaattaattaaggtttgtaacagcaataatgcaatagttaagtaagtttttccttgatgcatgttaaccatttcgacggaagtcggtcaatgatgaagttgaggtgttgggttatgaagggacatttttttttttgcgggaaaggagattatattactgagaaactagctagctcctcgttaacgaggagagagttaaaaaattacagctattatcagaccaaaagcccttattggctaaagtatggctacaaccattttgacttgggtgaatcttcttgatgaagggacaaattaattgatgtacgtagaaagaggcacgttggctaaatatataaccagctagctgcaacggaaaaggttgactaacttgcgattcgttaattaaatggtgcatgaatctggatcgccaacagctagcgtaacatgcatgtagattccatccatcgtgtgccccg

SEQ ID NO: 40161 - DNA, 1501 bp, Oryza sativa
caccgccttgtgcgcagacggcccagacgttgtcggagttgctcgtcagctccctcaatgcatgagctgctctctcccttgatgaaacagtagtgctggtgcagcttggactatccagtaactggacaagtggagcaaccacacctgctttcacaagcattcctctgtaagaatcatagcctgcaataagggagacaattcttgcagcctgttcttgaatgcatgcatcccctgattcaagaaagctgatcaggagagtgatgctattatcaatgtcaagagctacaatcttgacatactcgatatcttcagataggagctctccaatggtgaccagggcttgttttctttgagccaaatccccaatcctcaccctcaagaagagatcattgatgtagaacctcttgttgcttaagcttgcaccaatggcaggcctcgttgcgatgacagcttgagaacgcacagaaattctggaggaaaccatctccttgaggtccttcaggtggatatcaagcttggagctgatgctgtccaaatcactcctcagacgaagccttccaccattgtaagattcatcgctgcattgagaagcaatagcttgaatatgacttactgttgctgtagccgtctgaagaaactgaacaagaatcacattttcgttgcagctgccgtcgtctcctggcgcattcaggttggaacagagttgctgaagcttgtacttgatggattgccacttgactgggaactgaacaatcgaataagccattgatgctgaagccgatgcctttaaaatttgcagcttctcactgcattctgctacctccattcctgcactcctgttgggatcaaaactggttcttggagttggagacatggaattgaagatatgcagatagtagtttttctgtttagtaaatgataatgataaggttcttatagctctagtggtctgcaatgtatatgcaaagcccagctggcctggccagatgaatggatcagttggtgaatccatttgatctgtctttttgctgcctccttttggtttcttcgattggaattttgcactgctctgcctgccacaggctcgaggcatcttttgctgcaccgaagtgggttagatttagtgggataggtgggtggagtgctggggtgtaaagcatatccttaatataaacctcggtagggttgattacacctgataatcatatataaactgcttctcattgtgatatgtgcaaacatcaactcttccataaatgcctttatttagtaaaatattaatattcaatttaccttttcccttctttgttttgtcctatggaaaaaaagctggctggcaccaaacaaacagttctttttcttttcccttttttttcagattgcagtagtaccatacaaacttgcattgaaagaaacactgtataatggggtcatctatgatgcagaatctgagcgctactgcatggtggacctacagaccccaaaaatatgcatgacaaaa

SEQ ID NO: 40162 - DNA, 1501 bp, Oryza sativa
ttttagaatacccgtcattctagcgttcaaattatatatcaaaatacttgtcattctcatatttcatcatagcatgtttatatttcatcatagcatgtttagagaggtgaagttcctagcttccttgcttttcatcttgggcaattgcaaatttaccgctactttaaatcgttattacaagactgtcactacaaaattgcaaaaatgacactagaactgttattcgagtggcatccttacaacattaaaaaaacggtggcaaatttgcaaatgcccctcatcatcatcaaatgtaaccatgtgcagctgttaatcacaattgacagctactgtaaagaactattcggatgtccttaatgagggtaatgatgtaatttgtcatatcccctgtttgatctgtaacggagaggtatctgttttccttactcaacttattaacacgggaaaatgtgttctcacggcatagtttcgctgaatatatatacacacacacagtaataagcagtttccagttcttgtaaggtctggagtgttatgggtcactttttctttccaattggaggcacgttcaagaacacatgggttcttaatatagtacacttaatataatgagctctagatctagatagacggacgatgggcggacctggagcacagcgtcataaggggataggctagcagcagcaggcaatgtgtggatccagtggccatgattggatttatattgctgaattggtgaattttagggactatattggatttcgattttattttatttttgctccaaagatattagcgaatgcgagtctcttatcagggccgcgtacgaaaatcaattttcatttgcgtcgagggaggcacctatgaaaaagattgattttcacatgcggtgtgtccatctgctgccagctgcaaaatccattttggccgtataaaaataaatttgatagtagccggtactgatataaattaaacaccataacaagatcttaggtagctaacacggactctttttatatatatcttggacagtactgtcatttaattaatccaatcgaatgatgaatgaatacacaagatgaataaaaggttttaaaatggaagtggtgccgctagtgacgcacgcggcagctcctgttgctgacggaccaagattacgcaataaaaagcaaagaaggactcagacctagactgggttggaattaattaaggtttgtaacagcaataatgcaataattaagtaagtttttctttgatgttaaccatttcgacggaagtcggtcaatgatgaggttgaggtcttgggttgtgaagggacaaattgatgtacatgtacttatagagagaggcacgttgggtaaataaccagctagctagttgcaatagtatagaaaagtaagttttgactaattaattaacttgcgattaattggtgcatatgaatctggatcgccaacagctagcgtaacatgcatgtagattccatccatcgtgtgccccg

SEQ ID NO: 40163 - DNA, 1487 bp, Oryza sativa
ataagtgttaagcctaacatgatcaccttaatacggaatccttaggttactgaccgttgtttgaagccattgatgcgattctccctgttcttgtcggtgtagaggtagtagtggtagcagtagcagtgtgagcaccggcttgatcccgaaggggtcgccgccgatcacttgcggggtagcggcggccttctggtcgccacctacgctgtcccggaaacaccacacgttctccctccagcgctcaattgatcggataggtttttgggattttcggggaaaagaaggtcgtgaagagatcgtcatctcaccatgacaccggcctcccctattagtatggcgctgagggagatcgggggtaatccaaaatatggaaagatttggcgctaccgatcaatgcgcataatcacgtaattatggaaattgaatcgcgttaatcccgtaggcaccgggtggaaaacggccatccgagatttcctctcgattttcatgccgagagataaactttcctaacacatatagcatcaaactaggttgtgtttagatcaggggtttggcgtatcacatcaaatatacgggcacgcatttgaagtattaaacatggtctaataataaaagaaattatagaatccgcctataaactgtgagacgaaattattaagcctaattaatctatcattagaaaatatttactgtaacactacattatcagcttaaaacattcatctcgcaatttacatgcaatctgtgcaataagttattttctcatttatatttaatactctatgaatgtgtccaaatattcgatgtgacaaggtataatttttttccagggatctcaacagacccctaatatatgtcgtgctcttggagcgatataatggttctcaacggcagcgccgggccccggctgggaatagcaccgcccagcatctcctcgtctggctggataagaccattcccaacccaagacattaaacatagtttccataaactccacattatcaagtactaaacgctactcttctaatgcaaacaccattattccacacttaaatttaatgctacttatcacacatgatgccttggatgttgtgtagaaatcatgtctcatgcaagacatgatttccttctctttcctcatttattcacttgtcatatcatttttcattctaggtggcagcttatttaatgttatggacaccatcctagtcattgggttgggaatgatctaatagtactagctcagtgcagtgaattgaagtaaccgtacgaactatagctagtacactgatgtctgaacgtggtgatttgtttcaaaattttgctgatattcttcggaattgttatgttcatcaatgttcgtaaaaaaatcatttggtataaaatatctttaaaaaaatcaagttgctaactgcatgagcaaaatgagagaaaattgcacgattactgatgaataaatataggggcaaatgtgcaatagcaagtaa

SEQ ID NO: 40164 - DNA, 1501 bp, Oryza sativa; identical to SEQ ID NO: 39858

SEQ ID NO: 40165 - DNA, 1326 bp, Oryza sativa
ggaagcggattgttgtgctgctgggcagctggactctaggagtccgagaaaatgaaaaaggctctgggagccgcttaatcaagtgaaatggctctgggagccgggaagtaatgatttgacccgggaggtcaatacattaccaattgagttgttgaaaagcatctcttaagtcgaatcaagacgcaagtctccttttcgacccaaacttagaaagaaataaatcacttagtgatttctaaatgatttcaaacaaaggatttgtaaaacaaccttacctctcttccaagcttgcattaaacacctaattcccgtgacttgctgagtacgaaagtactcaccctttctctatataaatatatatatagttcctccgtcgtgaagtgaagatgatgtgaagtgaagattagggtttcgtcctggttcccagccgtcgcctgtggtgttgggtgttagtccgttggttccgctgctgctgctgctgttggtgttttcctcgtccgcgtcgtcggttgcattctcgggctgttctgagctacaacctaagttaaggtaaataagtcatttatttattttaaggattgcaatgattcatatttgtcaccgtgggtaccagcactatgtcctgggactggtactgtaatcgcggtttcgtaggaagcggttcacgccgtttttcctacgacacgctcctgtcaggtgccgttgtacggcggtgccggatcggggtgtgacagagatggtatcagagcattagttggccctaggatcgaaacccctgaataggatggcattaattgagtacaaaaactatttgtgaaagctaaggtgtcgttgtcccctttagctctagttttgcgaaaaatgtttttgtgtccaaaagtagaagctagtcgtttgttttgacatgttatcctagagtaaacctgtcttcacgcccagttgaagaaaggtgtgctcaagcctctaggcgtcttagttaagcccttgttggtaggcaaccctagctccgtcacccgctcggtaggagttgtggtgaactagtgcgtgtgtgagttttgtttggtagcccgtgttcaggtgttagaccagttgggttaccggctggaatacaccacctatgtcttctgcgatttcgaaaaacgttttgatctagtgtttttgttttcctccttttcttatcccatttctggttcggtcagatctcagtcgctttgaagtagatggctcgtcgttctacccgtcaaacccgtgctcctaatcgctttggttttgaagaagagccagttcagtcagagattcccgatcaaccagttaaccaagcagatg

SEQ ID NO: 40166 - DNA, 1501 bp, Oryza sativa
gctcacaatgtgtatatattgatataacgtacgtactactactactgtgtagcgcccgctcgttggagacgaggatcgctgtgaaataattggaatacatagctaaaatatgctccccacccctaatcagatcaggtttgggttccgtggagcagagtttggatcggatccgtgcggacggctgtagttatagggcggtaataaagtcgaggtcgcaattgacgacgatgagctcgcgtcgtgtcgatgtgccgcccgtgccaggttcctcgttgggcttggcggtggtgaccgcgcgcggcgggctttggtacgtgtggtgagggtctggtaagcggaagcatgggccgatcgatggttggcattgctggctaactgggctgttcggccttgcccttgctgggcctggtcagcgtggctaggctaggtgactggatagacctggccggcgtggtgctggctcggcctaatctagctggctggtttgagcatggccgactgggctagcccggcaggtttccggttctgaagaacttactttgggaataagttcacttgccttccctcaactttacattaagtttgttcggcataccttaccctcaatactatatatcttcaaccctaaactatacaaaaccgtgcaatttagttcctatggcagaattagcagctggtttcgttgacgtggtatcctagtcagcgaaagaaaataaataacatacgggtcccatatgtaagtgagaagaaagaaaaaaaatatatgtggggcccaacgtgtcaacgcttctcttttttacccaccacgcatgcgaggtcaacatctggggaggcagcagcggctggggcggctaggaggtggtggtgacaaggcggcttcgactaggggcgacaaggaggtggtgatggctaggggtggtgaggaggtgacggcggcgctacaccggctgtggggtagcgatgaggcgagctcagctgggggcagccggtctgtgcggtggcgaggcaacaccgcgctcagggtgttcgccggtcatcctcttgttgcccaagcacctcgctcgcgtttcatctcctcttcgttgacattggcgagccagagccacgacagcgtcggcagcagcgcagggtggggtagaggatgtagcctcaaatccgggtcgacgtcgtgaacctcgaagggagaggaggggagaggcggtcggccacgccggcgagagagggggaagagtaggccaacgaacctaggagggagaggggggagaggcagctgaccgtgcgtggtggagagggggaggaggccgatgaacctgggatggagaggggaagagaggtggtcggcatccatttcacgcccagaaatttagccctaaatttccagactattttgtgtattaaatccctgtccaggaccagccagggtacacaaaatgacaagtaatatacagttccaaacgtaaataaagcgtaaaatacttacagaagaggcacttagtcctca

SEQ ID NO: 40167 - DNA, 574 bp, Oryza sativa
cccccttgccgccctccgctagggcgattttgtcctgtgcggggggccgcctgcaaatgggcggcgagggggcatgggtttttgcaggtggcccccttgccgccctgggggagggcgatttttgcctccccctataaagcccagtcccccctctctgaaatttcattatattcactaaaaatccaaaaaaaacgaaagagagagaggagagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 40168 - DNA, 1018 bp, Oryza sativa
ttgattccattgacatctgagagtataatgtagctaacattagaagactcattgtctaaaaaaaagctaacattagaagactatgaataaggagtataatgtagctaacattagaagactcattgtctaaaaaaagctacattagaagactatgaataagtaataggtaggtaactcgcgattgcataactacataaggggggacaaacaaattattgattaaaaagagcattcaaagccaactacataaggggggcaaacaaattattgattaaaaagagcattcaaagcctacatgggttacctgattattaactataaacagaggaatcaatgtaagatcgtaacaaccaaaatgagaatggctccaaagtagaaaaagggaccacacaccatctgattacttggttacattaccaccagcatctgacatcattagcagcattcacgtgatggccccataagactaaatagaaatttctatcaagcataacataacgttcacattctcttgtgctacaaattttagttgaagaataatttcaaatgtgctttattcatagttttgggagtaacatgggtttggcaacataactgttcaaaattacaatgacggtaggaagtccatacccacatattactgaaacagaagggctacgcttgacgcattaagacctagtctgatcatatttcttaccttaactaatgaaataatagaagtacaaataaaacgacatcgattacaaaactacccaactctacccagatcatcagaacccatgaaatacaccatttcacctccccacccgaaccgcagcggcagcagcccaaacaatggaagaaacaccctccgaagtccgaacccacacattacagcataattaggcacagcctagtaggctaccgcataattagacacagatgcgatccgcaccaggcgagctccgatcgaacggaaggatccagcaggcacgcgagggggcaaacggagcagaagaggaatcgagacggagaggca

SEQ ID NO: 40169 - DNA, 553 bp, Oryza sativa
tctacatttttttctagctttctttatccaacgatcatgcaatgcttgatcgcatgtctctgattcttgatgctaatacaataatctatcaatcgttcatactccatgtcataggggtcgccggccttgggatcctttagagagcccgtcaatcatagcgacattggctctaagctccttgcaggtgatgttgaatccgatgatggggagatcatcaggagaaggaggaggaggaggaggcgacaatgtgttaatcgatgacaatgtcctcgactcattgccattgccacctcttcccatgcggccgaccccacgatgccgacgacattcatcgcggccacaaaggcatgtcattgtcgaattctcagggccatggacactgcaaccgtggtcatcatcacatctcaaggttccatcatttgaattatatgatgaattaatcataataataagtgcaaatcaagttatcagtatggcttggattgccaggaggaagaagaagcaaaggacaaaacaacaacgttggttgaggagcttgaggggaaggcggcca

SEQ ID NO: 40170 - DNA, 1501 bp, Oryza sativa
acgacggcacggggtggccggcggcgtctccccttcctccctccctcgcagatctggccggaggagggaggggggaggccagcgggggcggcggcggcgacgaaggcacggggcgacgacggcatggagcggcgcggctcctctcccctcttagatccggccgggggagggcggtggcggtgacgacgacgactgcggcggttcccctcccctctcagatccgcccgggggagggcggtggcggcgagccgcgtgcagcgattttttttgttcgttttttttttttttgcattttcacaggtgggccgttgccccgactgtcgttgtgatgcaggcggatctccctcccgcctgcgaagattagttttggctgcctgtgaagattagttttctagtagagtggctggccgggctagctactgctgaaacattaaactaaacaaagaaaaaggaaaatattgcttatatcttcctcgaactggtagatgactggagcatcttagtgtaattctcacatagtagtcagggctacataatccggcttaagtaggttttatacccatataaaaatatgaatatgatcacgcatatcccggatataataatgccctgcaagaatatagagaagagtcagtatagttggtaattaatcatctcattttggactattctaagagcatgtgcgcgcatggtgtctaataacggacgctttctattgccctgcaaataaatttggtgatgtggaagagagagagggaaaaggaaagcaaaatgtctaaacgtttattaacggaaattttgtttcataagggtggattaaaggaaagaaggataataaaaattatttagtgcattaatggttaagaggttttgttgtctctattattgtagcatgatagtatctagtgctacaaagagctcgtattagactctacctttatatatgcctaaaaaactaatttctcaacaaaaccaatcattagaaaaaaccgaacaacttactggattcaaatcctctcagtaaactgaattaaaaaaaaagttacaacgcaccggcctgtaactaacacctagggaaaaagaaaatatggaaacacttgcatacgtacccataagcaattaatcgccggctgccgccaatcgtcgacgtcgcctccatcatcacccacaaaatcgtcgtcgatgcttttcgtcggcgctcgcgggaggagaagaggagccgcgggatcgtcggcgtcggcgtccttgcccttgatgatgcgtatggtgatgtaggtctcccctggacgcagatcccgcgagcggctaggcggtggcgagtcgtcgtccgacgaattttttttatttttaattttttttattaaaagttttaaaaaataatttttcattttgaaaattgacagaagtggtcgcctaccgccctctgggagggcgatttttaaaaatcaccctcccagagggcggcgaaagtgacgtggcagacggtcgttcgctctcgggc

SEQ ID NO: 40171 - DNA, 1501 bp, Oryza sativa
aggaatcaagtttgggtgcagacattggacattaagacatgggcttcactggttgcctgacatgcccgctctgttcatagcccataggatatatagtcttcctcatatcctctttccaatttgcacaatcttttttttttttgacaacatagaaatggagagaacaacgaacactacccaatgggaaatggaacgcaacagtccaagagataatcattactaagaacaaagatatctagtagatgaagagatcaagcaatgtgtagatgttggatatgagatggttcaagtgagcattggagttcaataaaagcacatattttcatgggggttcgcagagaccattaccctcaaatccttccttcctccgagattgaagcagcatacccgcagggtgcgtcgccactcagccaactccggcgcacgcggcagcgtcgaggtggtcctggatcttggcggcgatttgcagctggccggagcgaagaggtactggagattggggcggcatgagcagttggtggaggaactggagatggacgaggagatgggagcagtggcggagtcctgggtaggacagggagcccgcggcggcgtcggagagagtcggcggcggcggcgaactcctctccgtctccggcgacaagaaccaacggctcagattggtacccattacccaactatacaaatcgtaatccttaacctcttttcatcaaggttcctttacttaaccaatattaattttcggtactgaaatttacaaaacaacacccgattttgatcgctatgagtagtagtatttccaaaatggtcctttctgaggaccgctgcggtggccgccggctgcctcctccggcggcgcgtgagcatggcggatctgtgctcctggccctctggttgcagtgcaggttccctagatgatcgatgcggctacaagtaaaaacatcattctccccggcactgattcctgcactaaatgtctcatttacccccttttaaaatgggaacagtagaggagctagataagatttatagtctcttaatacaaaagtgcgcaatcttttgcgtattcccgaaaaaaaaaagttcataatgtagtttcctgtaattgttgacctcaggttgactggtagtcaaagtcttggatgttgaaggtgatagatggttggatgcagcatacatgtacagtggaatagagagctaaatactttatccgtcccataatataagggattttgagttttagcttgcactgtttgaccactcgttttattcaaaaaattttaaaattattatttattttttttgtgatttactttattatccaaagtactttaagcacaacttttcattttatatatttgcataaattttttaaataagacgagtggtcaaataatacaaacaaaaactcaaaatcccttatattatgagacggatggagtaaatctcaagctgatcatccccaccatcatcttggcaatgcatcagagcccaaacatgg

SEQ ID NO: 40172 - DNA, 1501 bp, Oryza sativa
gattttactgttgttaactctaagctgattttactgagaaagtgggcccaatttttagagggaaatattttttgttatccatgtgctttaatattatagatgataatgttctaaaaaggtagtaagcggagtcccgtgtggtcacctcacctcgtagagctcatggggaaggtagccatgtaagcggttttaaggctttcttatttggcatatgaagtataatagtagatatattttttacacgtatattgaacatgcatgtatattttatacgctaatacaggaaccgcacaataagatatgtatcaggtgcacggttccgtttgatatagttgatggatgatggctaaacctgagtttatgacaattattccagcgcacaaatgaatgaattgaatattaaaatgttcatctaaaaaaagttttctaagaaatgctggtaaagaaaaacttttaagaaaacgtaccattaattaagaacttgggaaaaccttcacatgataagccaaaaaaagggacctaagtttgcaatgagattttatactagagcgagatagctagcatactataggaatgtcaaacctggcaattttaagcggccttctaatagagataaatagctggaatatttctaactacagtagctttaattttaaggctgattattagagtggaggtggtggaaaggtggctggtgtatcaagttgtaaaaaagtatactgctcggtatttgaggtacagaaatagctaggttcagtgtagaggtttaacgaggtcgcactgaggacataatgctgatattgtctcgtactctcgttgtcttgatttaggttcatcagtccataaatggcatcgttagaagccacatgcaccattagattctttcatataatacagatattcgattgtttcctgcatatatattggagccgtattagtatctagatatatgtgacatagacatgcctaaagacaggtttatcaggttaacagacctagccagtcagtcagttctaaacagttatgagaagtgtcatgatgaaaatattgcatagtgctaactagagttggtttgttcaaactatctgataacattacaattgctttctcacgaaaattatgacgaaaaactgatcgaatgatgtataggccggcacgagtgagccataaggagataagatctagaagacgaaaagaagacgcttgtgcttaacaggacagccgggaattattcagtatcttagtaaatatattgtattatgaattatgtatactctaaaattgtgttcatggagtaattgacttgatatttgaatacaggttgctggagctgatgttaatcaaaagttatttctaggctatgcaacaacagctgccgcacgtgaaggaaacatccatattctagagatgcttctgcaggctggagtcactcgggaagcttgtgaagattccctatcagaggctgctctttttgctgaggctgaagccgttcggctattag

SEQ ID NO: 40173 - DNA, 765 bp, Oryza sativa
caacgttctgctcccgagagacatgcttcaaaatcaccagccgaaaactattcatcaattcccagcatttctcgttgtagatcatcaacgcatcatttttgcattcgtattcccctgccaattgactgatcaccaacaaagaatcccccattatctccacggcgtgggcttcaacttccataagcaactgcaaccccttgagaactgcttcgtacttagcttgattgttagttgcataaggttttgttgatgctttttttttgccaacacaagatcacctaatgatttgcggtgcattaaacagagtcgccaaaatcaataaatcaaaattggctagtgaaaccgatttcgagattaattcgctttcgtggaatcacacgactaatttacgagcaaattagtaaagaagataatatcgtacttacgtgacgacgaacgactagtttccgagcaaactagcaaaggataaccttctcgctttcatggagaagcacgaccgtttttcagcgcaaaacggcaaagattaaccaaattctagggttgctagaactcagccataaaaacaaaatagaaaagaactaaaaagtaaaagagatgaatattagattgaaattgggttcccttctattctaccgtggaccaatatatatagctaattgctctgatcttttggcatgtctactcggtcccacgcaatatgcaatgatggtttaccggaatatttgaaacaattcgatccaacaaactctttatcttctaactaga

SEQ ID NO: 40174 - DNA, 1501 bp, Oryza sativa
actagtgctatcaatattgctaagaatcctgtacaacactcacgcacaaagcacattgatattcgttttcactttttgagggatcatgttgagaagggagatgttgaattgcagtttttggacacaaatttgcaaattgctgatattttcactaaacctttggattctaatcgctttgcttttcttcgtggtgaattgggcataattcatccttttggcatggtttgagggggagtttgtacctcatggttttatcaagcaacaatatgacaatgagaaaaattgagaaaagagagttttgtttatgcatatggtattttcttgtgcatgctcgcaatactttgaaggtttatttgtctctagcatagcttgtatgtattctagtcttttcatgagatttagattttgcttttaagggagatgatgcatgacacttaaattctacttgaattaagcaaatatgcaatgttgatgctagcatatggtttgatttttaaatgccctatatatatgctttattgacatgttattcctcaaatagctttaattgctcattgtgaaaaagagaataaaaatatgaaaaaaatgaataccgaatccttggaaacagtcttgaagacaaggacgtattcgatgtgagcaaaataatgggtgccgaatccctggaaacagtcttgacgacagggacgtactcggaataaaagagaaaaattatgagcaaaaaggctcaagaaaagaaaaagttaaaaaaattttcttggttattttgggctaaaggtttatttgagaaagagtgataaatgccataggtatatgtgtttagtgtttattcttcaacctatgtgcttgttaagatgttgcattataaatcgtatgaaatcatgaattttgattgttgattcaagcttaattgtaaaatctttggttcatggttatactctaatgcatgcttgttctgttatagatgggttcatcttctttttattgcaacacatgacttggtatgctatatgtatgctaagctcttgaatattaagcgcttgatgaaatcattgtcaaaaggggaagtaatgtgaacttttttggatattttggagaagcaagatgaatttttggagagttgttgagaagagcatgtttttggttcaattgggaatttctttcttttaaaaagggggagaagttttcttttgaatttttgagcacgatgtgtacatttgtacgaagtgtgctttttaccacttttgtttttatttttccaaacaccaaaacatttttaaagggtttgccaatgtgttcatcaagggggagattgtaaaatcaaaggtgtttttgattattattctgtgatgtacaattgggcattggagattattggttttgttatttggaatttattcacgaagtggttttggagatgattggtttcataggtgatcgcaggattcattattttatgtgaccggtcagaccgggctgtgcatgccggtcagaccggcag

SEQ ID NO: 40175 - DNA, 215 bp, Oryza sativa
tgattagggaccaaaccaagaacttctccaagtctacttctacctcaccacgtcacttttggcccatagaagacaagaaatcaagttgtacacgttttgtattcggattcgggcctcctgacagcatcaacttcaaacggacctagccactgatatagaaggagtttcgaggcccatgagtacttgttgaaaaacttatggagtctactttcaga

SEQ ID NO: 40176 - DNA, 1247 bp, Oryza sativa
acgttatttacttatttttatttaagagttttatccttaaagcgaggatcagaacagttactgtaagaaacagtaattcaggacttcagatagaaagtttggcaacttatatgtttcccatgatgtgcgccattcagcatctatcattttgatatatttccatcaaatcacacagccttatactttataataagctaatttgtttatattctactaaaattgtatttccattgatctctaaccttccagcactatcattgctctggataaactgttgcagtttttatcgtgtttataaaaagatagcaaatttagtatctctactgttttgttgccgtccagagagctgctgatcaaagctcatctagagcaatggaattggaacacaaggtggctgtgcttgaggtaagttatttttaatatttcgtgtgaaatgtgaactggtttgtttgtgctagtcattgtcagtactctggatatgtcataggttgaatgtgcatcgctgcaacaagaactacaggagatggaagctcgtaatcgccgtgctcagaaaaagccttctgaagaagctaatcaagttattcaggttagaatcaaagcgcctcatgttatccacagcttgatattgagctgtgcttttagcgtactctagttcaatttgaaatgctctttgcacaagggaaatataattgttacttaccctgcaaatggctaactgcattttttgagtcaagttatatcctgaaatataacattctgggtatttgttcttttcttaccactgcggtttgaaaaacagatgcaagcatggcatgaggaggttgagcgtgcacgccaaagccaaagagaggcagaaaccaagatatcatctttggaggtactattatttcataagatgccaaagaataatagagaattatatcaattcatgatgttccattggatatgcatagcttaaatttgttaagttgcaaccaggtcaaggtaatagaactggtaatatgctgaccaagtacattggaggatattatattacaatatatttattatacatggcatagtaatatataatgctttaccttaagaaacttgttcattttactaatttatgtttgtaatgtaggctgagttacagaagatgagagttgaaatggctggaatgaaacgagatgcagagcattattccagacaggtgaacttgtctcgctggtcattgatgttattttgttaacactagccaaattatt

SEQ ID NO: 40177 - DNA, 592 bp, Oryza sativa
tggtatgtagagtatttcattaggctaatcgcctattagttgatgatcataattggcacataaattgataaatttgtattgatgattctactcattttaaatgttatatggtagcatcctttgtttgataaggaaaaatcagtgttctttgcatattcaattagagaagagcatgaatactgttgttactctaggaagaatgcttatattatgaaaggagcgctaacattgcgttgagaaaacaacaggtgatgttatctttttctgatttccttatattgcagtctgttagcaaggagcatcaagagttcctcggccttgtcgacaaagaggtataatgtgaacttgtaaattgatattagagtgacaattattcatgcagttatcttccatttttattgcaaatacttgggagggctcaataactcttggtctttgttgaatgcagattgaattatattatatactaatggaattccgccggcggtgtgaggcccactcagagtaggatttggagggtgcagaactgtttttgcattgccaatgaaaggaggaagaccgcctcaaagagccttgtccccatccaccaaca

SEQ ID NO: 40178 - DNA, 343 bp, Oryza sativa
acgttatttacttatttttatttaagagttttatccttaaagcgaggatcagaacagttactgtaagaaacagtaattcaggacttcagatagaaagtttggcaacttatatgtttcccatgatgtgcgccattcagcatctatcattttgatatatttccatcaaatcacacagccttatactttataataagctaatttgtttatattctactaaaattgtatttccattgatctctaaccttccagcactatcattgctctggataaactgttgcagtttttatcgtgtttataaaaagatagcaaatttagtatctctactgttttgttgccgtccaga

SEQ ID NO: 40179 - DNA, 584 bp, Oryza sativa
tgttgagcaagtcaagaagtgcgaaagctgtcagcgcctgtagccagtcggcaaccttaaaaaccttatagctgcggccgtttatcactatttcgcaataaacaggccgaaatgggcatcgcaccgttggcaaacccttcaacgccacaaatttcttgtttttgcttcgccgaatacacaatttttggcgaacaccctgttaaactgtgcagaaagggcaaaagacgatttgtatagtaagaattggcgaaagaagaggaaatattacataatacgaaaatgacataatcatatacgccaaaggcatcgaccataaaaagtggctaagatagagtcatacattccaaatacccaaagggacgttttcggctacaataaggagggaagaggccgaatgtacattgttcgcctttcccggcaaacgcaaaaaagaagaagaaaaacttcaaaaatctaaggaaagggcggagggcctcacacctctaggtgatcctgggcatcgcctgcaccccctccagctgctgcatcctcttcaaggtcgatcgcaagggcgatcgggtagcgatcaattcaccccccccccc

SEQ ID NO: 40180 - DNA, 1501 bp, Oryza sativa
agtccatagtagcaaattgtaccaaaaagtgctttgggaccactccctctctctttctctctctcactttagtgctagaatggcaaaactttaacatgcatctaaacaccaactagtacttttacaataccaaaacttttgacaccaaaacttttgccattttggatctaaacactagtagcaaaagttgacaatttggcatttgtcatttgctagtccatagtagcaaattgtgccaaaaagtgctttgggaccactccctctctctttctctctctcactttagtgctagaaatggcaaaactttaacatgcatctaaacaccaactaatacttttacaataccaaaacttttgccacaaaaaattttgccatttgtcattccaaatggatctaaacatgccctaaacaggcccttagatcctccatttgccactttgaagcaccttttgccattttgatctaaacactagtagcaaaacttagcaatttggcatttggcatttgctagttcatagtagcaaattgtgccaaaaagtgctttgggaccactccttctctctttctctctctcactttagtactagaatggcaaaagtttaggatgcatctaaacaccaactagtacttttgcaataccaaaacttttgtcatttgccatttgccattccaaatggatctaaacaagaagtaaagtgctcgtcgcgtattgctgtggaagttaagaagaataaagggaaaaagactaattcccctcatcgaatgaggggttggagagtgggccataatgactgttgctactggcattatcgtgtggattcatatgaggatgaaactcacatgtcggcagctataagcttataacggcaataccgttacaatagagactctcagcctatggaatggtggttgtggtagttgagtgagaagagcgtgacctgtggaacccaatttagcaagcatacgcaggaaatatggtgtgccacattttaccaataaatatttggcatcctgtgactttcttccaaacatgccctacgttgttggaacaacggggagcaactgttcagaagcaattgttatcagatcatcactgatcagcaggtcagggcgagcgaggatatctgactgtcatggctgtccgttgtgtgctggagtacaactgtacaaggcgcaaacgatgatcaggtcctggccttcctggctgtccaaagcctcaagctgtcatcagctagcttcactgctccaactccaagcatcacatgcccagtctcgctacacccacacgcacagattgggggaccagtgaggagccacacagacacttgtgcaacccctcacatgcccaaagccctcttgctttcctaccaactggtcagtgcaatccagcaatgcacagtgcatcacacgcttgaattgttattacaatcaggtcagcagcttaaaccaccgtgcaccgggtgggcagcagtgcagtgcggtgcactacaaacttgatgca

SEQ ID NO: 40181 - DNA, 363 bp, Oryza sativa
aatactcttctaaatacatttatggtattgaaatactttccgagaatatgagcacctactttacattatgttcatgttatactaaatatacggctagcttatctgggagatgctttggtgtggatataatgtttgcttatgcaattactctatgtcataacgatgatattagagtagtatctggtagtttagacgtattgtctagattacgggatatcattatttggggttatatattgcggatgagaggtgggccactgatggtgacagctcagtacgggtattcctccgcgccggtatataatcctaagttaattccatggggagggtattccttcgtatttagccccgattgtatggtca

SEQ ID NO: 40182 - DNA, 641 bp, Oryza sativa
caaacatgcatgttgttaagctgacacgcggtgacaaagaatgacgattttgtgaccggtctggcactgctcatgttgtaagcgcacggccacgtcccacgacgcgcctgcccccgtcaagagtgaaggtaggtgtgggctgtcccatcagaagggctcccggatggaaaccgtactgatctccgcccattaaagagaaaaagaacagtccagtttggaaagagaaaggtgcatgtggtatccccttgagatataaaaggaggaccttgcccatttagagaggagacttcttcccttttgaaaggctgagaggggaaaggaagttaatcttttgtaacttgtccatacacaaatccacaaaaacacaggagtagggtattacgcttggcagcggcccgaacctgtatacatcgccgtgtctcgtgtgtcttgcggacgggtgatctttccacatacagagagagagagagcttgggattgcaccctaagcccctggtcgaaccggcaaaggggggcttgcgcagtctcccggtgaggggccacgagctccgtcatctggcgcgccaggtaggggactcagtgtgtgttttctgagctctcagactcttccgtgggcgccaagtttttcttgttcagcctaa

SEQ ID NO: 40183 - DNA, 1501 bp, Oryza sativa
tcttctagtaacaaggacttatcgaccatttgctgaaacatcgagaagtcgtgagccaaaagtttcactcgcagtttcgcatccattccttttaaaaatcttctgatcttctttttatcagtgtctgcatcttctagggcatatcgggccaatctgttgaagcgactcaaatactcgttgataccagaggatccttgcctgatatttgcaaattcttccttcttcaaatcaattatgctttcaaggatgtgtgctgagcgaaagacttatgcaaattctgcccagacgatggtaccagcatctgtatggttagcacaatagttatcccaccaatctgcggtaggtcctctcaactgatgagcagcgtaaagggtcttctcatacggagtacactgtaccagatttaatctcctttccacatctttgatccaatcgtcaccttcaataggctcagttgtttgagagaactccggcggacgtgatgtcaagaaatcattcagttttgatcgcccattatcttgaaccatatggggttgacgctcttgtgtgtgttgttgttgcatagcaattatattctgaatcattccttgtaatatctgagtttgcatggctaggatttggtgaaggtccatgggtgggggttgattacctcttgcattattaactgattcggaagcaaccgtatgatcactctcagcttcttgctcatctgcttggttaactggttgatcgggaatctctgactgaactggctcttcttcaaaaccaaagcgattaggagcacgggtttgacgggtagaacgacgagccatctacttcaaagcgactgagatctgaccgaaccagaaatgggataagaaaaggaggaaaacaaaaacactagatcaaaacgtttttcgaaatcgcagaagacataggtggtgtattccagccggtaacccaactggtctaacacctgaacacgggctaccaaacaaaactcacacacgcactagttcaccacaactcctaccgagcgggtgacggagctagggttgcctaccaacaagggcttaactaagacgcctagaggcttgagcacacctttcttcaactgggcgtgaagacaggtttactctaggataacatgtcaaaacaaacgactagcttctacttttggacacaaaaacatttttcgcaaaactagagctaaaggggacaacgacaccttagctttcacaaatagtttttgtactcaattaatgccatcctattcaggggtttcgatcctagggccaactaatgctctgataccatctctgtcacaccccgatccggcaccgccgtacaacggcacctgacaggagcgtgtcgtaggaaaaacggcgtgaaccgcttcctacgaaaccgcgattacagtaccagtcccaggacatagtgctggtacccacggtgacaaatatgaatcattgcaatccttaaaataaataaatgacttatttaccttaacttaggttgtagc

SEQ ID NO: 40184 - DNA, 426 bp, Oryza sativa
tttcaaactattaaacagtgtatttttttcaaagaaaattctatctgaaagttgcttcataattcatatttaataatttatttttttaaaaaaatagctaatacttaattaatcatgcgctaatgagtcactccgtccaataataccaaccgaacatcaaccttgatactcctaccatcctaatataatataggcatgatcaaacttgtacaattttcaaaactaatatttgactttttttttcatatatactagaatctttgacttatatttctcatatactatatggattgttacaccaaaattataactatctaaaagtaaatttaaatgtgaatccaatgatattattttaaaaaaaataaaatgtaatgatattatactaaccattggccaaatatttttaatgttgaatcttaaaatata

SEQ ID NO: 40185 - DNA, 231 bp, Oryza sativa
gaaaaagaagctttaaacagagtgaaaagggataagcacaagcagacctgcaagagacgtcaagttttgtgcacagatgatctattaacactcaaactttggttactctttttggtgctatctgaattctgaaatcgtatttatcctcttgcttttaacctttgcagctgaactactcatctaatccgatttgacagtgacacactcatttcgctctcatttatcaatcca

SEQ ID NO: 40186 - DNA, 472 bp, Oryza sativa
aaatatatatctatactacttcctccgtttcataatgtaaaactttctagcattacccacattcatatagatgttaatgaatctagacatatatgtgtgtatagattaattaacatttatatgaatgtggacaatgctaaaaagttttacattatgaaacggagagagtacagtataaaagataatagtggtggtggtggttctgccattagcccctgatattaaggacaagttgggcaggctaggatgaaactcatcaagaggggtatgaaccaagaaatatcataaaaacataatggtggtactaatataataccagtagtatatttgtagtagtacaagaagcttgatttctatgccatggttcagacgtggatctctaatttttatgtgctcctatgcaaatccaattctctggttgcatttcaaacactgctcacagataactaggtcatggtctgttatcattttc

SEQ ID NO: 40187 - DNA, 307 bp, Oryza sativa
ctttgtttgtggctaggattctagaaataattgcctaactgttattttaccagcatcgtctaatcattatttacattcagagctaaatcatttgtaccaactaaagttttgcaaattattaatgttcagttgggctgctgctcaccataattccttccaagaaaccctctgagttgaatcgttattcatcctctcaaaaaaatagtacgtagaaactatgaagtttctaaattcttggtgtttatatgctactcatataaatacttggtgtagataccaatcatatcgagtgatgtttcctgtcagg

SEQ ID NO: 40188 - DNA, 1501 bp, Oryza sativa
gggaggcctgcttctccgccagcacgccggaggtgaccagctttgccaactcatcctcgtccacaagcgaagccccgagataggcggtggtgtcgtcatcaatcctgccgggatcagggcccgtcacggaagctgggttcggcttgcgaggagccatggtgaaaagtgtgggccgtgacgaaaagaggaacagtcgaaaggtactagtgactcaagaggaccgtgaagtgagagggcggaaaagagagagctcgcggtgaaaatgacgggggtgcggcggtgaaaagggggggatatataacccacccaagcgtcaattcgccttcccacccaatcgtaagccgccatgtgtcacgagggtaggcaaaatggtaaattcccattcattgagctacacagtgctaagcccatgaagggaagcctgtcactgtttattgcggcccacggaaaaaaataaggacggcttcgccgtttgcaaaaggcgaaagctaggaaaatttactaaccgtaaaaatacatatgcacaaagtgtacacatttcctgtaggactgtattataggtttcggcaggagcgtcggtcgaaagggggcgcctcataccataccacatggtttgcacggtctcggccgaagctcctaactcacccttgcccgtgaggggcttgttggcagtatgtcatgagacccttcgaccagacctgccgaaaccgtgcaaccagcgaggactatgaagcaaagatggcgaaggccgaagagtcgtgctggtatccggcaagaccaaatgcgtcttgggcgaagggtgtatgccgaaggatggagacttcgcaataacaagcccaactttgaggaggctcaaggggccatcccggccgctcaggcctgttcgccaatcggcccattagaggcccatgtatccaaattacactgtatacccaagcaaacgtccctttcataagggcaaccatgtaaattcccctgtaaagcctaaaccctaaaggggtgaacctgtaataggattataaatagtcctctagggacatgtaaagggggatcccaaagaaaaatcttaaattaatacatttactgtttccaacactgtcggtgacatggggccgggggtatcgtgactagaggcttgggtagccgcggtcaccctcgtggcctgaccccctcgggggggtcgggctcgaaggtgacgtggccacccctccctctgtctccccgaggggtcgggccgctcccgtttcggccccgagggctggggtgccccgaccccctgtggttttggcgccacgtgtgtgggttaggtgagcacacagggctcacctaaccgcatttatagcaggttggacgagcgcgccacgccgcgtttaatgcggcgcagcgcacgcttatccggtccgtgaccggtcgcggtgagtgaccggtcacagacaggtcaagatcgcgggttaggtggcaacaggcggcctgtcacacgcctcgccccgtcccgtcggaa

SEQ ID NO: 40189 - DNA, 1501 bp, Oryza sativa
tagatagatagatagatagatagttacatactacactattaatatctagccccacctgtcatagacacactgcgtcttggagtccgtgctacagctgtctacaaatctgtagcccgctgctcttctttctcctgatttatctccttaaaatatgtttgcagctggcttgtagtctgctattgtacctgctcttatacaggcaataatcactgccactaaatacagacaactatatttcttcatttataactgtatactgctttctaataataaaaatatattacattgccgacctctgcctgccacacgattaggcttgcaggccctacgtcatgttatttgtaattgatacagtttttgtatttatcaatccgtctcaacaagattgatcgattaggtggacattaattgatttattcaacgactaatcgatcttgctttgcagcagcatttcacttgctcattgcagtaggcgcctttccagtctaccaaattaccatagtatttgaggcagtaggctccacacattctcacttggcatgcccggagacccgtatagaaacacacatctgtactctctacaaaataaacaacaaactctgtataaaatgccatgattttttttgtaagtggtacccacaagttaagcgcatctacaatcattaatttctagtgatgccatgcttacagtaggtactaaagaaaaacaaatttgtagtaactaccacaacttcaaaaatcttcgcttataaaatcttcaatctgtttggcacaactctgtatattggccttgttcggcacaactctaatttattttttttaagctaggtatttctaaatgtagaaattctgtgcttatgttggtaatatttaaataaatcattttatttatattttagaggaaattaaatattttaaacaattgtagtttaacatatatacaaactttaaatttgacatggatctaagatttggagcaatgtttaaatttgtagcaaacattgtagagaggaaattaaatctaaccgtccgctttgcaggatgagagagcgacagccaagatcacaaaagccaccaagcagccgagggccattgtgttatttttcttggaaatgattgccatcacaagatcaggctacagtgttttgttctcccgatgatttgataagctacttctacgaccttcactgttgccggtgttcatataggggtacaataacccaccataaatgacatatattaatgcaaacattatcttactcatatcccttgcatttatgctgagcaatttattagctgtttattttataagatttgatgttttgggccgacacgtacaccttaccggctgggctcaaattggtccaaataattcggcccacggttagattgtaggtgtgaacatttgacattttttttttgcggggaaacatttgacatatttatcagagctgtcagtgcttccgtgactaatacttgctaatcgagcttatcaacaaat

SEQ ID NO: 40190 - DNA, 333 bp, Oryza sativa
ccttttcttctcccatccattgcagcgaggaggaacaaacagcctcatctccccacctcgactcgacaacaggaattcgacccgtcaccggcatcctcgccgcacggcacggcacttactcgtccatgccggaagtggaaccatctgtctttttttctttgcttttttttcttctcgactcatccatgatggaaccatctaccattctaccttgatttttcctctcatccttcttttcttctcttatttttttcttcaacttagtccatggcggaaccatctgccttttttttctcatccttctttctttcctttttcttttctctactcagt

SEQ ID NO: 40191 - DNA, 1501 bp, Oryza sativa
gatggaagcactaatctcgagaacacaagccgccataacaagttttacctcttgttgaacatcaaaaccgatgcagctcaacccgaaagcaataactcgttgaaataaaacgaaagcaaaaagagtggcgatgcgccgaaattgtattgaacgtgtgtgttcatcattacatagggctcggggtctatttatacccgagaaatacaagatatgtccatattggacacgactcttatctctaacaaactctaagataccacaagtctttgcggcagacttttgcccacatttatctctaaggaatttacataaaatatcctaattaatagatacaattgccttcccaggactctatctatgcgtggcaatcatcttgaaacacatcaactcgaacccaatgtcgcacatgggtcgtattatcggaatcggctgtatcacttaaccagactgactcagacttagccaatcccagtcgtagccgatccggactccagccgattcttactctgtttccgaaaaaaaccttatcttcgagtccgcttcgatttcatcttcatctccgatgttgatattaccaaatttggttgttaacaataggctcatttgcaaaagcagcatttagcaaacatttaagagaagtaaaatagtagagcaattaatcatcaattttaatcaacactgaacatcacacccatgctgcacaggcccaaccaaacctaaacaaccatacccggctgtacagatctatctccaaaccaggaatataccattccaaaccaggagctaatcaaattttaccagttatagcatcatctattatggtgagaagtgtgagactatcatgaaagacattgttagacccgcccataaccgtgggcacggctattcgaatagttttactctggccagaggtgtaccactgtacccacaagacacgattccacacatgttaccatgccctgaagtaccaccacgtcactgcaaagggggaaatcgtgacagtacccttcgcacaacacaactcaaagcattgcaccgttcctggatcataatcacccccttataaacaaggcatggactccccagcgacccccgtgggcttatctccgccacttctcagtctggtgctccgcaatgaaccatgctatacaaaagataaagccgttgcccatgctggcttgtggttggcacggttaatgtttcacaactgaaacttgtgaaccggtccttaattgtcatgtgcatgaccatcaaaaccatgtgctcacaacccaccattatcaagttttagttagcatattaattaattaaccaatcacgattgaccatcgtgagctaatcattaaatatccatcattaagtaatagtaaaacattagttatcccaatcgtgtactaatgtttctaagaatggctaagcaattatgtctaacatctagctgaaccaatatataaagctcaactagtcaaattataataacccaaggtaatcaagaaatagg

SEQ ID NO: 40192 - DNA, 672 bp, Oryza sativa
tgtactcgtatctgtactgtataacatcaataggttctgaagcttaaacggcagtacggcatctctgcatcattgaacgctacagaccaacagaggaacacgaactcaactgctatcgaccaaaatttcttcgttccagcgatccaaaaccacagcctctctctgcaccgttcgatcatatacaggcggctgagattagacgcgcctcggaatccgtgggccgattttcgtttaggccctcgtattatctcgtgttgtcgtgtcgttgtacaagggaggaagagatgtcgagacgccgccgccgctgccgccggcgatgaggagaagggaaccgggcgttgcccctggcgcggcctctccactgcaatgttcacaaagataccccgaattattactccatctgcaactacacattctgttaatcacagttggcatctgaaccgaaaccgagaattattttttttgagaatatgcagaacttgcgttagttgagtatcttttgtattaactctgaactctgaataaactagttggtttggttgtgatcgataatcctgacctggaagaagacagcttcgccgtggccgcaggcggcgcaccggacggacttggtgcggggcagggtggggtcgccggcgacgtcctggagcacctgggtgaaatccccgggcg

SEQ ID NO: 40193 - DNA, 1501 bp, Oryza sativa
atttgttaccttaacttaggtggtgtttggatccagggagtaaactttaatccctgtcacattgaatgtttgaacactaatttgaagtattaaacatagactacttacaaaactaattacacagatagaggctaatttgcgagacgaatctattaagcctaattatgccatgatttgacaatatagtggtacaataaatgtgtgctaatcatggattaattagtcttaatagattcatctcgcaaattagtctctatctgtgtaattaatttttttaaataatctatgtttaatacttcaaattagtgttcaaacatccgatgtgatagggactaaattttagtctctagatccaaacaccacctaaggtacagagcatgtcgttttaaacacgcatgttttaagtcaaaccccgactgattgctaccttttcatatgtacatggaccaacactagaggagccaaggcatgccaacctcatcatcattaattaatttttgctactgagtgaatcggtacaattaagcatcaactgcaagagtttactatcgaatctctgcttcatcaatcaataataagattgccgttgattatacaaccgtcgttgttgatttggacaagagaaatctattatttgtgcgggcctcatcagtacagcagcagtggtcgttcgactcgccgtcgcacaggcctccgttgaaccccttgatttggcagtcactcatgcacttgttcatatcgcaatttacaaggaccatgcacgaatccatttctccatatccacctatatatatatatgcacatgtaaaatacatatttttagaggaaaaatcattatattgttaatgaccccgacttttacagagagccgaaatagttcatacagaaaatgtaaaatgcatatatacttgtcaggctatatatcagattattccagcatcattgatcactaatcatttcatgcaaaagagaacaaattaaactgtttttgcatttggatgtgatcaatcgagaggtgtatatatatatatatgtataccttgtgtagtatgaccggatgagaaatttacggtggccatcaccataagagatgtgaagaagaacactgctgcagccttcttgttgagaatttgcgccatgatgagatgagatgagaggagatccttttgacaaggaagctactgcatatgctggctactacctggcccctagcttcattttgcagctgtttatatagagtcacaagagcaaatcttggatgattcattagtaaattacctccattattatgcattaatgacgtgtgtgaggtttcattaatgaccgtttctcaaatttattgcatgagcatatcgtttcaattaattttgtttctatatcattttacctatgtcgtcgtttagtgtccacctctacaaaatattccattgttcaaacaggcctaaatgtacgttgagtcattcgaatgaaacaaaagcccattacaaacataggcccatgg

SEQ ID NO: 40194 - DNA, 1501 bp, Oryza sativa; identical to SEQ ID NO: 23477

SEQ ID NO: 40195 - DNA, 688 bp, Oryza sativa
ttcgttttgatcttgctagaaatagaccaaaaacagcaaaagacttgtttgaaagaatggaaagttttgcaagaggagaagaagatgagttgagagtgcaagaggaagaagccgtcttgttgggaaaaaagcagtcaaagaacaagcaaatttcccaaggggaagaacaaaagggagagaataccggaaagccctggaaaaagttcaagtatgactataaacaagatcagaaaaaacaggtaaattttatcggagatggatccaacaatgaaagagaaaaaggaaaacatcaatgggacaacactcgcagagggagaaacaattgggggcagtctggaaaaggtcgaggacaatggtggaattcaggcagaggtagaggacgatggtggaacaatgaaagaggaaaaggaagagaaaataaacctgaccaaaccaaattttgtcaaacacatggaccgggaggtcattccacagaagaatgttacagtaagttttgtcatatacatggtccgggaggccattccacagaagaatgcaggcaaatgacccacttgttggaaaaacacgtaaatcgatatgagaacaagtatgaaggagctcgtgatcaacgaggacaaaatgccatagaagcaccgcaagttatgaagatagaggcaattgaagaagtgccaaagagagtgataaatgc

SEQ ID NO: 40196 - DNA, 418 bp, Oryza sativa
ttgatttttcaacggattgatagcatcagtttcctgcaactatcaactcactagatttttcgatggatcgatagcagaaggttcagcaggaaaccaccaagataaaacctgagatcacctgcaaagagaagaaaaataaaagaacaggtgaattgcaagttcattaatagaaagctggtgcaaccaatggttagaagtaaaacacatcaatggaaaagaagaaattaaggttacgccatatgaaccagagaataagagaaataaccggaaatatggatacaaattatcatgccattggtcagagtgctgcagaaggactgaaggagagtgctatatgttcagaaaaattggtccctcccaagtcccaactcccaacaacaagatctcttcagtaaaaaaacttcaataagaacagaaa

SEQ ID NO: 40197 - DNA, 294 bp, Oryza sativa
agctgctctactgtgctcttttgtcactgattgctgctgcatcctcgggctgctgctggctttgcacccaccaccattgttccactgctcatctatgctgagagttactgactatgttggctgaactttgaattttgcacaatatgttcttttgtgattaataattatatgtttatatcctctcaagctcagtagcataatggttacttcaaaaaaaaaaaggaaggaaagggcagtgaaaatttgtgtaaaaacttgtatagtttcctgcccaagtgtttggaggtacacaga

SEQ ID NO: 40198 - DNA, 847 bp, Oryza sativa
tatggcttcactggtcaatcaagttttaatttaggtttaattagacctaaagtgtatatatatacttatacatgtttatgtattaattaaacaacactatgtgtttaaattcttatttcactaagttaaggttttgatcaatgttctctacagaaggtgccaaattttattttactatgttgaagataactatttgctggttctatagaaactttgttcatttcatttggactaaaatgaattttctacaagttttacaaattaatggctgctctatgttagtaaatccttatatgaatatttagagacttttactacacagcaagtatataatattatttcataacttggaaatacttgtgttagtgatcctacataacttaagtttattcaaattgaagctaaattgggttctacatgaatttctaaagtttagcttatctaaaactagtcattttaaagataatagttttagaggcttttaatgcaaagtaagtaattacttttatttcacttaatcagagattgtatgatgatgaatgatgaatctgtagaatttgattttgtttcaaaatgagttgaaatgaattttctatgtattttataagtttgtacatgttttatgcatgacttatcttagataaatcttagagacattatttgtacagtaagtgtcaagttttatattcctggaataaagttcataacttcaagaatctacagaaactggaatcacttcaaaatgagctatatttgattttatatagattttacaactttgtgcatttttctgctaaacatataattgtttgggcattttcctaatttttcttcagattttaaagga

SEQ ID NO: 40199 - DNA, 183 bp, Oryza sativa
ctccaagttctctctgttcctccccttcttcctaccccttctctctgttcgaatctgctcctctaatcccaaaactcccaaattcgcaagcagattcgtaacaataggtatcagagccatccatcctggagtacctcgacaaacctagataccattcccgtgcgcaactcaagtcccaagaga

SEQ ID NO: 40200 - DNA, 1501 bp, Oryza sativa
ttgacgcggtcgcgttcccggagattggctgcactaaaagaggcgttcttggtggcgttagagacggcattgagagggaattacagaacgcttattgaacggaaatggagctcaccggatttcgacggcgtcgaggacttatctcaccggcgccggagttggcacccccgttcccggcgaatctgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagaggaggaaaaatctagaaaaattacatttattcatgataactaatctagtatttgaataaattatttcccatgttcacttatgtgcagttaaatgtacttttggatgaaatatggttttagccgattaaatttaatttgttttcttttagttgtctgcttcaaccgattaatttgagatatcaacatgagtgttaacatgttaccaaattacagaggacaagtttgtgctaatcactgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccatatgttatcacccaagattaactataggtttgtttagtgaaataattcttttagattatgctcatgggatctattatggaatgcaagaccaaaactccaaatgcacaaagaactcgagcctaggcatgcattatgtacatgtatgcttgatgacatttctagtctaatgttgggaatgaaaaggttttattttgttctcaaattttaatcatgcaatggtttaagttgatcatcacctaaattaaaacggaaatttttggctctcgaaatttggagaagttaacctctaactattttgacaagaaatcttaagtcctaaaatttcgggtatgttacac

SEQ ID NO: 40201 - DNA, 1501 bp, Oryza sativa
aagcacgcattactggtagaaaattcacaattttaggggcaagaaacctagagctcatactggatttttctccaaattcaccacatattagacacttgtatcgtaatttcaatgtatttctaagagttcttatttttcttaatttgaaaaaggtacacatggaaaaatgcagaaaatttcgcatctaaatttctccagagattgttcgttccagaataccacggtgatttcaagtagtagtatgttgtaccagacatagcctaataaaaaaaagtaaattactggtggtatacgaacttgttagggggatataatatagcgtacaaacttataaaacattcgttttgattaatgaatttgtctggtgtttgtgaaccaaggccaaaatgacataacaagactaatttcactaagttgaaaattgattaggacgtgatgtgcatataagagatgggagtgagaatgctatatttataaactcggtttctacattacgcttattttcatttccacccttgcatcattatttagtattttatgtcttttatctgtacaataagtgtgccttattttaccatttggttgagcgtatatatatgtttgtgtggcatcttttttttttcgtgtttgcgtcgcatcctaatcatagcttaaatcagcgagattagtcttattgtgttcttttggtcttggtttacacgcaccaaacaacagggtgggttcaggatttgagatagggtatttgaaatgaaaatagataaaaattccttttcacaatacatactcaatataatttggtattttagtactacttattattagatttttttctctcgaacacgtaaaaaaattgcacgtcaatatattagactacttatcaaattagaacttacgatagggtttttagcaatttcttcgaagtagacaagcttgtgtatcaaaacatgctttttataaatttatgcatcagattacactgatcacttgataaaattgtgtaccaccaatataatttatttaaaaaagcctaatttcagatgtttgcatcattcaaaatttcaacgcttcaaagctagtactacgaatccagagaactgtaattgagggtatgtttgatacagcttcaactcctaaatttagctctaggagttgggtctggagtggagttgtggagctgcctaaacccagctctacaactctagtttattttgtgagagagctccacccagctccactcccagttttagtggagttaaaattgtttagctgagcaacagctctaggaagggtggagctggagctggagctggagctgtgccaaacatgccctgaagcttgagaagtcgagactcgagagacctgccggctttgcttctagtctgaaggctaacctgtagacttgtacagtacctcagttacccgggcccccgaacccccaaacccccgccgtctcccgcttccaaaaccctagctcatcgtcgtccggcggcggggatgccag

SEQ ID NO: 40202 - DNA, 1501 bp, Oryza sativa
gctttcatactccaaaatttggggcatgtgttaacgccaaaatttggtaagcccaaagtcatcatcggcctaaagttagtatcggcttcagagtcttagaatcggccgatgggagtcatcaaatcggcagcagttgtgttcttgatggagtcggatcaattgaaggaaatttatccagaagagtccgagttcaaggaggatgcggcatggcaagtgtatctattaattaggaatagttcgttagtttccttttatctttatgaaagtgtgtttagtgttcgataaggactttgtgttttccttttatctttaggaaattttctttattgacctacaaggactaatatctacccatgggtataaatatgtacacccggggtcattgtaatctatcaatctctcaatcaatacaactactctcggcgcatcaccaccctctttactaaggttttacttgtcatctgacgttacttggcacctgacgcggggctgcatcggctttccatctctggcgaaggggtaagtcctacgttccgctggccctggtgaatctaccgactacattggtgttgttcaagactgcatcgcttcgatctcttggatcgctctggtttggttgatatatttgcctacctgatacctcaattctatccctaattgcattgtgtttagagacacatcggtttagttgggactgtctcggttaggtctgatcttttgtcttagccgatatatctctacaatcacaatgaagttctaaggccctctttgtttaggcttaggcttattggcctagacttttaagtcagtttattggcttatatgatttataagtcagtggatttaatgtcctaagtttagtggtggagtcatacatctatctcatataagccaaaaaagcttctccaacctagcttttggctaatagtgttagagtggcttatggcttcaaaaaagccaaataaaaaagctgcttgtttgttttggcttagacttttcgacttataagttggcttataagcctaaacaaagagggcctaaatagatttgctatatccatcatattagatagatctatcggcttaccgagtattagattatcatatacaatctcgtgctgcattggtaggttcgacctactagattgttgttgataatataaatcttgctaagtcgataggttcatgctaatgttttatcggggtgctagccgataagttatctggatgttgcatcggcttataaggattgcatatacatataagttgtatttagccgttgacaacaaaggtttcattgatttatctaatcttgtggattttatgacatcggacctccagccaatgcatgctttaaccatcggatcagtacttgttctatcatatcatcttgttagccgattagtttctactggattatattgttgtatattgcatcatcatcagccgactgcctttatatattatctacatttgacatattgccaatagctcaaaaccct

SEQ ID NO: 40203 - DNA, 1501 bp, Oryza sativa
tctcgagctcaagttggtgatactgtactttacccaggcaatctgaattacttcctcagtttcacagtgtaagtcattttagcattctcacattcatattgatgttaatgaatttacatagatatatatgtatagattcattaacatcataatgaatgtgaaaaatgctaaaatgatttatattgtgaaacggagagagtactcgtattttcgcaagagtataatttttaggtgtttcttctggatggatcaactggaagtgcagtatatatgcctaggtctagctcagaaatccttcgaaatgagcaagtcgttcccatgtcatcagaaaaggtggcattcgcatcaataaaactcagtcaagctgcaacggcttgcacggtggccgcaccacacctttcgaaaaaaggaacagccgcgatatatatctagacacgaacatcaaggcaccacatttgccttcccaaaaaaattatggcggcagctcaactttgcaacttttgtcaaattttgcttggattcaaaggaaaggcctgtgctgtggggaacagagcaggagccactgagccagggcgcccaaggccggggagaccattgattgcttggataggaggtttacgtcacgtatttttatctctgtagtctgtaccaatcttcttcccttttgcctatgatattttttctctctttagcttttttttttattcttttgcccctggttagtattatgaattttttttatttttaattttttttattaaaagttttaaaaaataattttccattttgaaaattgacggaagtagtcgcctaccgccctctgggagggcgatttttaaaaatcgtcatcccagagggcggcgaaaatgacgtggcagacggccgttcgctctcgggcgacggccgtcaatgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctccccctataaagcccagtcccccctctctgaaatttcattatattcactaaaaatccaaaaaaaaacgaaagagagagaggagagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 40204 - DNA, 995 bp, Oryza sativa
ttgactgagaactatcaaaatgatgaaatttactccattctgaagtcagaatatctttcagatgtagagaatctataagactgaaaaaaggacataaatatgggctagtgttgttgttgttgttagtcaggcagcataaaaagggtgtgaattatagatacttatgtaccactgacgtagactgatcaacattttgggttacaaggaaattaatgattaaagtgcccttagcatagataattatgcaccactacgatagaccgatcaatcttttggttaggaaattaatgacctatagagctataggaatggcataatactcagagaaacaatacttgtaatggtaggtacaattgagttcatttttgtcaagaaaggtaaaccagcatgtttctttgtcacttggaccgttagtgaaatgcaggtacctttgcagctttgctgaagcaatgaacttgcagaaaacaaaaatgtcaaaatcatcgaatgcgactatttacttgaggaaacatgtaggtgaaccattattggtagggaatacatagagagttccgaaaatggcaataacatacgcttagtaaaaagaactttaatgaatgatatggtacgctgcatttaacccacttaggtatacacaatgatgaaattgtaaatcacaatgaatcaagaagactaaacacctagatagaaaccaaaaatcaacatgcatatgaagttctgaacatttcagtgtaattcattctcacccatgacgcgaatgtcttgtcatcctgctccctgtgggctggggctgagagacccttgttgaacctttgcacacatcttgaaataagaatcaatcaaaaaatgaagattggagtaacaagcagcagacgcgctgagtaaatagtgacaaggtaaataatgattgattggctacaccggagtaggagcaccaagcggacggcaatgccatgaggagtaggaggatgcggcagcccaacagatgaggagga

SEQ ID NO: 40205 - DNA, 1501 bp, Oryza sativa
taccgctcgcaatatgctggtaggaatactattctatcccgacccagcacgtagtccgtcgtcagaatccagagctccgtccggcctctagtactgtaatcgtagtactactagtatcctccctctctctcctctatctcgggtttatctattgccacctcccatgtgagcatgcggctcgggcgcgcgcctccgcccgtcaccggccgggggtagctgccgccctgaccgagcacgacgccggtttttatactcctccacttgtcccccccccccctcggggtagtgagagcccacatgcgctcagttcacagtgccccccacaagctactacgtagctcatggttaattttctacttgctggctactactgttaccaaatgactgacctgcaaccaaatgatcaagtttaacaggactagcttcacagctgggtaggatcggagtaaccaataaccacccaaggtccacagttaggagtactgtacatatttttagcgggtgctggcaggtatgtcagatgcggccggcaggttaagtggcctatcgtacggtaggctgcctgcctgccatttatattgttctgagctgctgactttctgacagccagttcgaggagtacgtacgtacgccaaaggtaggagtaaaacggagctttcacttcgccagcagccagccgggcagggcatgtcactgattgcttatccggaattgcggccaagccaagccccaggtggtaccggcgcgaggtacagcaatgatgaaacgcaaccacactaacacagcagcagcaaaaggcttgccggccggcagcagcagggcggggccaaaagttttacagcgaggagaggggctccatgcctccgcccatccgcccgcccgcccagccccagccaccatttattctgtgctgccataaggagggcatctttctcacgcgaggtgtgcaaatggtcacgtgctagagctgcgacgcacgacaggtgggcaatggcgccctcgcctcctttggcctttgcatcctgcatgcctgcttgtattgtatgttcggttgcccacacaaccatcgtgaagtggtcttgcaacggcatggcatgatgattagttttaggccaaagcaatgagccaaaaaaaaaaaagaaaaagaaaaacaggtttgttttcatcttctggtagaagggaggaagaaatggaagaagagatttaagtaccttgaaatgcgttacaaattaaatggcaagatagagaggaagataagtagaagctagagaaatcaactcccggctagaaaaggtggtaaacttaaagagcatcataaacaaaattgacacgaaaaattcgacgagctgagcaaaagcgcacaaactaaacgaagggaaaagagacaaaaactggggaaactcctaagaaaatatcagttcttctgttttttttttggttcaagggtttcttttagattattcatgggctaattgatcaattctagcacacgactcatctc

SEQ ID NO: 40206 - DNA, 162 bp, Oryza sativa
gcaacattttcatacgggtttagatatggaggctgcactctaccttgacataactgctgtagggtcattcatgcacaaaactcccgctgaaggcaaggaaattctcgatcgcatatcaaaaaatacctcatttgtcgggtagtatgttgaactccatctaga

SEQ ID NO: 40207 - DNA, 1501 bp, Oryza sativa
gcctgtgggagtggagctgaagccatcgctagaccgttaattccactgctgtttttttttcttctgtaagtatgtaacgttattattatgatggatttgtatattaaattgtcagtttgtgtacctcggctgattcctagatgagggttttatgcataaataagttcggaaattactagtgaatttccggacgtgacaggccaaaaattgggcattagcgggcgtgaaaaatcttcataattggctttcttttagttagctcggatcaaaggtcttgagctcgttttcgtctttgtacagttcactcccgaaatgcttgaggagatcagatgtccaacgaaaaaaaagatcggatgaacaaactactaatagtaccccatgtctccacacattcatatgatggtcttcaaaatgttttatcttttaaactatttatccaatttatgatatgatcacatcattatatttgttacaattaaatctttacaacaagatatcacatcattgcattccgatgaaagaaaaatatatgtttcaatccgttaaatttaatgtttcagacacagtagcaatatgtttcaacgtgtgtttttgttatgtttcataaaaaaaattaaatgtttcaataactaatttttttgtttcactatgtgcaactcaatgtttcaccaatgaccgaaaaaatatgagacgctattgcccctagtctctctcatgctattctattagctttctcccacacaccacgcatgatgcaagtatttagtgatcttaaaaattattttttcttttaaactacttattcgttgaacgatttgatcgcaccgttaaattcgttataattaaatctttacaacaagatattgcatgattatattttgatgaaagaaaaacatatatttcagacaataaaaatttcatatgtgatagaaatatgtttcaccatgtgttcttattatgtttcacaaaaagttctatatgtttcataggctgacttttttgttttgtttcactatgtataacttaatgttgcaccaacagtcaaccgaaatatttgactgtccaatttttattacaacgtcggacgtccgatttgtagctctctccgtttactccttctctatttaataaaaattggcaggttgccttttcttaaaaaagcaaaatttaaagaagagaaataaattttggattggctatgttaatatgatatgaccttatgactcaccagtagtccacggcccaacaacaaacaacgggccgaaccggtgtgtcgcctcgaccgcgaccgcgacgggctcagagtcagacgcgtcgccttgcgtggcccagttgccaacctcaccgccacggcggtgcctatcctctcctcaacccatctcctccctatctctccttttttttttctccccaaatcacccctccgccgaaacgggagctcgatctccgccgccaccgccaatccccgaaccctacctctccccccctccacccatggcgc

SEQ ID NO: 40208 - DNA, 1501 bp, Oryza sativa
tctgtaaataaaaatacttaaagggaaatcgaaaagagaaaatggccaagtacacattatagcatcagcccggccagcttgggaccttaacgcatgcggcccataatgcacagcgcggcccgtggcgagatcgatctcagccgtttgatgtaatagacggtttggatttatcccgaatcggaaaacatatagccgccggctgtaacactaaaaaaaaatcttttccccaactctctctctctccgaaaagaggcggcggcggcgatttcgcggcggagggggcgcgcagcatgaggcggcggcggcacgcgcgtgttaacagtgaaatttggtaagcccggagtagtcatcggctgagagtcagcatcggcttcgaagtcctgagattagccgatgagaattgtcaagtcgttagtagtcagattcctgctatattcggttaaggaaatcaatctactaaaggaagcttatccctaagtgaccgagtttaaagaggatgcggcatggcagtttatctattaattaggaatagtttgttagtttccttttatctttggaaaagtgtgtttagtgtccgataaggactttatattttccttttttctttaggttagttcctttcttgtccgacaaggacttgtatcaacccatgggtataaatatgtacacccggggtctatgtaatctatcttcacgatcaatgcaattcggcgcatcgccaccctttttacttctacttttgttttttaagttccgacggaacttggcatcggtgttcgatctccggcgaaagggtaagtccaatgttccgtcggcccaggcaattgtatcgtttacgtcggcgtcgttcaaggctgcatcagtacattcgacctcttggattgctctggtttggatgatataattgcctatctatttatcatgtctctgttaatctagtcttagcatatcaatttaggtctatcggctgtctcttgctttagggttcctgccggtatcggctaaatcgcgttgctagattagattagcctaggcatctaccaccgtgaaaatcagtcaacggcttgattctctagatattgtgtttcttttcatacttagtgctgcatcagttaagtttgatctactaagtcgtgcttagaaccataatctctagcctgcttattgattgccaataagggtttcatcggggtttcagccgatgagttatctggacgttgcatcggcccataaggattgcatatacatataagttggatttagccgatgacaacaaaggtttcattgtttaatccaatcttgtggatttcatgacatcggacctctagccgatgggtgctttaaccttcggatcaatacttgttctactatatcatattgttagccgattggtttctactggattatattgctatattacatcatcatcagccgattgcctttatatcattatctacatttgacatatagccgattgcttaaaccctatcgctatcggctg

SEQ ID NO: 40209 - DNA, 1501 bp, Oryza sativa
atctaatgattccaaattacgtgaaacttacatacaagttacactacagttacatgcaagttacagtataattatactacgattgtactataattacatctgtcaaatttttaggagaaaatttgtcgacaaatgtataggtagtcccgatatgacatagcatgttggaactaagtgatcgctttttttaaaaaaaaaagtacaaatgacaactatttttgtttcgcgggctgctatagcataaggccattttatataactactaacccataacaaatgacgagtttattagttgttttgtctcttaaaaccttgtattcttgtgagtcggaacatataatgagtagaacatcatatatgttcacttcttaatttaatttgagttgaaataagacatcaactcttcgattgctactaaatctatatttatactcagttatatgagtattgcttctaatttgtttctcagttgctttgttaatgttttataagatcattattcatggcatatactcaaatttatgcgtggttattaaatgttgctattggaacctagcgtccgctataatgctcgttgtctgcgattcgctacatagatatcaatctgctactgactcattatgtgctatttattactccttctgtcccatgtgttttttctgtgtccaacgtttgaccatttgtattatttgaaaaaaaaatataaaaaaataagtcacatataaagtactatttatttttatcatctaacaacaataaaaatactaatcagaaaattattttaaataagacggacgaacaaacattgaacacacttaaaatgggacgggggagtaccttattaggcctccttaacaaacttcttgtgggctcgatttcttcatgattttccgtagcaccaaaaattaatgcaaattttggcttggagataccaatccctcatgtcacgcacacgatgttcccgtggatggattattagtccttagattagtgtagagaaaatgttttgaaacatctctctaacattctaatctgtagtattatactcatcctctgagagagtgactgctgactgaatactgtcatacgtactgatcaatgtttaatcaggcttcacctcgatctacgtaatcaaaagtcttcgtgcttgacctctgatgagttcagagaaagtacatgcatccacgttctcgaagcaattaacaagagcgcgccgcatctggattcttgaaaaaaaaaggagataatattatgaaacttaacgagtaatcagttaaaggttatatattatcctgtgcattactagggacagattgcaggagaagattagaaaaaggcaagaggcggctgattgagacaaatcgttatcgctcaaaataaagtgcactgattctttataagattgtgatcggcaataaaatatttattcaacacacaatctctgccttgagagaacaaaacactagctgtaatttttttataatcccttctgattatttaa

SEQ ID NO: 40210 - DNA, 1501 bp, Oryza sativa
aaatttctctagctcgtatatacaacacgtacgtacctgggtaatagttaggtgtaacgtgagaaattgaaggaatttgcagcatcgtaggagccgaatcctagtttgatttacgtggtcattacattcgggtcgtcgtagtgaactcatctcagtctcaaagatccgcacgcacggcatatcctcgacttggacaatggaagccaccctcgtgtagaagaacgtcaactcctctagcctcggcgctgatatcaccaaccttcctatggacgcgttcctcgtgtggaaaacacggagcctgggagtcctgagctccaacaccaaagcacggctccagatccaatccaacgacacctttaaaagctcgttggactccagatgcaacgactgatctgtcgttgtcgccggactcacagtttgcttgtgcaagcatagcttccgcagagaagggcagcgtgctgttgacaagagctgattgagatcatcaacatcctcgagcgtgagatgtacaagcgaatcgagcgtcacgttcgtgggaaggcggcggagacacgctttgttcaacgacaagaccatgctctccaacctcgtcgcgccgccgccgcaggtaatcataagcttattactacccaaaacctgcatgcagccgttgctgctattgctgttgtgcaagttcaatggcagcatgtagttaagttgtagggtgaaagacttggatacatgctgcataccatactgaatccacgcgtcgacttgggcaacatccactgatggcacgacgcgtttgctgccgccactcatgcaacggctattgaacaacttaaaggagatctcgagctcctctactacagtagtactagtgccatcatcggcgcgcctggcaaggatattgttaacgaaggcgatgaaccggtcgagcttctcctgctcgctgaagtcgtgatcgaggcagaagaatctgaggacggggacacgcgccccaagatggcgccatcgccgcgagaccgcgcacgcgcgcatcacgtccgtcatgctgggtagggaggcgaggatgtgcgccaggatgtcatcgctgaggtgactgatcaggtcgttgcctccgcctccgccgctgtcgtggtgatcagatggatttcgccgcagcagtttcgcctcgcgcgtggtggtggtggactccatggaaaaaaggcaactaatttgattgcctagttgttgttacgggcgttagggcttctatatatcatcaaaagtgaaaaaacaataatgcttctatttgtatctatatatgcggttacagttaggaacagcacgcgtttctgcgtctgagttctgaacgtacatgttcacaactctgcgctctttaattggggcttgatgggcctattaagtttttggggaaattcgggacgttaatttgtcccaagtggcataatgaaccgtaatgggctgttcctcgtcttcgtctccattcaaaccgcgcccatgtaaaaatttcagagtt

SEQ ID NO: 40211 - DNA, 1501 bp, Oryza sativa
atgcacaggataatatataacctttaactgattactcgttaagtttcataatattatctcctttttttttcaagaatccagatgcggcgcgctcttgttaattgcttcgagaacgtggatgcatgtactttctctgaactcatcagaggtcaagcacgaagacttttgattacgtagatcgaggtgaagcctgattaaacattgatcagtacgtatgacagtattcagtcagcagtcactctctcagaggatgagtataatactacagattagaatgttagagagatgtttcaaaacattttctctacactaatctaaggactaataatccatccacgggaacatcgtgtgcgtgacatgagggattggtatctccaagccaaaatttgcattaatttttggtgctacggaaaatcatgaagaaatcgagcccacaagaagtttgttaaggaggcctaataaggtactcccccgtcccattttaagtgtgttcaatgtttgttcgtccgtcttatttaaaataattttctgattagtatttttattgttgttagatgataaaaataaatagtactttatatgtgacttatttttttatatttttttttcaaataatacaaatggtcaaacgttggacacagaaaaaacacatgggacagaaggagtaataaatagcacataatgagtcagtagcagattgatatctatgtagcgaatcgcagacaacgagcattatagcggacgctaggttccaatagcaacatttaataaccacgcataaatttgagtatatgccatgaataatgatcttataaaacattaacaaagcaactgagaaacaaattagaagcaatactcatataactgagtataaatatagatttagtagcaatcgaagagttgatgtcttatttcaactcaaattaaattaagaagtgaacatatatgatgttctactcattatatgttccgactcacaagaatacaaggttttaagagacaaaacaactaataaactcgtcatttgttatgggttagtagttatataaaatggccttatgctatagcagcccgcgaaacaaaaatagttgtcatttgtacttttttttttaaaaaaagcgatcacttagttccaacatgctatgtcatatcgggactacctatacatttgtcgacaaattttctcctaaaaatttgacagatgtaattatagtacaatcgtagtataattatactgtaacttgcatgtaactgtagtgtaacttgtatgtaagtttcacgtaatttggaatcattagatctattacaagatttgttctggtgaggaagaaaaaaaattacagcacacacatatgtgaaaggatttgtttccacgacctccattttaccgaaataacatgttacagagagatttttgaaagttacattatagttacagtgcaattacatgcaagttatagtgtaattacactacgattgtactgtaattacatctgttaaa

SEQ ID NO: 40212 - DNA, 1501 bp, Oryza sativa
gcttgccaaaatatgccaattcggaggtgaccttgacgacagcggccgggcggtgggcggcgagggcgcggtggaaggtcggggcagagacggcggagcgccaggccttgcagacggcgaggcagcgcacgatggtgcgcggcggcaggcgggccaggatgtcctggatcaccttagatgcctccaataattcagagaaacaaacagctcgcagcttattctatgtcagcttattataatctagcttagagtaatctgatttaataatctagattacaataatcttaagctgaaacaaacaggaccttagtatgagaactttataagtgatcgtataaatataacaacttgcaaggtaggtacgattttgatacaataaactaagaaattatgcgacaacttaattatttggagcattttctacatagattcaatttaagtaattattttgacaatatactagtgtggatttgtataagcatatttatatttttattataataattaataacttgaagtcaattaaactggatgtaaaaattattatatttcggttgatatttgagaaggtaaagaaaacgaaaaaaaattttaaggtaattggatgtaaactgtatatgcaatataattactaaagattaaatttaatatctaaggtaatatctgtaggattgctatgtaatggcattattgatatcgggaaaaaaactcacctagcatatgcctagccaaattgatgcaccaaaatacaaattgtcaagttcttgtagtagaacgcacctacctgtcaagttgttacacttggacgctcatttctcaagttcttgcactatatcgcacccacctgccaagttgtaccgtgggtgcaatttactcttctttcttctacagatttttggaagccaaccttgcaggtttcgagtaccattaggtgcatctggtactagcaagtactaaccccttccagctgttagatcttgtgtgatggatggtcaggattcggtacctcctcttcaaaaagggcccaaataaattgattcattattttgttttgtttgaaggaaaatgattatgcacattggctggctatgtacacacaattgacctgttataagcatgaggtctctgttatacgtcatatatcatcacatttatcatttacagcagtaccagaaaagatctccatacagattaagagttctgaatctttagagagtgcttaaaataaatcatttagggaatggaaaaaaaactgcaatcagatgaaccaacatactgcaatgcaaattcagtgcaaacaaactcctagcgcactcaatcccttattttcaacatgctacatgtagatattcagcgtttattttctgaaccaaactgatatacactacttgtgtttcatacttgcagtagtggtctcgtgccattgtgcaacaacacagacaagactaaaccagatcaacttctatagtgtcctaattctggagaaaagggatagcttccc

SEQ ID NO: 40213 - DNA, 1501 bp, Oryza sativa
atatccatgcctttttaatccgatgacgtgagagtttctacctcgattactaggttgttaattgttcaattgtcaagatgttctgaaatttttttgctgccatgtttggggattcagatttaagaacaagtttggccgtgggtggttaatacaggcagtttgttcagtatcttttggggttccaagtgataaactgagattatttcattcacgaattagagcattggaacttgatttgattgagtttgtggctgtataggaaacagagtatggagcgatcaagctcttttatatcttcatgttttatgcctgccgctactctgttccttgctcctcaattttttttaatctcttacgtgtaacaggtaaattctgtagtatttgtgtgtaaacaaacaggtaatgagtaaaaatgttttgggcactttctgctcaaggttagccatcactgtgactgcatgtcagtaaaagtcttttttttttctttctcctacatgtgggttctgtcaatttttgagaatgcagtagttctttcttggatatatgagtgccctcttaatcaaatgatatgagattttcctcatggattgctagcttgttaattgcacaattatcaatatgcacctgttggataatgcagcagggatagttgagatagaacatcttggagcgcttgttcttttgtgtcatgtttggagattgagatttaagaacaagtttagctgtgggtggtttgcactggggattttgttctgtttcttttcggaatatcaactagcatgaactgggctatccattaattccagaactaggactgtaggagactagaagttgatttggtttaatctgtgcctttgttgtacaatggcacaatggtcgcgctgctcgccgcatcttgctttcgtagggctccatttgtttggtcgatagatcactgaaatcgcttgcaatttcctctggcgcgtgcgtaccgaactaccaatcatgcgaattcgtgtgcaaacacataagtagatgatgttcatcacaatctgagattcagcagcagattcgcattccatttgctagcggcagtgttccaaatttgatcaaccacactagtaaatgcgtcacaactctgaaatttttacatgggcgcggtttgaatggagacgaagacgaggaacagcccattacggttcattatgccacttgggacaaattaacgtcccgaatttccccaaaaacttaataggcccatcaagccccaattaaagagcgcagagttgtgaacatgtacgttcagaactcagacgcagaaacgcgtgctgttcctaactgtaaccgcatatatagatacaaatagaagcattattgttttttcacttttgatgatatatagaagccctaacgcccgtaacaacaactaggcaatcaaattagttgccttttttccatggagtccaccaccaccacgcgcgaggcgaaactgctgcggcgaaatccatctgatcaccacgac

SEQ ID NO: 40214 - DNA, 1501 bp, Oryza sativa
aaagccaacgaattgaagaagtgtatatcaacaatacatatgatgatgcaacgtgtgccggctcctttttccttgtcacaagataatgttttacttaattacgtgctccgtgctgatgagtgcgactgcatttgaatccacgtatggtgtcgcaggggtgatccggtgatgtacaactatgttcttttcggccaaagtgtgtcatcgagtttccaatggccatatataacgttgatacttttgtttgtttgatacttcatccgttttaaaataaattagattatccccatcagttgcttatgacttataagccataacgagctattaacgattaaaaaaaatacatgagtaaaatttctgtgtgtgtatatatatatatatatatatatatatatatatatatatatatatatatatatatatatatatatatatatatatatatatgatacacatatgggactccatggtgctcgggctccaagatataaaacacacaaattctctcaaattttttaaaatttttaaattgtgagtatatacctaggtatatgaatttgattcatacaaatacctaacaacaaaacaactcaaactcaactttatttcacaattcattattacatacctaacgaattatatgtttggatgttatatacctagaaccaaaatctaacaaaaaaaaagttcaaacttgtttgaacttgttagtaaagaagttgatgttcatatctaaacatttaaaaaaatttcatactcatttaaattgggtatatactcaatttgaatcttggagcccatactccatgtagcaccagttaatttacctatatatatatatatatatatatatatatatatatatatatatatatatatatatatatatatatatataatatgttcttagcgacttaaaagctaaaattgaaaaaaaaactatgttaaagaacatcaaaatcaaattgaaaatcaagttttaaaatttaaattttggctctgacttataagcgataggacaaccaatgagacccttaacttttacgcaggagtataatgtattgggaacgtgcagtgtatcagaataaaaatgggtggtaatcttggacccttagaatgatgacgattttctaatgcaggttgcaggatatagccggataaaagaacggcgaaatctagtcggtttttgtgtgccgtgcatcagcgcatgtgagaaaccccgtcagcaggtccaaagcgcgacgcatcaagcactctctgtcgactacttgtcgaggcttatccgtccccaatgcagcacaaagcaaattccacattgcgtctcttttagttgcccctttttggtgcaactagatcggctcatcggcgcaaagcagaagcagaagcagggcaccaacgaaatgctaccttatcatgcattgggtgattagcaaaaaagcagtcggctaatgacatggcaaattagactctcttttgcttttgaagcctcaagaaagattag

SEQ ID NO: 40215 - DNA, 1501 bp, Oryza sativa
tacaatgaatctgtacatatggtttgtccagattcattgtactaggatgtgtcacatccatctaaaatccttactctagtatcaataatccggtatccagaatcgccattatcccgcgagaagcatcgtagaaagagataatggctctatttagaagaattcaaacatagcttcttctaacatctccgactcacttcaaatcgtataaattttcatctaaattataagaatatgtagctataaaatctaaaaaaataaactataaactaaaaactataaaacctatatttttcagaagtatcaaaacaattgtttcaatgttaaactctgcctaacagaccaacaataataacaattactatgtctgtatgttattgctggcaacaagcaaataaaactacattgtgcttgcccttagcggtttagccttgattcctcgaatgcttgttagggttcacataaccgttcacctattgaaaaccgtcgataaacttgtaaatttcaaatttcattgaaattcaaaaatttactttgatttatttcaaatctggtttacctcgtagtttgtcagctaagtaggctggtaaccacgaaaattcgtaagaattgaacatttttcatgagttttgtgaatcctactcgcacaacttccatggttttactcaatcaaacggacagatcaaagtgtacccattcaagtagctatctaaaccttacatgcaccctgcgtactttgatttgcacacaatcaaatgtacagtagtacatgtagtataaatcatgtttactcttgtaccctgtttgatgcaattactccaactttactaccaaatggtttattacgagtactagcttgcagcttctttataatagtgcaacattgcactgtacttaataaaatcaaacgtcacagttccgtacttttcagtctggcgacagtttttttcatccttttttattcttgtgcataagcctaaaataactagttatatttggggttgttcagattgatattatttcaaatcataacatttttttttggtaaaattactaaagatatgcatacatttatttatttttaccaaactttgataaatacataagaaatcatgtcaaaacttatcaatattataaatttttacgaaaatttgataaagtttattttggttaccatataaacagccccttgaaatcaagtaaataccttttttcaggtttccagtggttgggccgtctctagggccatagttttactgttgggcttttgctgtgcagatactggaccgagtgtcatgttgggccaaatcttatttcagcccaaatttcggcccaagagagttccacggcccacgagatccacaactcccggcgccaaaaagctcagaagcggaggcgcgcgccaccaccgcgacagtttcccgcgctttttttttgcccctctctccggcgaccggcgctagggtttcctccattcggcggggcggaggtggggcgcgctcgc

SEQ ID NO: 40216 - DNA, 376 bp, Oryza sativa
tctttgctgtagcttgtaacttattctctctctttttcccttaataaatctcggctggctcttcacgccagcccggcgaaaaaaaaaaaaagattggcacctgtagactgcatactctgcagcattggccatttcagaggtgtcctccctatgagccctctttgaaagtagtttccatgtgagatgtttttatttaccttgttctagttccagtagagatataaataaacttgtcctgattctactgacgatcatgaataatttgctatccactactacaaacgcatcaacataaagtttcttaaggaccttccaaagacaaaattaaatttaattgttttgagcactagtgtatctgtgtatgtaactctctaga

SEQ ID NO: 40217 - DNA, 1501 bp, Oryza sativa
acaactgtgcactcacggagctttacctcatcagtctcagctgagcaggacacgtggatggatcacatctactcccgctgtccagctccttaatttggcctgctacagtacagatccgccattaatgacgactctaatcacatcccaccatcgaataaacgtgctgttaaagtgttaattaagacgatgggtgagcttctgcaaacaatgctgctagtgtcgtcagtgagtagtacacacaacatatctcctcttctgatgctcggctgacgacgacaggagaggagaagaattgggaagcacacaccactgcactgctcctgccatctccaaaacgaagagagcagtgtatatgatgatgatctgaccatggatgtgactagcaacggctcggcaaggagaggaataaacgcgatacacgcagacaagcagcaccagctcacgtcttgaaatggatggaatgatagacaggtggacactgatctggacggatacacagagagagagagggatgcacacttgcattgcacatactgcagagagaagaaagccaatgtcgcctcaaccgcggagtttgcctcccgtgtcgggcacaccggtggttcctgttccgctccctgctccgccggattcggacttcggactcggcgaaagcgcgcactggtggtggtggctaaactgctccacttcaggtttggaatttggatgcttgacatgagcccaaaccgtcccatttcctattattgccactcctgcaacaaggctcaatctacctctgtgaatcactgctcaaacatacccctaggacctgtttggcgcagctcaatctacctctcctgcaaatgtgcaaatggagctcagccaaacagtttcagattcacttaaaatgaaagcgaagctgggtggagcgttctcacgaaataaactagagatgtagagctgggttttggctgctccacgactccacttcagacccaactcctgaagctaaattttggagttggagctctaccaaacaggacagaacaggttattaaataaaaagataggaaaaatcatttacaggttttcacaggatttcaaggaaaaaatgggttataaaatagcaggagtacagtgtagagaatttcctgttgtgtaaaatcaatacggcaatactagagatttcctccagataggacgatgcgacccggtcccacctgtcagagggatcgaataacacggcttttccagtagtacaccacaaaagaggacgatcctacaattacgcaatccaagagggttcagatctgatcaccgggacaattacattaccacctcaccccccgaaactcacccctaatcaccttagaacccctcaactccactaacacactgaaaccccaaaatttatgtaaaaccaaggggctgaatcgaaaaaaacccgagcagttaaaaactcccaccgtcccactcctcctcactcccaccacttcgctcgccgcaccaaaccaccaccccc

SEQ ID NO: 40218 - DNA, 154 bp, Oryza sativa
ctgaccaaggacaagcgcaaaagtatccgagcgtgttccaataaggaatcgacaaatgcgatagcaatgttcatccaagttattacgaaatatgtagaaaaaaaatcagagacttgtttacttcaatatttaggatccagttccttgtcaaagg

SEQ ID NO: 40219 - DNA, 320 bp, Oryza sativa
tttgttggttttatgtatactctttgatgtcatgtggtcgtcccatcatctagtttgttaaatatgatatgttaatttcaaaatgttatatttgatttcataattgtttactaatattatgtagaaataagaatatatagtatgtaaggctcaaatgtatgatgctatcaaggctgaaattactcgattatatgatgctggttttattcggccgtgccgatatgccgagtgggtttctaatatagttccggttatcaagaagaacggcaaatttagggtgtgcattgattttcgagatctaaataaggctacacctaagg

SEQ ID NO: 40220 - DNA, 368 bp, Oryza sativa
tctgttgttctaaggtcacttaggtttgacacataaatactatacaaaatatgcatatttagcttttgcccctgctttttgattggcttttatgacactttttttattacgagctgcattcaaacttgttaactattctaatctgtaattgaaagaatttcactcattccttaacctaattcacttactcactgaatggaatatataacaatgaaaccattagttgctaatcaatgaacatggacttcacatctgaagtttgtaaaacaagcccattgtaaattgatgtctttgaagtttgaaagaaaaccagtttaaactgaatacaactatatggaggtgctaactggttgtttggttttttatca

SEQ ID NO: 40221 - DNA, 1501 bp, Oryza sativa
agagatccctaccaaaacccaagcgagaggcgcggcggcgggagcggggagaggggaggggtaccggcgggcgtcgtcgtcgtcggagtggtcggcggcggcgtccgcctcgaggttccgcttgcggaagttcttccgcatggttggacggagcttggactggttccccggcgaggtttgggtggggttcgtcgacggcggggtggccggcggcgagtttgcagatggtggcgagatggggattttggataggtttggttcgaattttttattttttttttccccaaatcggaacgaattcgccgccgccgcctccgactcaaggcagcgggccgggtcgggcggtcgggatgaacccggttcattggcggacagttgaaccgggtctggaccgcttagtccgcttcttcgctgcgatctgggtccaaaaggacagtgggcggacgcgtgtggggtgttttgaatttccagctgtccagcagccatcgagtttgaatcaaaattttcgttctgtctctaccgttcaaagttggaactcaaaacggagtttgcgtaattaattgtaaactactcttatgcccctgcctccagtaatcagtcctcgcatgaccatgcatttgatgaccattagtttaatttttgaaatagcatttaaaggtaggatagtagtacctaaaagtaccatattttgatggcatatacttaaaataaaggggatgagaccttaaaaatatctacaaatgaagttgttgtcgagtgtgaaatagtgattctattgataaagatcgtgagcgtgagtacgaggctacacaaatatgtgcgtagggaaagctgtctgcctgcattatccatccctatctcacagcaaagctcacaactctcgtttaggaccgggatgcattttatacatattctatttaggtggagcgcataaccacgtaaccaaacaaatcgctctgtgtacccaagatatgagcacaaggccagcgaaagcaatcgaacatgccatatgataccttccatatgatatggtttggctcaaatgctaaaagttcaatccgataaacctatacaccaccaattgaacaaatggttgaagtagaacagattgaaaaatacaaaagagtgaggtagatgtgatggtttgtgtggaggaagattaacattaaaaagaaaaataaactaaagaaaaccatagtttgttcgccacaatttttttatgatcctatttgtttgaatttatcgccgcgtttgattttaacttatgttaaggttaagaaatgttaactcctacctatgcgttttgctcaacgatgaaatgaaaaacaatgagttactattagaaaaccatccacatcagtgccaatcatgtgtgcagaattatgcacaaatggaatatctttatggataaataatatttctatttacttgtggatttatatacttcatttttaataagtgaagcacaatatatcattcactgcatatcataaccagacat

SEQ ID NO: 40222 - DNA, 1501 bp, Oryza sativa
atttgttacttctcgccccggccgagttgagacttgtctcgctctggtagtggaaagcacacacttagattattgaaaacttgcaaattaaaccgattgaaaaataacagccttatctttgaagcttgcattaaccacctaagttcccctggcttgctgagtacgtaagtaatcacccttgctctatataaatatagttctgcccgctctgaagatgaagttgaagtgaagtgaagattagggttttgtcctagttccctgctgttgcctgtggtgttgggtgttagaccgttggttctgctgctgctgctgctgctgttggtggtgtttgcctcgtccgtgtcgtcggttgcattctcgggctgtctaagctgcaacctaagttaaggtaaataagtcctctatttatttaaggattgcaatgattcataattgtcaccgtgggtaccagcgctatgtcctgggactggtactgagatcgcggtttcgtatgaagcggttcgcgccgtttttcctacgacacgctcctatcaggtgccattgtacggcggtgccggtttgggctgtgacaactatgttgaaaaagaatcaaattcaaattcaagtttttaaattcaaattttggctttggcttataagctatagggcaaacgatgaggccccagttatgtatgagatgtgaaatcatctaatattgtttaagaaagtcagcttctagacatcacgggcctgtttactttgatgctaaaaaaccttaccaaatttcagcattgccaaaattttggtaacttgccaaaattttggcagaatttcttatgtagttaccaaaatttggcagcaaactaaatgtagccacttttttggcaacgttaccaaattttggtaaggttgaaaatggcatcaaagtgaacaggccccacattccagatttgaacatcacgatttcagattacacaatattgcagatcttattttcgcaaggaatcagagaaacaaccacaagttttttaacaaatcaatcactttgcagatttcataacatccaacacgccaggtgataaaagaaatatattgtacagatatgagtttctttgctatttgaaccaaaagggggttcaaatttgtagcatctatgactactgtccctgcaaactcttaactatatacagactacccagctactttagtgcatcttacaaagaaaggctacagacatgaggcaaaactaactactttcacacatcagctcccagaataatttccttcagtccatatttttctgtcgttgattgttctatggcatttcttaagtggcctcttgttcattgcagtcttctaatgttgaatcatcagccaagcttcaccccttatgtctgtctcccctgcaaagatgttgtatgtaaaaatgtagtgagtaatttactacttcatccgtttcacaatgtaagactttctaacattgcccacattcatttagatgttaatgtgtttagattcatta

SEQ ID NO: 40223 - DNA, 1184 bp, Oryza sativa
tgacaaaatcaattccataacccctaggctattttacgagacgaatctaacgaggtatattaatctatgattagcggatgattactgtagcataactgtagcaaatcatgaattaatatgcctcgttagattcgtctcacaaaatagcctaggggttataaaatgggttttgtcagtaatttacgtttaatactcctaaatagcaagattctggagagctatttaatagcctgaagcatccaaacagggccatggtttcctcctgcaatgaagagatgccagcaaagagccagaattaagacgtgtatgcattgcacagttggcttgcattatagatagatgatgggtggtagatgatggattaaagtgggtttatgacaattattcaacgataaagataaacaaatgaattaaatgatagacagttgaaaatttattaaaagtagagtccacgagaacactccctgattgtgaataattactcatcatcggagctcaagggtataaggattcctaccggtcatgaattgctacctaatatgattaaccgggaattcttgccaattgatgatgcatatacaatctaacttcccaggaaagttaatacaaataatctgagcacaaattagtagttaaagaaagtaaacatatgggaggcgtacgttgccgtttgctgcttcaagcagcatctgctagaggatgaagcagaagtgcaggagagagactaaacttggggctacatgtcataacagcatgtttagatatatagttaaaagttattatattttttttacggagatagtactattcttgagaaacagagaactcggtgtgttagaactcaaccataaactaagcatgcagagtagagaaacgaagtaggcagaaggctacatgcaagtgcaaattacaagtatgtgctgtttggatatttagctaatgtgaagagtccttgtgtaagagaattgaaaaaaaaacactatatgtcataaattcatcttccatctttttctagttcctttttacttttaatttctaattcaaaatattggtatcaaggatttgttaattcgttcaatttgttgatggatgagaaaatttatttccacacgttacggtgtacgggtataatgctagtaaaaaaataaaaatgagggggtaatggacacaatgagtatacaaga

SEQ ID NO: 40224 - DNA, 1501 bp, Oryza sativa
tcacaatttaaaaattttaaaaaatttgagagaatttgtgtgttttatatcttggagcccgagcaccatggagtcccatatgtgtatcatatatatatatatatatatatatatatatatatatatatatatatatatatatatatatatatatatatatatatatatacacacacagaaattttactcatgtattttttttaatcgttaatagctcgttatggcttataagtcataagcaactgatggggataatctaatttattttaaaacggatgaagtatcaaacaaacaaaagtatcaacgttatatatggccattggaaactcgatgacacactttggccgaaaagaacatagttgtacatcaccggatcacccctgcgacaccatacgtggattcaaatgcagtcgcactcatcagcacggagcacgtaattaagtaaaacattatcttgtgacaaggaaaaaggagccggcacacgttgcatcatcatatgtattgttgatatacacttcttcaattcgttggcttttctgcagagatccatcaatcatagcttaggaacaaaggaaactttggctcaatctctccctagcctctatgtacacatgggtcgttgcattctgcacacatcgatgcacatggctcgattgctttgcttgggttggttctcgacctgctggccggtgatggacaaatggcggtgtggcgcccggtagccgtgtctcgactgttctctctctaaaactttagttttgtggtggataagtgtaaagttaaggtttcgttattttcggcctcatcttttcacttaaattttaaattttcaacatttaatttgaagctgatgttgggattttttttatcgaagtttatttctaacctttacttttagatcgctaagaacacgtatataaaagtttttgttggaaatttggtcataattcggcatattttaatccaaaatattaagacaataaacatgacatttgcaatatgagtagatctagtgacagtgatagatgtatacagcttgagtatgcttaatatgaaataagcatcaacatttacatagtaacacaatactgccattgcgaagagtattaacaaagaaacatctaatagaatcgggagaatgaaagtataccccgaaaacatcccaccgctggattttgaagcaggattgcctccgttgatgtcgttcatcatcttgtctccaatctccgtcgacatcttggtgaaggcgtcgatgcagcagcagtagccgtgaagaacaagagcagtcgcgcttgaagcgttacccaaaaacttgatcgcccgcctacccatacaggttctcaagcggacggagtttcggaggcacctgctcatcccgtacacctgagcgcgcaggtgaacagaaccggggaaggattctacagctcaagaacagaggaggaggaactcgaagtgcaagagaggtcgggaagaacttctttcgtccttctagtcgctgtgg

SEQ ID NO: 40225 - DNA, 1501 bp, Oryza sativa
tgcttatggtgctcttaaagcaacagtagtgcaggatacgccctaaaacctttagcgaggtgtcacgtgctacgtaggccaagacactgaagtctggtttagtttccaaaatttttttcccaaaacatcaaattgaatctttggacacatgcatgaagtattaaatatagattaaaaaattaattgcacagttaggagggaaatcgtgagataaatcttttcagtctaattagtccataattagctgtaagtgctacagcaacccacatatgctaatgatggattaattaggttcaaaagattcgtctcgcggtttacatgcgagttatgaaattattttttcattcatgtccgaaaatcccttccaacatccggtcaaacgtatgatgtgacactcaaaaattttatttttgcgaactaaacacaccttgaatggacacaggtttcatgttgtatgtggtctcaagggtctatacataggctccacaacaaatctcatgtcacggtctatctctgatgagctcaggaacacgtacctcagctcctcacatagagttaggggtgggcagaataagaccgaaccgatgagccgaaccgaaaagactaagaccgagatcgagaaatttggttagtagttcggtctcagccatcgaaagaccggatttttttggtaattcggttataggcttcggttaaccgaattaaccgagaaaaccgaattgtggcccaataggcctaggaagcccaataaacccagtacatacagcaaaccctagaggaggacagccgagtaaagtcaagcacgccctcaccgcctcacatccatcgcgctgcctccaaaccaatccccaccctagcgcaccgtcacgcctccacctcgcgtttcctccgacccccgcctcgtgtcgcctccgccctccgcctccagcgccggcgccaccttcgcctcggcgccgcgccgccacctccgccctccgcctccagcgacctgcgttggcgccgcctccgcctccatcgcgccttttatttgtgacttgtgagctctagtgttgtattgtcaactgttgctgttgtgaagtttagacttgagacctatcttgtgatatattttttggtgtttgatgttgcctattatttggtatttttgtgatatatatgactgtgataaaatgtctgaaaagaggggaagtgctgtcaatttttttcatttcaaacttatctcctgaaaattcggtcagaccgagaccgaatttgccggtcctgagtttccaaagaccgaactaaccgaaaaaccgaagaccgagaccgaattttttagtctaaccaaacgcccacccctacatggagtacaccgagcgcaaatatggaggatgaacaacacatcaacacaatttctgttgtggatggtctcattgtaataagagaacatttttatttatccacatgtctggttatgatatgcagtgaatgatatattgtgcttcacttattaaaaatgaag

SEQ ID NO: 40226 - DNA, 705 bp, Oryza sativa
tcacatgagcttggaaactagctcttggcagttttgtctataagggttagtgagcgaatgacactaatgtacaattgcacagaaccttattgttattgagctgatttttttttaattcagcttaatcaggtccttggctacataactaggtagaatgcttttgttgtgcaaaatattgtatgtcatattttgcaattatactgttccccacatataattgccacgcacagtggaaaaacttgcctatcatacattcatactataaaatattatctagtttatgtctttatgatcatttttgtttaagtggtaacaccagttaaagctaaatgcatgaggattttgaaatgtttactgctatactcattatctacgtattctctactaggtagccttgggcaaaggaaacttcttggttatctttatttgtgatccatttatttttttcatccactgttaattttgtttttgctcaattatgcaatctatttatcgataggcgtggtgcaaacttaaaatgtccctggtttgcatgtctcaacatattatttttccagttaagcttgcaaatttctaattcatcttaatgtagctgtcaaaccttgtcaacttctgtgttgatgtaggtcccaggatatggtctatccttcaattgatacaatggagttctgtagtgaaaatcttctagcatgtggaagtgattgt

SEQ ID NO: 40227 - DNA, 435 bp, Oryza sativa
  unsure (1)..(435): unsure at all n locations
cagcaaatcaaccaacatcaatcagctcatgaagaataaataattataaccctgaacttatgctctatgacaaaaaagaaggccttgtcttaccaagacctaaacaatatgcagttatgcactagtttatagcggtgtatttgaagtattcagtgtatagcttataatagtatactcaactataatattctgataagaatgctggttagcaaatctttgtgaattaatttgttatgtatttgggcattgatacattttactttgccaataaaataacattttatgaatagccgcatgcaaaaaaatttaaatatagccncctaaatcccacaagttggattaaatgtcaactatttggtttcaaatgatagaagtcccttaatttcttgaacaagactttttaacattcagttttgcagcttcccctattggcca

SEQ ID NO: 40228 - DNA, 406 bp, Oryza sativa
tatatatatatatatatatatatgctaacacgtaaaaaaactttgcatattaatatattagaaaaaaaagtgacacgccgagacgatcaaccagcaaagctcctaagctatgacctcttgcatgttaatatattagaaaaaaagtgacacgcctagacgatcacccaacaaagctcctaagctgagaccgagagaggaagaaactacactaaacataactaagctatgtgcctaacaactctccaactggattggcagttgtcgccacccattgcctcccttcttccacaatctgctccaccaccatcagcacttgagatagaacatcatcaaggacatgggcattcctctccttccatagttgacaagggagtcgagacatttcctactcttattatggtggcga

SEQ ID NO: 40229 - DNA, 1434 bp, Oryza sativa
acatgaaaagaaagtaaactgctttaaatttatattttaactctatgtggtcacaaaatcattcatctaacccgaacaaaaatcaagccctaattagagttaattaacgcaagttaattaatactactacatgatttaactcctcgttttaagtgagctcctgtgttttcttgctgttggcttaggtggactggtgacgagtcaacgactgacatccgctgctatttcctgttttggttttggatgattgctgccttcttgtcaaccaattatgctctgttactgttgatgttcacacgtccatctggtgtgatctgatttgttttgaaggagtctacgccacgatcatccaattgccctattgttgttgttactgtataagactaatgtgactcgtcagaagcgaagagctccatatctctgacggcatcgtataaaaatagtattatgtgttctctcctgttgtgtttttgttgtgttgtgccaaactactacttttcagcgtgacctaatcctttcgtcacaggttgtcaccagccacgagcacgaaatgataatgcatgtcattgatccttctcataaatcaatcgtatcttaaagtctgaaattaacgttttttttatttactactactcagtttaagtgagggtgatcactacctttgtcattacatccattggtacagcacgcgcgagagcgaaaacttttacaaaccctcaattaagcctcatctaaaatgaatacaatgggattttgtttatgaaatgaactaatttctataaaaatcctgtaaaattcctatgttcaaaaataactcctaaacatatgaattgttggaaatttagaatgaaaatgctagaagtattgtcaccaattgtttattaaaaaaacatttgatttctgaactgctagattacatcaaaatttggaatgaaattgctagaactctatcgccaattgttcgtcgaaaagattttctatttctagagtatcatattgcatcaaaatttgttcagggagaaggggaaaaaaatgtacgatgcgcatggaaggtgggtatagaatgcacgatctgcaagacacaaacacgtgtctacaggtcaactgtgtcacacgctgtttttataagttaaataaaagttactgtaaccatactatagttatgctctaaagattttcttttttcttaaaaaagaaaactgttgtcagatttggatagccccaatcaataatcatcagtggaatgagacgtataaccaacgaatcatcttgcggtaacgtagccggccggccgccttcccacggaggccggcaatggtgattcgttgaacattttgatcgattcgccgctgctgacctcccagcgttgatggcgatccaaccatatcttaccatatatccccgagcatccctgctaagagcaaggataatagt

SEQ ID NO: 40230 - DNA, 443 bp, Oryza sativa
gtgattacatacaaatcggaggtgcctaaaaggtttacaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 40231 - DNA, 411 bp, Oryza sativa
gcaccggcgatcgggagagcaggtctccagaacctctgccttcgacgtcctgtaccgggagaaggcggcaataaggtttttgggaagcgcttcgcgcgactgctccctgttcgttcgcgacggctcgccttcctcttcgctcgcgtgctttgcgccttcgttgacgctcgcaactgcgagtagttcatgccgagcaaccggactttccgccacctcggtacgtattcgacatattgcgcatatttgatttgttcatgttttattgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttacta

SEQ ID NO: 40232 - DNA, 305 bp, Oryza sativa
ccataacattggatgcattagttgcaaattatggactgtcaatttgacatttcagcacataaagtaaattgtgtcaatgtttctatgtccttctgaaatctaaaatcagccataagtttacaaccatgttgatccatgataataaaatatccaccatctaaattggtacagacgactcaccttgtaattgttgttgtagacatgcaggagtacggtgtgtatgctggtgatgtggaaattgtttttgaacaagaggagttggatgattcagatgaggaagatgaacatccaaacaaaaatcttac

SEQ ID NO: 40233 - DNA, 870 bp, Oryza sativa
aaggggcccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcgccttccatgtctctcgccctcttctagacttctacatgttggttggtttgttggcccagctcagtatagagcacggcccacttcccaggttggcccatattggtagatgaacagcccatacaaggcccagtaatatatttcccaggcttgtgtccggtcagatgtcactgtgttgctctgttttctttgttgttacatggcacatcatcccagtgcaatttaatcaaaatgaatcaaattcttcgtccacaatgaagatatataaattatttccatattttaaagctgagattcgagtattcgtcggtccatctgtaagttccaatcatggacaccgaatatcgcagggttaatcatcagttcatcatggaggggcccactcgtcaaccacaggaggaaaacttaacaaaatacaaagccgcgggaacggggtgaagtgaaacatgtcacgtcttcaaatgtcaacctcacggatagctgcttagcagtagcagcagcatcgcctccagctagctctgatcatttgattctctcgtcctaatccacattttgtgctgccgattaaccacaggaaagtgagctttgcttgcaccacaaaacctgcaaattgaactatattcgaagcttagctaggtgactgattcttgctgcgattcgatgtcca

SEQ ID NO: 40234 - DNA, 868 bp, Oryza sativa
cgggagtaaatatcttttcccgctatttcgaaattctttttaaacccggttagggttaagaaccgggactaaagattatagcactgcatatgattttcgcttacatatctgtttataaaatagaagttaatgcattaacattatttaaagtacaaagattaatgacaattacttcgaaaaattatttttgtctgtaataaattaagtggataaatcgtaataagcaaatataattaataaaaattcaaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattatcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 40235 - DNA, 918 bp, Oryza sativa
gccaacaccatgattgattgattcctctgaaatctgaatctctgctggtttctaggtaacgcgtgaagtgaactgctctccacgtaattccatccgtcgatctcgtcctacgtgcgggcacagcaccggagtgcagcatacagctaatataatgttcttaaaaaaaaaactaacaaaggaggtgtttagatatagggatataaagttttaaggtgtcttacatagggtgtcgtatgaggtgtttaagcactaataaaaaaactaattacatagtccatcattaaaccacgagatgaatttattaacctaattaatccgttattagcagatgtttactgtaacacaacattatcaaatcatggaggaattaggcttaaaagatttgtcttgcaaattagttgcaatctgtgcaattagttatttttttagtctatatttaatatttcatacatgtattcaaacgttcgatatgatagggtgaaaaattttagggtgggatgtaaacatggcctaaggctgtatttagacaggggtataaagttttggtgtgtcatatcgggtatacggacacatatttaaagtattaaatataatctaataacaaaacaaattacataatccgctagacgaatttattaaacctaattaatccgtcgttaataatgtgtactggagcactacattgtcaaatcatggcataattaggcttaaaatattcgtcttgcaatttacatacaatttgtgtaattaattatttattttttatttttaatactttatgcatgcgtccaaacattcgacataacatggtgtaaaattttgcgaggggatataaacaagccttaacataacacccctaccatgaacctttgcgccttcgatttctccgacatccgctgctagctgcacgcaatgcaa

SEQ ID NO: 40236 - DNA, 381 bp, Oryza sativa
ttcctgcagcccccacactatatattttttgaatgacaaatgggccccacacttttttttttatttctagtgccacttaagcgccacatcaacgccacatggaaagaagaccgagtcaatgctgctacgtaggcgccacgttagcaaaaccgccgagggagtcaaattgctccggttttaagagttttggggtcgaaatatccggtttttggtttatggtcgtggattagatttcgatcacagttgagggtcacgaagtgaacttatcccacataaaagagccgacggcccaattccactgcaaatttaaatgggccaggatccggattctatccaagcccaactcacacccacgctgctcggctcgacacacatcgccgc

SEQ ID NO: 40237 - DNA, 1501 bp, Oryza sativa
cgttgatcctggggtttggcgtggtggcgctccagatgaattcccaatgacggttgcggggcagttcgaacatttccccttctcagaaccgtcataacttacctataaaaggacctcacttcattcactctcacacacacttccaagcttgagctgaattataagaggctctattgtactatattgtatactagaataggaagagagtagagtagaagaagttggaagaattccggagctgtcggtaatcttctcctatttcttttattctgtttattactttgaattcaatataatattcttcttgagtaatttagatttatcttgtgagaattatctcttggttagttcctaaatagcatacgggattattgttcactataatcaactaaaatatagtgattgctttggtgagttataaacactaaagtagatagtaattgcttagacgtggtgtttaggtaattgttatctagtaattgctgcatatcccatagtatgtttgaggtaggtgtagaggtggttacagccctcgagatcacttaagtcctccctgtccgggtacgtagtagagcaacatctgggaacaacgggttgccttggtcttcctcttcctaccggcatcggctggttctcttatttgcccttggagtaggcttgaggtcctgggggcataacagccgatgacagggggagctagaccacctccatttagtagaaggcctggagcatattctatgtctttgccgctattgcttttgcgatgaggagaggattctattgtctgcaagacagaagaagaggttagtcaaaatacaaatcggctgacagtcattttacatgattgacaaagtaaggatttacctgagggataacatctgggaatagatctgtcatgtacatggaagccgattggtggaacaagtgctgcttccattcaccccaccatttgtcaaagttcgtgctcctgaaccttgctagttctacattatcgatgctgcccaaagggggtcctgggatgttgagcagtcgatccatcatcaatgttgatgagattttgcctctgcattgaattttatcggcaaaatagaagccgattggcagctgtcccatcccaaactgcctagccgagctcatgggatggtagaactcataagatacttgtatgtttctcccttgatggatgccaacaggaagaatacatggactgatagcagccgagaagacttctctagacttatcatattttttagaattgatttcttcaaatatgaagtctgatggcagttcaaagctcattgagtcttcatatgcaaaccaaactcgggcatctttctgaaaaccatcatagaaactgaagaaccagtccctcagtagctcagccgataacttggatccagaatcggctggtgtggatgcagcctctccatatgacatgcatcggcggtgggtgagttcttctccatcatcatttgtaatcggttctagccttggaaattca

SEQ ID NO: 40238 - DNA, 1501 bp, Oryza sativa
agatcattccagctagccacatggaaggtccagaagggactaaagtaactgggaagagggctaaagatgcaacgagaacaacagccaaaactggacgcccaaaggcacttgcttcccattgcatgattggcaagagaacctacaacaaacagatcttccaacataagtccaaacaattttctggaaaatgaatatgattaaaatgttactcctatctggcacaacatggtacaaaaacaagagataattgaaaattttgtaaacttgaaattaaattgcattgtgacagccgtgcatccattaaccatacattcatctagcattccaactggtgtgcataaactagggtatacatgggaacatatggactagtcaaactatcaatcaacagtttgaaatttcataagcagaaacctccactaatgcatggtagtggaggtttcataagcagaaacctctgccgacaaaccataaaaagaactcaagtcaagatttcagtacttggtcaacctatgaacctatgacaaatattacccttgatgctcaccttctcgaaggcaaaggggactccccatttcacgaagacataagatactaatataagaaggaagcagccaagcagaactttcatccaccaaatggaccttgaggtaggttcttcaggtaggactaccgtgttatcatcagctattacactatgagctggtctgaccagcctttcatattcatcatcctttgtgttttgctcaggttgttcgattccgttgcctgatgccactgcggaagagcttggcatgtctgtaactacctcttcacgtctgtttacaaaccaagcagattagaataagaagttactcaaaacatgtaacaaattttatcaatttatctcattgaagtaaagatgccatgtgcttgttttgttttgtgtactggaaaagcatggaaattagttgtatggattaaatctaaccaagatgtgcaacaaaaattaatctgatatgctcacattcacaagcatggctcatatctttgtcatttgatctcacattctgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcatggtatcagagccgaccggccggcggcaggcgacggctgaaccctagctggccggaggcgtggaggcttgagcagggtagagagtgcgcatcagcagcggcgcggaagagcggggccagcgcggcgcgtcgaggaggaagaagccgagcagctgcaggtgcggagctgctgctgctgcttggggctgagctcgcaggtgcagagctgctttgggctgaggcaagaaagaaagtgctggtaaacagctggtgttggtgctcctcaggaagaagtggctcttgctctgtagtggcggggtcacagca

SEQ ID NO: 40239 - DNA, 1501 bp, Oryza sativa
cccaaccatagccaaagatcattccagctagccacatggaaggtccagaagggactaaagtaactgggaagagggctaaagatgcaacgagaacaacagccaaaactggacgcccaaaggcacttgcttcccattgcatgattggcaagagaacctacaacaaacagatcttccaacataagtccaaacaattttctggaaaatgaatatgattaaaatgttactcctatctggcacaacatggtacaaaaacaagagataattgaaaattttgtaaacttgaaattaaattgcattgtgacagccgtgcatccattaaccatacattcatctagcattccaactggtgtgcataaactagggtatacatgggaacatatggactagtcaaactatcaatcaacagtttgaaatttcataagcagaaacctccactaatgcatggtagtggaggtttcataagcagaaacctctgccgacaaaccataaaaagaactcaagtcaagatttcagtacttggtcaacctatgaacctatgacaaatattacccttgatgctcaccttctcgaaggcaaaggggactccccatttcacgaagacataagatactaatataagaaggaagcagccaagcagaactttcatccaccaaatggaccttgaggtaggttcttcaggtaggactaccgtgttatcatcagctattacactatgagctggtctgaccagcctttcatattcatcatcctttgtgttttgctcaggttgttcgattccgttgcctgatgccactgcggaagagcttggcatgtctgtaactacctcttcacgtctgtttacaaaccaagcagattagaataagaagttactcaaaacatgtaacaaattttatcaatttatctcattgaagtaaagatgccatgtgcttgttttgttttgtgtactggaaaagcatggaaattagttgtatggattaaatctaaccaagatgtgcaacaaaaattaatctgatatgctcacattcacaagcatggctcatatctttgtcatttgatctcacattctgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcatggtatcagagccgaccggccggcggcaggcgacggctgaaccctagctggccggaggcgtggaggcttgagcagggtagagagtgcgcatcagcagcggcgcggaagagcggggccagcgcggcgcgtcgaggaggaagaagccgagcagctgcaggtgcggagctgctgctgctgcttggggctgagctcgcaggtgcagagctgctttgggctgaggcaagaaagaaagtgctggtaaacagctggtgttggtgctcctcaggaagaagtggctcttgctctgtagt

SEQ ID NO: 40240 - DNA, 1501 bp, Oryza sativa
tccaaataaacagcccgaaatcgacaccaatacaaaatcggtcgatcaaaccattgggctagccgatttgaccgcacataccacgtgggtttgtccggccaccactgatgggtatgaccaagctaacacagtcagcaccacctcgctaatcatccaccaaatattaaaaccaattgtctctcatatcaattgttcatcacaaaataacaatcaagcacactttgatttcataatctcccccttgatgaacacattgataaaccgatcaaaattttgttgttttgttatttgaaaaaataaaaacaaataagtggtaaaaaatcattggagtgctaaaaaatcaacatagaacttctcccccttttgaaaagaaagaaaattcccccagctgaaaacatgcatgttttgtatctcttctccccctttgacaatgatattatcaagttttgcaagtcaccacttatagttcaaagagctttgagatataacaagagcaattcaaggacgtgtgttgcaaaacaaaagatataaattcatcaacgagttaacaagcatgcattgtgagtataaacatgaaccaaaaatgttacaattaagcttaagtcaacaatcaagattcatgatttcaaacaatttataatacaatatattcaatagtacataggttgaaagaaaaactctacatgtagacttattgcattatcattgattctcaaattaactccttttgagaaaaacaataaccaagaaaactttcagcaattatttgagctttttgtgctcactttgacattgaacattgaacatatatatctcattttgacataaatttttactttctcttcaagagacgactattcccggacgaagctaagaaacctcatggccaatagatgactaaaaatctctttcctaaatctccttttgagattatctaatgaggatttgagaatattaaaagtattacctcaacccgcgctttatcatcgtgccatctgactccacaatcacccatctagcgctgccctcccactcgcccctcttcttggatggcagtctcgctcaggagacaaaatttgagattgagaacgattcccgatttgtgaagagcgagaatgaagaagggaatggtgatttttggaatgaatagtatgggtactgttggagcggttttttcttactaaaattccaaaaaataaagattaggaatggagtagggacaccattgttgatgctctaaacacgggtcttaaattattagatttgactgtgtagagaacatacatatcttctttggtatatatgcatgtgcgcaagtaaaagtattttggaacaactttttttcccaacgtatatagatatagaagtatagaatgttagcggtataaaaatgaattattgctccaacttgacctaattttttgatagtagaattaattctgccattccaagttgatttactaattgtttcgaacgaacaggcacaagagttagttccact

SEQ ID NO: 40241 - DNA, 1501 bp, Oryza sativa
cgtgggtgcacacgagtgagggctagccaaaaaataaaatttatttatttttggaatatactcatatgtgacgggcattaactctagcataagttaatgcccgtcacagatgactcatctgtgacgggttatagttgtggcccgattgagataggtcatctgtgaggggctatagtttgattggtcgtctgggtcaaagctatcggtgacgggctttacttagggcccgattgagatagaatcatctgtgacgaccgtttgcccgattgagatagctcatcacatcagtgacttctagcctgtgatggacgccatgcccgattgagatggggcttaccgcccgattgagatgagggtatccattctagtggattaaaggtgccgttttttgacatattaaaggtttcggttttttaataaaaaccagcacctatagaataagtgttggtttttatttagaaccggcacctataattgtttaaagatgtcgttttttttgcaatttcaacccacatgtgcgaaaaggcctatatgtgtcagatttagcacttctggcacctatagtgtcgagaccaatttgatgttttgtagtaatgtgagtaagaagctattgatggttaaagttttacaagtttcactaaatctgatcctaaacattaaatattcagaggaagtatattaattaattagccctgcaagttggcactgtctatttaagcattgccccggggtctccagacggtagcaagcgaccaaggttagaataactcaaggatcaagtttgcaactgatcgaatttgctagctagctggtttcacaatggtactgatcttctcttgctatacgcatatactactatgatcttcgtcccaaaatatagttactttaaacgtttaaatttatttttttttcttatattacttgtctacctagctattttcttatatatctcatcatttgtttagtttctccaccagctgcttgtccctaccaaagtaccaatcattactaattaattttctttttaatgttacgtctattcccaatccttgtaatgaaataactcgaccgatgaaggaaagaataagaaaaagcttcaaccaaactggctaaaaatggccacgaactttggcccatacatgcggattagtccttatgatctgtcattaacccatgttttaagacctctgtctttcagatgatgggcccattcttaatacacgtttttacgaggagtctacaagtgatcttttttaacctgaaattcgcttacatagatagtcatacccagtactactcgagcatttcaaccactaggctacgagttctttctcgcttaatccttatacaagatatgcaaagtgctttattgggacggatggagtgcttatatactccttccatctcaaatatagcattagattcatcgtatatctggatatggtctcacccgattttagattcccatattttgtaatggagttaatattcttatcaaaca

SEQ ID NO: 40242 - DNA, 1501 bp, Oryza sativa
catggtgacaaagttgcatagctgtaatgaagtgaacacgagtcggcggtaacagaagcaaaccggtggtgaagacgcgcagttgtgaagataaaagcaccagtcggcggcggcataaccagtcggcgacggaagacgatgatgtccatcagtagtggtagctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccaacgtgcaggcggaaacaccagtcggcagcgaacgaggcggccggtcggtgaaaacgtagacgtccaacaacggcggcataataggccagccgtgtaagcggaaacaccggtcggtggcggatgaggtggccgatcggtgaagatgtaggcgcccaacaatggcggcataataggccagccgtgcaggcgaggacaccagttggcggcgacgaaggcaagccggttggtgaagacgtagacgcccaacaacggcggcataataggccagccgtgcaggcgaggacaccagtcggcggcgacggaggcaggccggtcggtgaagacgtaggcgcccaacaatggcggcataataggccagccgtgcaggcgaggacaccagtcggcggcgacgaaggcgagccggtggtgaagacgtagacacccaacaacggcggcataataggccagccgtgcaggcgaggacaccagtcggcggcgacgaaggcgagccggtggtgatgttctgattgatccattcctaaagcgtaggagataagcttaaagccatgaatcccttttatgcatatctggatctggatcctacagaacaaacagataggatgagtagtacctgatgtaaatataatactcgagaaaaattcaagcattttaaaatgtttataaatatgtatttctcctcttgtcaattgtgatttccccgagcagatgactccttacgtttaaacactctgcccgactagtcatagtccccaagcatcgggagtcggcctaggcacttcccaaacatgcatatgagtgacatgagttcgtcattaatggaacaaagtttcacggatcagaatttactactcgggtacttttgccattattaagagcagaaaataaatttatctcatctctatgcttttgatttattccgaataatacttagcaccttgcgttactcggtccatccaacgagcccccgggtgctaggaatcagcccaaaggcaaccatccattggcaaaccaaacggaaagcataggaagatagaactccataactcgataggtacttttgtactcagattatgtcgcaagtaatcaagataaat

SEQ ID NO: 40243 - DNA, 1501 bp, Oryza sativa
taagaatattaactccattacaaaatatgggaatctaaaatcgggtgagaccatatccagatatacgatgaatctaatgctatatttgagatggaaggagtatataagcactccatccgtcccaataaagcactttgcatatcttgtataaggattaagcgagaaagaactcgtagcctagtggttgaaatgctcgagtagtactgggtatgactatctatgtaagcgaatttcaggttaaaaaagatcacttgtagactcctcgtaaaaacgtgtattaagaatgggcccatcatctgaaagacagaggtcttaaaacatgggttaatgacagatcataaggactaatccgcatgtatgggccaaagttcgtggccatttttagccagtttggttgaagctttttcttattctttccttcatcggtcgagttatttcattacaaggattgggaatagacgtaacattaaaaagaaaattaattagtaatgattggtactttggtagggacaagcagctggtggagaaactaaacaaatgatgagatatataagaaaatagctaggtagacaagtaatataagaaaaaaaaataaatttaaacgtttaaagtaactatattttgggacgaagatcatagtagtatatgcgtatagcaagagaagatcagtaccattgtgaaaccagctagctagcaaattcgatcagttgcaaacttgatccttgagttattctaaccttggtcgcttgctaccgtctggagaccccggggcaatgcttaaatagacagtgccaacttgcagggctaattaattaatatacttcctctgaatatttaatgtttaggatcagatttagtgaaacttgtaaaactttaaccatcaatagcttcttactcacattactacaaaacatcaaattggtctcgacactataggtgccagaagtgctaaatctgacacatataggccttttcgcacatgtgggttgaaattgcaaaaaaaacgacatctttaaacaattataggtgccggttctaaataaaaaccaacacttattctataggtgctggtttttattaaaaaaccgaaacctttaatatgtcaaaaaacggcacctttaatccactagaatggataccctcatctcaatcgggcggtaagccccatctcaatcgggcatggcgtccatcacaggctagaagtcactgatgtgatgagctatctcaatcgggcaaacggtcgtcacagatgattctatctcaatcgggccctaagtaaagcccgtcaccgatagctttgacccagacgaccaatcaaactatagcccctcacagatgacctatctcaatcgggccacaactataacccgtcacagatgagtcatctgtgacgggcattaacttatgctagagttaatgcccgtcacatatgagtatattccaaaaataaataaattttattttttggctagccctcactcgtgtgcacccacgcggaagt

SEQ ID NO: 40244 - DNA, 380 bp, Oryza sativa
atgtgtacacattttctataaaggtaaaatattttggtcatatataaatctaaaaacctaagccttcgcattacatatatatgtattaatacatatatattatgcgtgtatatacatataattttatataatatatatatacatatacatatgtctgcatatatatgtattgaaacatatactaggcagggcttatatctatatgggtatatccaaccgggactaaagatccctctccactcccggttctttcaccaaaaaaaagacagatcgatctttagtcccggattggtactcccggtttggaaaccgggactaaaggggggttacgaaccgggactacaaagggtttctccaccagtgcccccatacaacaaata

SEQ ID NO: 40245 - DNA, 1501 bp, Oryza sativa
cttttgttaggtgtgtattttgttcactgttataggtgtggctttccatacttttttaatagcatgtctaacatgtcatagacttaatttcttttcaattttttccatactttatgactaaaaatttattcccatattttcatgatggcaacaacttgtctaaccttagttacgataaagtgtgtctgccaattaaataccccgtctttttttatcatgattatcttggtaaatactctctcagttgtttcatttaactagaaaaatgcacgtgcgttgcaacgggtgaaggttattttaatcttattattgttgtatggtttagctaaggtgaaatttaccgtgagaattcgcttggatattttttacaaaatcatgagccgcaattagggatccgatcgtctcaagttagcatgcaatatttttaaagagatttcttatacaactccttctatatttctaaaaacgaacaaaatcaaaaaccgactcaaacgcggatttgtatttccaaaagcgattgaacttaaaaaccgattcaaacaaggatgacgtaccaaaagtatcggtaaaaatatcttcaatttttataatagtaaaggtagagacatgtaaacaaaaatggagtatatcatctactccgtacatggtatggtgctgaagttttactctgttcagttttaaccaattgaatcttagagttgaggtgtactataaagtgtggtaatagtttctttcagaattttttattttggttttgtagtaaagtagtactacatatctctatctctactattataaaaattaagaatgtttttttcggcaatttggtacgtcatacgtgtacgagctggtttttaagttagttcgtttttagaaatataaatcgtatttgagtcggcttttaagtttgttcgcttttggaactttaaataactcgtatgctaacatgagacgatcggattcgtaattgtagctcatgattttctaacaaaatacatatccagatgaatttaaccgtaaattttatcttaaataaaccatataataataaaaaaattaaaatagccgttatgatgcacagatatttttttaatagtacatagtgttaaaagtattaatcgagagcaggttggcccacatgccacagaaaagaatatccctacagcactcccgttcgtcatcaccaaccaaaaccattttcttcaaaaacgaaatccatccctatccgaaacgatctcatggaccaactcccactgaaccgtctctcaccgatacgtggaccccacccacatgtcccgtcgtcccccgcgctgacttggcgaggccgggcccacccaacgtgggcccacgaatcggcccgcctacctcctcccgccgctattaaatcgccgccgtgcgggtcggtctcagctgggaagcagttgacaatctcggcggaaagcggcggcggcggcgacggcggcggctgcgggtccgatggatctggtggaggcggaggcgg

SEQ ID NO: 40246 - DNA, 175 bp, Oryza sativa
agttcttttttttctttttgaattacaagtaacagaccaattgggtctctgccgttcattcgttcttgatgtccattattgctgagttcgcaaagattctctgcacgtacctttgcaaatattctctgttcttgaaatgtaccgtatccctcctgtttgtacttcccacttcagt

SEQ ID NO: 40247 - DNA, 932 bp, Oryza sativa
ccctgtaaaggcatctcttggataagccgtttgctactacggacagttcaagtaacagcttcagcgctggactgttcactctgtaactgttagagtatatggataggactctagcatccgtttgttatactagatacttgagatctaagtcttgcactcgtatatatactgatccccgaggctaaatacaataactcaatatttgcagtatatctctctccctatactattcaacatatcatcaaggcatcatctaatctccatatgtctaccagcatgctaaacaatggcatgaagagcctggagagacacgagaacacaacaagaattacagatgaacaatatggaaaataatacatcaaatgattcagttccagttcatcacatgccatgtcagtaagtgtgagttggctaatggtagaggcaaccatttatcttttacatcagaaggagttcattctactaatctgcatatgaagaccgcataaggggattgccatggtgttggatttttttgaagagtaacaaatgaagcaaacaaatgctcacctagaaggtctatttgttccccccaaaattttgacatcatgcatcctcaccctatgagttgaatacaacacttggaattgttattgttatatccttgttggtggaagtcatagttacaaaaggatagccgtgtaaactattacacaagacaaaattcacatatgtactccacaacaaatgttcccttagttccaaaatataaggcacccacaattttaggaaaatcaacatttgtaacttttgactaataattaagcatataattatatatttagtgccatgcatgcaatatcattagatcatatttgagagtagttttacatgatgttaatgttatagttgttgataatatattatgaaagaaatcaacaatcattttagac

SEQ ID NO: 40248 - DNA, 168 bp, Oryza sativa
attctcattttttttctttgtttactcgaactaaccacacgattaattctgtcctgttctatatgcatacgtacactgctgcaacctattcgtaattaattaacaagttaatttaaccatcatctggtcccatccggcgactctttcctccctgattcaacggtgaga

SEQ ID NO: 40249 - DNA, 235 bp, Oryza sativa
tccatgcagatatctcgcagcagcagcagcatctgcacgttactcacgtggcatctccaactctaccgccaaatttgtattctttttttgaaaaaaaaatcgttggctcccgcgaccgcgacgcctcgtcgcggccttggtggtagagtacaagaaggagccaggcttctcttctcctcgagccagcagcaacacgcacgcacgcaccacacacgtagcagcagagcaatggcgg

SEQ ID NO: 40250 - DNA, 1501 bp, Oryza sativa
actgcggcaacgggtggattcctctcctggattttctctcccctcctcttcctcaacggtggcgaatggaaatgacgacggcaaccgcagtggatggcgatggtggcgtcggcgaatggcaacgacgacggcaagtcggcaaccgcagcccaaggaggcataggcggagacggcagaggccgccaaaatcaacgccgcgccgcccgaatccggtggggacggaggcaacggaggtcggacggagccggatccagacgacgataatggcaacctcagggacgacgacagtggatggcgacggtgcagacgacggcgacagcggctggcgacctcgacgacgatggtggcactccggcgtgggttcaagatgctcgccatcgtgctctctgctgccggtccgcacttctgcgccgcatcgagctcggctccccaagaaccccaccacagcctcttcctcgccgggcgcccgcggcctagcgctcgcggccaaggggctccgccgcaccatcctggagatgcaggcgacgcatggaagccggtgctcgcggcagtgcacgacgcctgcgtcgaggtcttggccgcatgcgccatccgagccgaaggagagaggggggaggggggaggaatctgtgtggggcctacggttggccaatgatttctggttgtccaaatttggctagtgtaggggggttttggccagccggatggcttagtcatccagttggagaggctattggagcacgtttttgggctagaatggctaaaatttggcttgaagagtgggatggagaaactgttggagatgctcttagagacgaccatctcctatccgactgcgtcaaacccaaccaaacacattcttttcaacaaaaacacagccttaatagaagcgtgtgtttttttgctaaacatgtaaaagaaggggaaagaaccgaacacgcgcacatttttcaaactgctaaacgatgtttttttttgcaaaagttttatatacgaaagttgctttgaaaatcatattaatctaactttttaaaattttgtagctaattcttaattaattatacgctaatgaatcactttattttgcgtgcgtgtaggatttgttcccaaacaccacatggcgaatgcagcgtaagtgtcgttgatttttcaggtgattcttgaaaactaagctcatgatatttacttgatttctcatatatcattgggtttgtttctatctttctcgcttgtctaacgattttcgttagtctatcaatagttagacatttgttttagggatctgaaatgaccttattgcatttggcatataactaaaagttaaaaattttctacataaaaactactatttgggttgtgaaaacttaggatgataggatcagataaaaaataacggattttatatagtttagggtgaaaaatgggatggaaaaaaacttcaaagtgtccgaaaatgtactcgagctgttcagcctcagcccacaaaatgcgctccatagaa

SEQ ID NO: 40251 - DNA, 870 bp, Oryza sativa
gccgtcatatgttctaatatcctcataacttctagtgccctttttacgtacatgatcaacatcctcataaaatatgcttcggccgcagaaggatggatgtaatacatcctaccaatcttatagccgtgctgccttattttccaactttttaaatcatcttcccaagtaaacatcgtaggatatttgcagtatgttaggtgacggccttgcgggaacagatcattagcgacaaaccactcagtcaatgttgttttttgtaaaaatgtatttgaaaccatagatgctaaatttgtgtctaatctaaaagagaccacgttcatgttcggtaaatggcatgctaaacgttcaacagaagggtttctaaaatgaatatcatatgcatataatctccacatagattgcttatcacataaatatcgacacgcaataaactcagctatctcatcccttggcggcttaacagtgaaatcagcaccacgcatctttttgctagagcttggtgtaccactatcgtcaactgcaacacgccctaacttcctttttctcactttggtaaactttatgttggcatgatcagacccttttgtgacatatttaaaaagatatttgatcattttagatttgttgcaccactcaacattgatatgagcctcaaacttacgcagcagcgctatattgtacggaacaactgaacgattatcaagtttcacattgtttttatatgcaaatctaccattgtcacgccgtctataaacaatgaaacctttatcatctacagttgtctcggaagcaaaatcttttggatactttttagaacaaaccccatttttcatgcaagcacactttctattggcatcaccacaaggacca

SEQ ID NO: 40252 - DNA, 1501 bp, Oryza sativa
ttttagtaaatacttctttcagtaaatagatggtggctattacatagatgaagcacacggtcgttagttaatgacaaatatcattgctttttttttcctggttctgattcattattggatcatgtttcgccactcagagtgtgtcccgtggtgttttcttttcgtgcagaaccatgtggttcatttgcatttttgagtctttccttaagtgcatctctgtacgtttacatgtttttttttgtcccttcacatcgattttttttggcgcaggtgcttattgtcgcggtcaggtccgtgcgatacgttcgttgctgttgtgctgctgttccctttaccatcagctcctgttcaggtgagctttgtttctttgctatttctttggggcagacatcctttttgttttgtagtttatttgtgccttgtggtttggtgtatgttctttcttttatctgatatccagcttaaattacattcttattccctgcaggttgcggaccgcatctcctgtgcccgtacatgtcggctaaggtataacaattggcctttgttgcttcagctatctatacattattcgagctgcgctgttccttgtgggttatatgttctatatgtgtgcacgacatttctgtttttctatgcgtttagttcctatatggaagggggtcgtgtggttaggcctgctcgttgacgggatcgccgattgctagagcgtagcagcgcttctcttagatgtatggtttgttgcggtttgttttttttagatgctttagattttatatcttttcctgggtggaaagattaaatcgtctgttgcttgtttagcatcttcctctaattcagctgccagcgaatatgtttgggagactgttgctccaccccatcagggtatgtgatttactgatctgtgtgcgactgttgttgtggcttgtttatatttatgtagtcgttgctcatatatttttctcgctttagtagacgatggatttttccctatctaccctgcatggtattcttcaaaaagacggcaaatgtgttcaaaaaaattggccatgaaacgattggaggctacaggtttttccattggatctttggttttctgcatatgttcttgctgacatggcttacatggatgttatatctccttccctataggcaaaaaaccttgccgtattgctcctgtctcttgcaacaagtttgacagtgattatgccaagtttttaagaggttgctttcatctctgattcgtttccattcccttgtttgcaatgccagcacgcttggtttaaacataaatttctttttttgaatgcttgcatagagacttcaaaggataggtgcgattatggccctcctgagtatcgctgccgtatgtgcgctgctcagttctggtaccaggaacagtgcaagaaagattctgctattaccaagcgccgtgtctgttacaacctttgttgcaaaggcgggaaaatttttgtccctccatttgcgcagccaccagaac

SEQ ID NO: 40253 - DNA, 1501 bp, Oryza sativa
agaatgaacagaagaaaagccaacaaagaagaactcacttgtaagatgtactgaagcaagagatgaaaatgaatgttgtgattgttgtcacagtgaatgacgattaatattctcaactgtacttaaaattttgaaggaagtcaaagtttgattttttttttttggggggggggggattctgatgatggcagtaacttgcatgtttacagtaccattttctgtatgctatttccaggtgattgttcggaagtggcatgcacaggaggagagattaataaaactaccagaagaggaggtgacatatctgattgatagaattgtctttaatctattatatcactttatatttttctagtaacttttgtaatggttatcagtgtagacatacggactattgattggtcctccattgctttgtttcctttgatgaatgtcttgatccttcaattgctaggcattctgtttggctgctaactgaaaaccaggaaatctgcttttatatgttgctaatggaccatttgaaacaaaaagcattatatttcaaccaattgatccacttccagtactaggatccaagtgatcctccgatgcgtgcaatgttaatattgctttgaaaccggtgcaaattaaagtatgtggagcatagaagcacctgtccctttctagttcttataaaggctacattgcactgaactgagatggaagtgtcttgaaaagccactatttcagaagataaaagagtgcattttgctgaatgttggtatagtagcttcaagttcttttaaatcctgtaattttcatatttccttcatgcgctgttaaactgtaaagtatgccaagtatcaattgtattgtgattgtacattatgaagacagacatggcaacttgtgaataactaaatcagtttataatgaggtataagatacattgcttaaaattggaattgcagctctctcatacttgcaccataaatgacagtggaaattagactagacaattccctaaaaaaaggactagacaaaatgcactcaacctatgtttgaagtttgaacttgtttttctatggattgccactgttgttagtgagaaacagtgtacattacatgaatcaggtaaaattaaatttgtctaatacccctaacttgtacatattccacagacttgtgcttctgcaaaattcactatgacttgacaaaaatacacataacagatatgcccagttggtttttcgtttaggaaactgaagtttactttttggtaggaaatcagatattctgaagcagtaagacatttcgagtttgacagtcagcttggaccatataatttggattcatttggagattggaaacaactctcaagctacttgccacaaagtgtcattgaacgtcttggtatgcaagattccttcttgtttctcatattggtttggaagtcggcacatttattacatatttgatttatatttgatatctccagagccaattggtggagaaattacaa

SEQ ID NO: 40254 - DNA, 1501 bp, Oryza sativa
attggcgaaattcttaatgggcgggcgatcgatcgatcgcctctcctcacgaggggcctgcttggcacagctccagctccaactccacccttcctggagctggagctcagccaaacagtttcagctccaccaaaaatgggagtgtagctgggtggagctctcacaaaatgaactagagttgtggagctgggtttaggcagctctacaactccacttcagacccaactcctggaactaaatttaggagttggagttgtaccaaacatgcacttggttttcttttttttcaccgtattacttttctattttagtaaatttatacacctaaagtttgtacgcatctaaagtttatacacctaaagtttagagacccaaagtttataagttaaaagtttatatgcctgattcaaatttgaatttgaattcaaatatgtttttttatatatattatttctatacatatataaagtttatgcacctaaagttcatagacacaaaatttataatcaaaagtttatatacccgattcaaatttgaatttgaattcaaatattttttatatatagtattttctatacataaagtttgtacatgcgaagtttacggtataaagtctgtacataagtacagagtctatgcacataaaataagagtattagattttttttctattttaattttttttctaactttgtttttttattttttaaaatttatggtgtagtagtaagagaagaagtggaggaggaagggggagaggagcgtgtaagagggatggggggtgatcgcccacagcgatcacatgcccattagggtccccccgatcattggtgctaagatatacgtgagattgatgtaaaagagaagggagatatggatttttatagaggtccagcccctaaactgacaagtaatacccttactccttattagctgaagtcggtgttgcttatatatagaaggggcgagaaagtacaatatttaggatgatctaatctactttatgcttgctcgaatatgaacttggcgagattggaggtcatcctagatccctcttgtcgacctctgtagctctgtatctagttcgtctaggcttgtcttagattatctagatctgtcttgacttgtctccgtctctcttcgcctcgggtgtccccttatctaagtagaattagggagtcaagtacggatattatccgagtagtccttacccggaacaccttctatatatgaggcttaattccgtataagatttagtatatgatgcctcgccgagtctaacacaaaagtattatatatgccttattcataacaccaataatatatatcctacatttctcattggttgtgtactacaaaatgataagaactaatattttggtgatattgttgttatataaaacatcacatatttttatgacttcatgttgtatacaggagattgttttatagagatacactccctctgattacaaatatatagcgttttggtgactgtatc

SEQ ID NO: 40255 - DNA, 198 bp, Oryza sativa
gctggcatgccataaaattcaagaaatgattttggtaatctggataataagagtgtgacattggccatgttggtgtatttaggctaagcactgatgaatcccctaatgatttttatcaaaatcattaagttaaggtagatacacatcttgtcatatgatcaaatggtttcgccaaaaatcaataatcagacaacaaaa

SEQ ID NO: 40256 - DNA, 1501 bp, Oryza sativa
gaggttttgggagccttgatgacacactattggcaagaactgagccatggtgactacggctgctatagtgatgagctaatgatagccaaccatcatacttgatatataatgtactaacataccaaaaaactgttcatctcttgccaacagatactacagtctcctacttggattttgcacagaaataagcagatttgtgaagaaagtttatcaacaagaataaaaaggaataatgcctatgcccttgtcaataggatggaattaagaaaaaggcttgatatatgtggaccaagctcaagcttggacaaatacaaatttgttatatgcttgagcacaatacatggaaggcatcacaatactgtaaatatggacagttgtgaacattttttaaaaaaaaagcatgattctttatgatggaatgaatgctggttgtggatcaatgaataagatcctctgaaaaggataagcagacatacctctgaaagataaccatcactatcagacagatcactgtttaattcacattcatcttccgggaactctaggccattaaccaaagctgcagcatcaccgttgttcctagaggaaaagaatttcgaatttatttagtaaattaaataaaagaaacactaatgaactattgtgcagtattatcatgattaatgaagttgtaaagttatgaagttgaattgaggttagtctattgcatcatttgagttgcaagcaaagttctggtcagtctcaatatctagtacaattcagaccagatcaattccatccaaaaaaacaaaccgacactatcaaatgtgtgaacctagcaaagcattgcaccctccccttctagttttcaccctattgtatgttggaaagcatcctgataagcctaccaaaataaacaaaaccgtaaggagaggtgaaagatgattacatgacgttatcgattgctcgctgcggcatctcgtcatcgccatcgccatcgcgctcgttcccgcgaccgctcccacctgaggaaaagaagagcatatgagctaccaacagaagagcccccgtggactggagccgtacggaaccaaaccacccggagaagagggaggagcaggagacgacgggggagcacgaacctctgcgagggcggcgggcgaactgcgagcgctgcttgcggttacgcttggcggcggactggaggtgcttgcgcgcgaacttgcgcgccttcttcccgagcttcttcgccatcccctcccctcttgcctcgctagggttagggtttcaggtgttctcctctctctctctcttcttcttcttcttcttcttcttcctcctcgagaagacggtagcgccggcgctccggcggagttgtggggtgagggttttggggttgaggacaagagaaacgtgggcttaaatgggccttctatggagcgcattttgtgggctgaggctgaacagctcgagtacattttcggacactttgaagtttttttccatcccatttttcacccta

SEQ ID NO: 40257 - DNA, 488 bp, Oryza sativa
gggaagaacaggacacagaacaagagctggccatcaaaaaccaagaaaacaaggctatcactgctcaatttccaatcttgcaacaccagagaaaaaggcaaagccaagcataaagatcaggtggacatgggcagcacaggagcacatcattctgaagtgtggaggaagcaaaggcagagacagacgagtccatgtagaggaggagaaggaaaggaaggccatgggaaccagggacaaagaggcatacatacatgttcttgaagcactcaaaagggagcacacaaaattcgctaaagatcaaccccagcttcgcaagaagaaaccacacaccctcatctttctcactctctctccactttggccccacaaaacctctcatccaaccacatcaattgcgagcattaaacaacacaaagagaaaggtgaaaacaaaagcaaagcaggaggaatgcaaatgcaaacctataagctcacatattaaaataaga

SEQ ID NO: 40258 - DNA, 158 bp, Oryza sativa
gggcgtcgatctctcttaagggggtgagggtgtaacatcccggcctagggtttaataggattaatagaatacttatatcaacaagttgcaacttcttttccgaaagccaatctccaaagaactccagggttaagcgtgcttggcctggtgcaatttgg

SEQ ID NO: 40259 - DNA, 1339 bp, Oryza sativa
ttggttttattcagtacattgcctgttcatatatttgctccaagattttggtcatctgtttcatcagggattctgaatgtttttttaaatttttttctgcaaggagaaccacgattctgaatattttagagtgagaattcgtctgtaagctcacgggtcgcgtttgtctaccatttgatttgtccgttgtagcaagataatttgacattaaattggaggcttggagctaagtccaagacttgtttttttcttttgggggcactatgagacaagagctgttacttattattacccataatcatcacctgagctttgtctttggcctgtagtttttacatcacaagattattattttttacttctgcctgattccttgcttatacagcagaagagtgtctagcatggtccatctgttctgaaatttagaatcctgcacttattttactgttaaatcttcagaactaaatcattcgtttcttctgtaacttgaagacagtaaagatgattctgtctgtactgttttaccctgaaaaaaagtgtgactttggaagtccaatgcagtacaacccctggtgtgtgttcatagcactagcctcacacactcacactccatactgtgtactgaactgaatttagtttagttgtcaagtccgttcacttactgcaagttgaaggtagtagggccaaggattaatattcctcactctcttgccttctcagccctcttttgggagaaaaagaatgctggtgctaccgaacaaatgtgtagtgtagcgtatttgcagtggggtatttcacctgcaaaggagcatctttctgtagccttgtagctttcactcccctttctttgtaaagatatttcaggtttccagataaatagatgcatctcatgctctgtttggttttcagtagcttgcagttgttgcctgtggcttctgagtggccagtttttgtggttgtattcaaccagtttcaacattcatgactgctgttgcacttcattagcttatgcctaagctcccttttgctgcatgatttgattgcatataatcattctgcattgtttctgcagcttctgaactttgggaaacttgtcagacagcagggttgattcaggtcatcttcttgcttggaatgtgctcatcaccaaatgtcgattcttgtacagtattaggtaatttctgcaatgttacatgactcaaatacctggtttcttcaagtcagaactgacctgttacattttccttctccaatgtttttccacatgttgaactcagaagttctgatccaagcatgacgggttcttgaaagttgaaactacacaaaggctttggagaca

SEQ ID NO: 40260 - DNA, 238 bp, Oryza sativa
  unsure (1)..(238): unsure at all n locations
gccgtcgcagtcgatggagacggagcaaccgccgccgggggtgcttgtcggggcgaaacggcccggcgacggggtagtacacgtggagcgcgtcgcgaagggcgncggcgaaatgttcnacgaggtgaagagtggcggcggtgngccgnaagagnaggcccttctggatgtagtcggcggcgaggagggacacgtcccaggtggtgagcgggatgcgctcccgcggccgtggccgcga

SEQ ID NO: 40261 - DNA, 253 bp, Oryza sativa
ctatagggcgaattcgagctcggtacccatatctcatcgtcgtcacgtcgtgtgagttgtgtttggacttaatttctatggtgtggtatataaatattgtcaaattcttttgagaattttttagaaccatttagataatttttaaacaagccagggacatctcctcaaggatcaaaatagttttccgagtaataactgaaataactgtcgctgtgacgtcaggtgaggtacaggagagcggcgaaggcgatga

SEQ ID NO: 40262 - DNA, 1166 bp, Oryza sativa
gcttcagcaccagtaattgaaaacataaaagtattaccgtaaaataattttttggtaaattttatgtaaattaacccgggtattatggttcttactgcgtagaaccacagtatcgcgtgcctgggcttaaggcaataccctaaatttaccttcgaagtatactttattatccgcactgctcacgtggtggctatcacgccgtaattcaaaaaactacggataattcacttatacctaattaccctactttgtgtctttttctccaactatgtgtttacgtatattcgttaggatttaaatttgaggcctctaactctagtatcatatattcatacgcaatcagctagtccaacccaaaaaaacaacttaatttgacaaggagatatggacaaattccaagaggtcgatcgatcgcctgagtaaacacatgggttaaaacccaaatttgccggacaattaactagaatcaaaatcacttgaaaaccatacaaatttaagacattgactttataatcacatgtatatgctattccctccatcctaaaatataacggattttgaataaataagacacatcttatctatctagatttgtaattctaagatgtgtcttatccatcaaattccttatgttttaagacgaatgtagtattatctagctaaatatggaagcccgagtcgagtcgataagcacacaaatggatagaattcgccgaacaattaaacaaagatcacttgaaaaagcacacaaatctactaccaaaacacaacataaaacagaacagaacaaaccaaaatgaattaccactagtaataataataactgataagtctattcttcataaaaaacaaattcaattttttttgttctgctcccacgtgaagtcgcgtccccccaacacttgtccagccaccaccacttgttctttccttcccctcctcttcctcctcctcctccgatccccatgcctcctccgcctccgcctccctcccccgccggccaccgctagctgccgccggcgccacccccgaggttcgtctcccccggatccgtgctcctcctccccctccgaatctccccgccccatttcacccacctgattttctttacagcggttgcgcctagggttcttgattttgagcttcggagcgaggcgaggcggaga

SEQ ID NO: 40263 - DNA, 1501 bp, Oryza sativa
cggattcgctcggaatctttcccctaaacctcgccggcatcaatggcggccgcatctttcgcggccgtttcccccttcgcccggccgccctctctccctcccgacgctataaaaacgttccccgagctccgctcttccgtttccgccgctcgccgctcgctctcgccgtcggaatcgtgctcgcgccgtgctccgctctctccgccatcgccgccgagctccgttccgccgccgtcgccgctccggacttcctccttactcggcgacacctccgtccgcttcgccgagtggttgccgaccccgtccgccgctccgcttcgcccgccgaccgccggagcaccgtcgtcatcgtcatcccgaaccgcgccgccgtcttcctccgctccggccgccgctctcgtcgtcgtcgttgtcccggggtgagccgaagaccgccgttcgttttcccccttccctcctctctctcgggtgccactccgccgcgccgttggtcgccggcggcgaccatcggagcgcgggtgcgcgccgctcccgtcggccgcgccagcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgccgctccctcggctgacgcaataaatgggatttttaattaaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcgtttgggaaagcgagcaaggcaagtcacatcatccttgagcatattgaatcccagtttataaaattaatttgatttaaattaatgcattatcgctttatttaaattcccgcgttatcactgttttatttagccatgcctatttacctttgttaggaccatactattattgttattgttattattaccttgttcaccctagaataaacaaaaccccaactagtggacactctatttatggttccactagtatgaatttaggtagatgcttcgccgattaataggacaacattaggtggttttataattttagactttgggaatattcatatcacctggacactatgaattgttggtttatggtggaattggacatacacctctcttcctctttcaaaacccctaaaacctattttcggtggggtttgggtgcatgccagttgtgggaagtagcaccccggccactataaggattaa

SEQ ID NO: 40264 - DNA, 1501 bp, Oryza sativa
tgctgctaatcgcgtatgggcgataagattatacaggttcgggccgctatcgagcgtaataccctactcctgtgtgtgagattatggtcgagtgttacaagggttccaaaactccggagagcactctcgctcttctttccctagagttcaggcctactgagtggcgttccccttcccggtggacaaggtcctccttttatagttcaaggggataccacatgcaccgcttctacctactctttctacgggagggggacccactctaccttgaccggaccgcgattcgtgccttcgcccggaagctaaaaagcggtccgcccttcagtgtcacccggtgccgccccccacctgacacgggggacagccctgtcactcactcttaaatgggcggagacttgtggctgccctccttacggggagagaactccggatgatgctccgatgtgacaggacatacctacctccactccgccggatacagaggcgacgtgggggcacggccgcctgtccagtcagatgtgaccgacgacaggccggtcacagactggtcagacccgactgacgtgcatcagtcgggcggcaccgcatgtctgcccttaccgcattaaatgcggtgaggggcagttggggcgccgcgcgcattgatagcggcttggcttgggtctcctccccgctcgctccccccgccacatggcagttgggcgagggcctcagggcgagtcagcgcgggggcccgaggggcgtgatgtggcaccccgaggccccctggctgcccctgcgtctcccgaggcgcggggggagggccaaactgtagagtcacgtggctggatgggaaggtaacttcccctcactttgcatacccccgggcccatatctccgacagtagcccccggcaccacgtcggacattggtcccctgagggcagtctgacgtggcgcctcacgacttaccgtgccgaggttgtgggcccgacgaggactccagacggttgccggcggcaaccaggatggcacattagccaaaatggcgatttgaccgccactgaccacgctgatgatgggggcacttagggcgcgaaaatcgggggtttggtcagaccatgcccagaatcgctatttacgccgcctcgactcccccgcctgtcaagcatgcgatgggaccaatggcgggcccgcctaaccgtgcctgtgagcatcgcacgccccacgccgagtgtgccgctgacaagcgcactaaacgcgggacgcgggctccgcggggcaacgtgatgagtgggcgcgagatttgaggaggcaaccgcaggcgcaggaatcgagggggcaaccgtaggggtgtgaaacgaggaggcgagtgcgggcgaggggtggataaaaggaaggggaggcggagagttcgtcccctttctctcgccaactgcatactcgcatactcgctcctaaagccctagcgctcctctcgctccaccctgctccatacaccaagctcctcgccgttttcccgc

SEQ ID NO: 40265 - DNA, 1501 bp, Oryza sativa
tccaaatgccgccacctcacagttggggattggaattcggaatttggaaaggagaggggaaagtgaaaagaaaaatttaaaaaaagagtaaatttcactttgggtcaccttttattaccagtatttcactttgggttacccttcaactaacgttttcacattagactgggtaatcttacatttgtttcactttggaccaccccgattctcttctcaagcatatgaacgacctcgagtacgccagctcctatttgtcaataaacctccttagctgtatttagaccgtttctttaacatatgacaaattagatgtagatgaataagagagttgagggtagtccaaagtgacacaatggtaaacatacccgatccaaattgaaaacatttgttgaagggtggtccaaagcgaaacaccggtgtcggagatatgggcccgggggtatgcaaagtgaggggaagttaccttcccatccagccacgtgactctacagtctagccctccccccacgcctcgggagacgcaggggcagccagggggcctcggggtgccatgttacgccccttaggcccccgcgttgacttgccccgaggccctcgcccgaccgccatgtggcggggggagcgagcggggaggagacccaagccaagccgctaccaatgcgcgcggtgccccaactgcccctcatcgcatttaatgcggtaagggcagacaaacggtgccgcccgactgatgcacgtcagtcgggtctgaccagtctgtgaccggcctatcgtcggtcacgtctgactggacaggcggccgtacccccacgtcgcctctgtatccggcggagtggaggtaggtatgtcctgtcacatcggagcgtcatccggagttctctccacgtaaggagagcagccacaagtctccgcccatttaagagcgagtgacagggctgtcccccatgtcaggtggggggtggcgccgggtgacactgaagggcggaccgctttttagcttccgggcgaaggcacgaatcacggtccggtcaaggtagagtgggtccccctcccgtagaaagagcaggtagaagcggtgcatgtggtatccccttgaactataaaagtaggaccttgtccaccgggaaggggaacgccactcagtaggcctgaactctagggaaagaagagcgagagtgctctccggagtttaggaacccttgtaacactcgaccataatctcacacacaagagtagggtattacgctcgatagcggcccgaacctgtataatcttgttgcccatacgcgattagcagcattcagggtggatacgcaatctcgaaaagcgagccttttcccccggccgaactcacaaaagggggatctcacgatctcccgctagagaggatcactcctcgatagctggcgtgccaggtagggggatttcgcgcgctttgaagacaagtcgttttcttctgccccaagttttcctccgccttcgacgatcatggtcgaggtat

SEQ ID NO: 40266 - DNA, 1501 bp, Oryza sativa
gctgagctcgcatgtttttgttcctattggtaacagcaattttcatagcttctgaatttctgtcagatatagtcatccacgaattcttgacgacacgaaacatccctatattaatcagtgttctctcacctaatttcatcgcaacctttttaatgctcaattgaataatcctgatcccataaggcaactggaaggcctcaccatcttacatctgaattttttaaaagttaatcaaacattcaatagtaggctggtgcacattgaactacattacaaattatccctaaattggttcttcttttatctatttcccatttacctatcccggacaccatagaggatcatcacaaatatcctttctggtccataaaagagagttgagacaggctctgaaaatggaacaggtgagtgcacgtttgtaatctgtagggctgttggaaactctacacacagtgaactgcctagctagtcagcatgggaagcattgggagtagcacagttgcttgtctttgttggtccaggactccatgaggaatgagctattgagataatagtacatgatggtaacaattagccaggcagatggaatttcctgtctttacaaacccactggacactgttttttgggttgtttccgtgttaccaattatcatgaattcacttttctatatatgttctaattgttaatcattgttggtctgttgctgccacagagaacggaattttgctttatctatatgctgctgtgatttcagtgattgtcactatggcaatttctaaaaactgaatgcagaaatctactcaaatttcattggttgtgttcagagctagctactgcccaatttcgtccccgtctgattgaaatagccctttatgcacacaagggcctcaccattgactcgctggtcttaaatgattaactgcatgctccgatgctcgtctgaactctgaacctagctgatgaacagcattttttctgatggtgccattatcgacaggaaaatttactgacagttacacgtccagcgtcaagtttcacagatcgatctgacaccagtttatattttctgtgcaaggcaatagctgtcggaaatattttttctatcagtataccgctagataatgaatttttccatcatcttttttctgacctataattctgttgctccactggtagaaatataatttttgacagccctttttacaggagcagcaacacagtaaggaaaaaaaagacaactttaggctaaaaactttaggaagctacatttgagcaagcacttcttcccttgttctgaacaggctaataaacatgttgaccacatcttccactgtctcattgtaaacgttgttgaaaactctttatcatttcgctgcagccaaatgcaccatgatgtgtatatgatgacaccatcaaatatccttcgatgttcctttactagctttctcctgcaggtttcccaccaatgtaggatatcaccccccgaaatatagatggcca

SEQ ID NO: 40267 - DNA, 1501 bp, Oryza sativa
caatggagaagatgtcctagttaattgtatgcatgcatgcatgccttatattatggaacatcaaagaaaagtagttgtgccttatattatggaacagagggagtaccaagtacatatgaatccactgttccaagcttactgtcactaccagaaagaatgacgttttggttttatgtatgtgctgctgtgatttaattgattatcactactgcagttttctagaaaccaaaatgcagaaatctacataatttttttttgggttatgtacacaaaggcctcaccattcactcactggtccttatatgcacataaaggcctcgtttggcttataaaagaggaaccaagagctatgagctgaaaagggacagagtcgtccataatgagtgttagttcacaacttcgcatagaagtgaaactggctccagtgtcttgtgaactgtcgcttgcccatggtagctaggcctaggaggcaccgggagctttcctaatatgtgtggatgctgagacagtgggtcgtgttttcggtagagcattgaggggggcagaacaccagcatcatactcttacctgataaagatgcatgggaattgtctgtaggacaaagcgatatgatgtataatcatgaggcccaaggatgagaccttgttgagccattgattggaaaagaggattttccgtaatcatggacatgattcatattcatgaactggagcttggtagttctcttagtacatagctaagcgagcataaatttgaactagcatttcgctctcatcctaatggttcattttgttgtgtgtacaggaatgtaaataccaaagtggatatatagttttgaatcgctaaatacaacgttcgttaaacttgcatatacttcaaaactaaagaaacggactatctctgatgtacatcttacgtctgaatcttggcgatttatactaaactggtccctgactttctcctggtggtgtgacaaacactccatttggttgcctaatcttggagatatatatttgaaattgcagccaaattttacttcccttgtttcaaccataaattgaaatgaactgatcagctgattattaaatcatagctttaatcgaatggtgagctacatacaactctaagcagtgacaattgcacaatggatcggcacatacatactgaataattaattacatcgaatcaaatattatatcctaacaagatattgccagaatataggcctaggatgctcagcagtgctggccttctggaaaaggtcatcttgtcgcaagcatgtactggattacgcagagagctggcagttgatttgtgtcatgaactgaaagcacaccagctcgatgtgtaatacagccggtttcaaagaattgtagtgtttaactcgtatatctggtaactaatgagaatttcctcaatggattaatgcatctgggtgaatttctgaattttcttaactgcacacacacgtaacagtctgtactctgttcctgaaagacag

SEQ ID NO: 40268 - DNA, 1485 bp, Oryza sativa
tccatccaaaatctcttatattatgagacggaaggagtatattacttttatataataaaatttaaggaagtatccttttcgtttcaaaataaataaatttagtatagagatatgacatatcccagtattacgaatatgaatatgagagaatattttaatttgaaatgaagagagtagaaaaagaacgtgccaatttgccgtagtacacaaggtgataattaggtagtagcacaagagatagctgggaaaataaactataaagactcgataaatgggaaataaagtattcttgataataaaatcccttatatatattattattgtgagacaagttagaagggtaaatcttatatcatacttcctccgtctaaaaaaactcaacttatggagtttaaattttgtgccaaaaaaaccaacttctaccactctatctacccttaggctgtgttcgataccatgagttgggaacccaactcctccacacggaaaacagagcggtccattagcacgtgattaattaagtattagctatttttttaaaaaaatagatcaatatgatttttttaagtaactttcatatagaaactttttataaaaaatacaccgtttagccgtttaaaaaagcgtgcgcgtggaatacgagggagaggggttgggaaccccctcatctgaactcaggcttagcacataaaataagaaagttttatcccttaaatacactttacctatctatcaccattacaacttttttttcaataatgagggatattttagtcttttttactctccactagttttaccttgggatactaggaatactcttgtgggacggatggagtagaacggagggactaataatttagagagctagctagtgtaattacgtcgtgtttagttgcaaaataattcttcaaacttccaactttaccatcacatcaaaactttcctacacacacaaacttctaacttttccgtcacatcgtttcaatttcaaccaaactttcgattttgttgtgaactaaagacagccttaaccgagtacccacctgctacaaagaacgatcaatgcatgcggcagtgtaacacatctaaattaaaggaagggtgttgcagatcataattaatactccacgtaggatgatgtgttcagcaaataaaatgggttgtcaattacttaaaaaaacaaaataactgggatacaaaaatgacttggacggtatccgtaagtgaggaacaggagagagtcgtaggagggttgttaataataagatgggaagaaatttaaatatgtgactatatgagggtggttagagggggaagataataccatagaattgtatttttaagctaaaatgtggttttcaaaaaaaaagctaaaatgtaaatggtataattgtcctttttaaagacagggagtaagctaggcttatgaaattgtggtaagagatttaatgaaaaaagagagtgaaagggagtgtcgaaaca

SEQ ID NO: 40269 - DNA, 896 bp, Oryza sativa
acatatgctaaaaaatcaacggtgtcaaacattttgaaacggagggagtataatagtttgtttaatgataaatctagaaacatcaattttacatgattgatcttttttattttttattatcaataggcaaaatttaaaatgtttgatttgatactattctaaaaatatttatattttaggatatagtgtctgtatgtttccaagttgcctcctgtaaatattttcttcatccattccatattataagtaattttaattcttttatcaatcaaatattttagtttaatcaaatttatagaaaaatattttaatattttaaatacaaaacaaatatattattaagatatatttaatcttacatctaacaaaattaatttagtattatatgttgttatttttttaaagttaattaaaactaaaaagttttaagtagcaaatagtaaaagcgatttataatatgaaacaaaaacagaggcagcataccatactgtctatacagctaacttttgtaccaacctatattcctttaacttttgtaccgtttataaacgctacttctccaaatatgctagtactaattgatagtacatctcgtctcgatcacactctcttataagctcgtgtagatattactccctgtggagattatgggtaccccatacccacacagcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggca

SEQ ID NO: 40270 - DNA, 1501 bp, Oryza sativa
gcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcataataggccagccgtgcaggcggaaacaccagtcggcgaaggtcagccggtcggtgaagacgtggacgcccatgaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacgtaggcaggccggtggtgaagtagtagaggcccaacagcggcggcataataagccagccgtgcaggcagaaacaccagtcggcggcggcgaaggccagccggtcggtgaagacatggacgcccatgaacggtggtgtgaccgaccaaccgtataggcgatgacaccagtcggcggcgacggaggcaggccggcagtgtagatgacgatgcccatcaacggtggtgtgaccaaccgaccgtataggctgggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcatagacgcccaacagcggcggcataataggccagccgtgtaggcgaaggcaccaatcggcggcgacggaggcaggccggtggtgaagacgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggagacaccagtcggcggcgacggaggcaggccggcggtgaagtcgtagacgcccaacagcggcggcataataggccagccgtgtaggcggagacaccaatcggcggcgacggaggcaggccggtggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaaca

SEQ ID NO: 40271 - DNA, 1501 bp, Oryza sativa
cccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatatttttaaatttttataaatactagaaaaaatgttcgtgctgaagtatattttaattgggtgaagtatattttaattttattattgttatatggattagttaagatgaaatttattgtgggagttcgcttggatatatatttttttagaaaatcatgagctgtggttaggagttcgagatcgtctcaaggtagtatgcgagttttttaaacagacttcttatatgattccttctgtattacaaaaataaataattttaaaaaccgactcaaatatatatatatatgtatttactccatcgtcacttaaagatttgggagggagaccggttgagctgacatgtccacgatggcagaatctcccaagattccacgtggaaccctaaccttccctttccaaaaagaaaacgagagcccttttcctattgacgcacgtgagcgcaccgcttaagccacgctacccacgctacgcctctctatacctaacgctttccccgaactccaagagatcaaaaaaaaaaaatctcaaacggcaaagtcaaaaaaatactactactccgacacgaaaaacaaacagaaaatcgggggaaaaaaatctctg

SEQ ID NO: 40272 - DNA, 1501 bp, Oryza sativa
ccgatgccgctgctgcgagagggtgacaccggccaatgcaacagcggcagcagcagcagaagaggcaggcaaatcataaggcttgcccccacgcagctgcgtgccagtcaaacggagccagtcaaaactccaccgttctcttcccccacactgtgtttcagccccacacaaacccatccatccagcaccgtacgtgtacttgtccagcaagggtagcggcggtgacagtatatgacattattgtaccatggggagagagataattggctgtgtttagtacacgctgaagtttgaaagtttggttaaaattggtacgatgtgatagaaaagttgtgtgtgtatgaaagatttgatgtgatggaaagttgaaaggttagaaaaaaaaaaacttggttaaaagtttggaaaaaaaactttgaaactaaacagggtagtaatatataggttaggccactgggatgcatcatgggttaaaaaccttgaatgctgcgctggaacgagaattccgtggtagtactgaactttaattttagtcggtagattgtctgtgagagcatggaacatattgtgaattatggatgatagaaaaaactgaattttgtaaccattataggagaaaacaatcaaacgagttaagtattagtagaaagttaataacttggtttagaaaggaataacttatgacaagaaaattttatggacaaattagcatgagatctaacgtcatggaaaatctctgcaatttttcttgcaatctatccaaactgtcgttcgtgtaaaaacataaaattgcttgaaaatccatgttttacatttctatttttcttttaaaattttacatttttcatattaatgtgttttctcattcttgcatttttcttgtgttttatatatatggtcatttctcaaatgtttgaaaatcctcttttatatctgtcctaaatcgtgcgctaccttttactacattttcttaatcctacattaaaaaggtggtcttataattaaggaaattcatgaaaactgaactggttcctattaaattatttttttaaaaaaattactttgataaaaagagctgtagcattcttaccttttgcgtccaactacagtctacagtcagtcccggagacatttaaccgacatccgatatataatgatggttcacgtccagacaaagtcaacagtcaacatggcatgcaaagcaactgttcacgctcctcgatcagacaagataaaactgtgcccgtacggacatggctggtatggcagtagctctgatcaccaagagtactccctcggcacaattaactggagcctgcctgaacgaaacagaactcaagagtaccaaccaaaaccatcacacccttgtcttttcccaaaaagtaagatgcaggtaagcgcaaggattaccacgggcaccatggttattagtggactttctcttccagcatttgacaaagatccaaaggtaagaagaacaagattttatcagcatctgttc

SEQ ID NO: 40273 - DNA, 1501 bp, Oryza sativa
ctgatttggttgtagaaaacatttcgatgctggaagaagcagtggcaagggagacctgaatagtggccaggaagacatgaacaggactccggagagcacatgcacaatttttctgctcaggttctgagattaattatgaaaagaatcagaagttaacaagatataattaagaaaggtataaattttatgcttgaataatctattttcctttgattgatcaataaagaaagacttctcttttatctatcctaactactgtattttttgaacagtagcagtccatctgaaccagtcagatcttcccagcaattgaaaataaattcaagatacagatcacatccactgaattgtatataccatattttactctccggataacagtcaacagagctaaagaattgatattttttgaagaatggcggagatcaaagcttcagctccacctcaaaaaaaaaagaaatacaaaaaaaaaggaaaaacgagatccgacacctgttcgatgagccgccgcgccgtgagcccgtcgaaggcgcgcaccagggagtacgcgcccgcggtgatgagcagcgtggcggcgcagtcccgcagcgccgcgggcgtcgccgaggccgcgagcgccgccacggccggggcggcggcggcgcccacgccgagcacaagccttcgccgcatggagctcgccgccgccgccgcaggagacgcgagcctggacttggagcgcgacagcagcaaggaggaggaggcggcgaccgaggaggagcacgggaagtggcggacgacgtcgacgggccgcgccgccgcggccattcggtagacggactgcagtgaagcgaaatcgctggtaggccaccgcgaatttttgtcggggcgcgcgcgggtttctcgttgagacggggcacttttgtagttttgtggaagcgattcgtcccacctatccacggtactgtgtactactgtatctttttccgaaaataggagggctcgtccaaccctcctagagtgtacgtaatatctttgttggaaataggattctcctgatatttatattttggaaactcatgctagcaggggtgtgtttagttcctgaaaaaaaataaaagttcaaagaaagttgagagtttagaaaaaaagtttgaagtttatatgtgtagaaaagtttttttttgatgtgatatgatgtgatggaaaattgggaataggaaggaaactaaacatggcagttttattccacaccatgaaacagagtaccaatgcaattagttgcgctgaaactatcgttcaaagcacaagcataacatgcactggatgatctctcgcgctttgctgcagaatatatacgttagatattgaagaaacgatgaaatgatttgaactgaaatattatgaaaatgattgaaggatgatggtttagcatgtatatatttagttttataatgaaataattgtaaatataattactatatgtttatatgttataagttttgcgtgtttaatgagtaga

SEQ ID NO: 40274 - DNA, 1501 bp, Oryza sativa
attacaatgtttaattatggtggtgatttttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggtgatttttaaaaatcgccctcccagagggcggtaggcgaccacttctgtcaattttcaaaatgaaaaattatttttgtaaaacttttaataaaaaaaattaaaaataaaaaaaattcgcgcttctgggtactacaccggtcagggtgttgggctggactatttgcatgggctacattggaggcccaatttggccgaaaagaaagtggagcttgtctcaactcttgtccaaacagatttcagatgtgcactcaccagtctcattgtcagagcttgtctcaactctttcatggaccagaaaggatagtagtgatgatcctctagggtgtccaatagggaagatacaagagcaatagggaaaagaagaaacatttcagggataacagtaattcaatgtgcacctaccattgagtgtttaattattttttttgtaaaaaaaatcagttgtaagatggtttttcagtgccttctagattcaggatcattcgagtgagcattaaaagatggagatgaaattatatattcaagagaataaaataaagggatgagctcccatgtttgtttgtttttttactggcaacagctattttcatagcttgtgaatttccatttaatagtcatccacgaattcttgatgacatgaactgtccttatatccaaatcaatgttattcagtaaaaaaaacaaacaaacatgggagctcatctctcaaaacatgcaatatattgaaaccctatccaaattagacacgccctaagctagtaaattgaatctgccacctagtaagctaaaaatgggactacgaggaaaacgatttttgtggacgaggcccttccatttttccaggtggataagtttttttg

SEQ ID NO: 40275 - DNA, 1501 bp, Oryza sativa
cgaagaactcttaaagtagatgacaactttattacttctctctgtgtttacaaagtgcaacaataacactcctcacgaaaatctcgactaaactcgaaaccctaactaaactcacagctcaatgctctcaaaagtgataccgagaagcctcacgctccctctctatttatacatgaggtaggcagcctaaagccacgaaccaaaatcatactagaagtcctaatccacctaggaaaccttctcatacaagaaacaaactttacaaactccaatcataccaaatttggactccttccaaatttgacttcgcatcccatacgcacacaatacctccatcgtatgccatatggaatcttcaccaaccatgtgcattgaactttagcctaagtatcccgcatgatatctgaccatcatggacatcgtcttatcaccaagctgactcccgatccatcaccggcaatactctcccgaggcatcaagtcacctacacatgaatcaaacaaagaaaccatattccgagaccaagctatctccaacttgactcattagtagcaaacaacagtattacatacgcatagtatccatctagaagccataaatatgaaatccaaataaacaactcgaaaccgaaaccgacacaaagtcggctggtcagaccgcgcaatacaagccagtctgaccggcagcacatgcccggtctgaccagaccacatattcagcagttcctgtatatcacatgtaaatcctatcatctccaaaaccacttcgccaataatcttcaaatattaaaaccaataatcacagatgccaattgttcatgatagaataataataaaaaacactttgattttgcacaaatccctttatctgctagaccaaattaaactgaattccaacaattattcacatgtgaactttaccacaatgatctacttcgtgcattcgtcacttccgcagacacaaggagcttcaccgcagcaccatgagttcttcgagttgtacggtggaacagtagtggtctttgtgaattcatcacatggctgccactgtcccaaccccttggaccataaaccactctacatggagcatcgacatcggttatcagtcaatctgcttttataaacaagaggatttgcatggctgcaccgcagagagaatactagctccaacattccctttctgaatgagaactgttcataattctgatgaaccgctatgctcaagcatttgtcctctacctcttgctcgcagatcctgtacgcaggatgcaatataacagttatttgcgcaattttagtttaagcatgtagaacggtgaaccaactatcgacaagctaggtaaaagtaattaatagtgactatgtaggaacttactgaacatgattcttgtggcatggcaactcctgatgcatcctattctgaccaaagcaacaagaaatgtccatctatcatctcttagcttgagcatcgctgcagctccttcatcgacagtctactcttc

SEQ ID NO: 40276 - DNA, 1501 bp, Oryza sativa
ccggtcacagtttttttatgtatatctcttctttccagaaaacttgctctcactgacaagtgggacaagccactacaccctccttctgggcccacctgtaagtgacccattcgagaatatttacgcgagggatctggtacgcctaacgataataccccaacggctacagttcccattcgtgattccacaaaagacagccagattcggagattcccctcgggaccacgtgccgaggcggcccatccggcccggtccggacgcatccgcgccgtccaaccgaattcacccccgcatccggccgtccactcgccgacggctgagatgcgtcccccgcctcgcttgatccgtttcgtaggccgacactttgcccgccaaatggcacgccaccgtaattaaccccgaactccgggggccaaatatctacaaaaacaaagggtatgggcgtgaagcctagaggtaggggggctactcgtagcctccgttttaagtacaaagactccgaaccaaaactccacgcgatttgtttagatcaaacgggttcgtaaaaaaaaagttttattctcgggttcgttgggttttatctatataggcggcgagcgagaccatctcattcagttttattccgcgcgcctcctaaatcgcgcttaatccggcgcatcctgattcagagagtggtttggattcgttggattcgaggtgaacgaacagggcgtggaattttcgaggactctctcctctcgcagaatcccgcgcgcctcctgattcggagagcggtttggatttggattcgaggcgaggaattttcgaggactttggcagcggcggcgggggctggtgagcttctgctgcggcttggagtctgcccccaccattgcgtggggaggtggaggtggaggcggtggtggcggcgggggcggcggaggacgatccttccgcggcttcggtggcaggtgagttcgccgggttgggttcggatttcgtctggatttgtgggggactcagttatgggtggtggttgcttgcggtggttgtggtggcttggtcgtgttgaggtgtggggtctccttcctggtcatctcccagggcctctcgatcggatcctcctcgggagtcgggaatgcgaagctgagtgtgacgcgtgcacgactctcgagggaggaattcccttggtgatcgtgctggagttcgtgggattcgtcgagcttttcgatcctctgctgaaaaaaaaaagtcgttctctgtcagttactcgtttcgtttcaattgggtgagatttttttcctggctcgatttgtgcaggtttgatccaaattgagcgccctgaggatttggggcgtgtttatggaggattagatcgagaattttggttgtttctgtgagatggccgccgattccagcatgggattccatcaggggatcacggcctcgatgtacaaccatcacatgctctccttccaatctaacagcgacttgggcggtggcgccggcgctgcggccggta

SEQ ID NO: 40277 - DNA, 1501 bp, Oryza sativa
taaaatcaaaataaagtatctaaccaaaaataaagagaagacacgttataaagccaccaacataaagggagaaatacaatttattcaacccctgttagtaaatttttgtttaaagttggcgaaaatttagtaaacctttgtgagtatcgatttacgcaggggcggatcctgttgtgcgagatcacccatgtcactgacagatgaattatttgatccctccttgaggacagttactttgcagccaagaagtattctgcacctacctttcatgtaatgttagtatatctctccattgagaggagagatcccagttgatcagcacacgagggtaaaatattaaatctgatgaaaattctgaatatccctaaagaaaaactatgcaggaaagctatcatcacgtcacgtaaaaactgcaccgaatttatcacaccaagttagggatttgatcctaccgaaagtacgtacaccgaccaaatttaataacataagtgtgacaacatatatacacaaaaatcatcaaaaggtgccttcacactgattttggcttctacgcctccaagacggaactgatgaggatatatcttactaaaccttgagttcatgaagcatattgatgttctacattacaccaaattatcttcgaccttccgataaatgtagtttgttgatgctttgtttctaattctgctttttccctttttcttttgggtaataactgattttgtcatttccgcaactcggcattaataagatttgatcgtccaaatccttcaactgacccggcatttttagaacatagttgtgcctcccaagcattcaattgcaggcatgatatgaggctgcaccaaggaaccttctgaatgtgtccaacatttgtattttggcagtgaaatgtctccaattccaatggactaatgtgctcaaacatttcgctgactctaggattttgcaagaactgcaatatgtacgcgtgcaaatttatagttagttactgtaggacggcattcatcaaatcgatctaatttgagcttgtaagctatttttttgactgaaagaaaagagagataatgaggcaagaacttacagtagtgtcacgttgtagggtgagcagggttcactttctcgccggtaaccgcgcggtaaccgcggttaccgggcttaccgtggggggtcggtaacgaaaaccggcggtagggtttgggcaaattttgctcaaattcaaaaatttgaaaaataatcgaaaaaaatcaaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcactgttcacgaggcccaataaggcccacaatgggaggaaaatatctttggaagcctctgcttcgtttctctggcgaatcctaccgtttttcccctctctcgc

SEQ ID NO: 40278 - DNA, 1501 bp, Oryza sativa
ttgccttttacacactccgacttactacctccgttttaattataaaactttataacattaccaatattcatatatatattaatgtattaagattcattaatatctatacaaatgtgtaatactataaagttttataacttaaaacggaggaagtaatcacaaatgcagttaagtgactcacgtataaatctgaggataccattcctatatactcatctctctaccagtttcattggtcacactcctgttacttgcaattttttaggagcagagattttccaatcaaagtaaaaagggtctgaagaataaacaaagtcccgaagatatgagcttggagtatcttatattcttatcgagcatatccacaactagttgtccaaaaaatacaaaaacaacacagggtgtaatgctcggtagcaaccaagcagaaaacgactgaatcaatattcaaaacaacttaattgagagaaagaaaaagttgattgccgagactaaacttgttggactcttcctgagtactagtaccactggtttttaagtcgtcctagtatcatttatccctaaacagcttaaaaaccgtacaattattgttgcaaaacgtttgatttattcatcttaaaagaaaacgtttgatttaggcctttagatctttgccaaaatttttacacactgacacatcgaacgtttaaatatctacatgaagtattaaatataatctaaaaaactaattgtacagattacgactaatttgcaagacaattcttttaaacctaactgctccattaatgtagtactacagtaaatatttgctaatgatgaattaattaggcttaataattcatctcgcagtttactgacggagtctgtaattagtcttttattagtgcccgaacactcagtgagaaactctatataatatgcgatatgacacgtcaaacctttatagcctgatctaaagttctaaacactccctttctactacgccctgtttgaatccggagggctattaaatagccctccggaatcttgctatttaagagtattaaatgtagattaccgacaaaacccattccataactcctaagctattttgcgagacaaatttaacgaggtatattaatccatgatttgctacagtgatgctacagtaatcaaccgctaactatggattaatatatattattagattcgtctcgcaaaataacctagagattatagaatcggttttatcaataatctatatttaataatcctaaatagcaagatttcatagagctatttaatagcgcgagcatacaaaggcctgttctgcatgcctgctgtcgtgtacttctactgcattttttccctcggaaaggaaaaaaaaacgtactccctgttggctccagccagaagcagccacgcgtcggatggcgtagcggcaagcgaggcacccggccacacggagggccacacggctcgggtcaactcaggcaccctcctttgcacgggccccacgagc

SEQ ID NO: 40279 - DNA, 1501 bp, Oryza sativa
agttactacataggacattctcatctagctaggagaaatccgagattatgccatttgttaaaagtgcgtttcacctcaacgccacttggcaaaagggattcgataaaataccattcgttttacctcaatgccactcggcaaaatgaattcgataaaataccattctcaacctgtgaacagcacgctataatactatctgagaccaaattgtcatccgctcttcctcgtccttcaatattccttccaacgcgtggcaatgctatcgcgtcccagatcgacatggcgtataacctaagcacttacattgcatatgccataatgctgcatcgtataacctttcgaatgagaccaaccttcgtatttcgcctgtgaattgtctacaatggcaatggcacaatgtgctcagaaatttcgcaggcgcgcttggatttggcaggaactgcaatacacaagcaatgtatggttggttactataggacatatattcatctatagttgatctaattcgagcatgtaattagccatcttttggactgaaattaaccaaggagagatgatgacgcgagaacttactccactgttactctgtggggtgagaactcctgatgcctcgtatgccaaccaaattgaagcaagaaatgtactatgaaacaagaaatgctcatctcctatctagatttgaacatttctgttccttcacatgcttttcaatgtatgaactatcaggaccaaggcaacaagggctgtatatatatttgacttgatgaccattttgtaatgttatttcttattcattgtagaacctacctctctatctttatgtcgtgaattattggttttttttagaacatgtcgtgagttattggaggtgtaatatgttcacctcacttggaaggtttgacaaggaaactaaaagttctcatccatcctagcactctagcagggccgtccttaggggtgtgcggccagcgcgcccgcacagggcccccaattttcagggtccccctaagcccaaaacttcaaaactagatatacaactcaataagtaaattggtagcctaactagtctagaaatatgttatttttcttgttgtttcggcttcgattacacgcctttgccggttcgcacagttgcgccggttcgcaatcttgaatcgcctcccactgtggatctcgccaatcgccaatcgcaacgaacaagaggagtaaacgacgcctcacctctttctctcgtacgatcgtgccgcctgacgcctgctgcgcctctgacctaattctttctggtaatttctaatccggtaatccctaatattggattatcattttaggccattctagattgctatgaaatatattacggagaataaattattttcatattatatcattaattaagtttttatccttcaactttccacagggcacccgaatttgacgggacggaggccagtccacacctcgcctcacccctaaacacctaaatcctaatccatccattcca

SEQ ID NO: 40280 - DNA, 1501 bp, Oryza sativa
gatccaccgaacgcgtcgcatcgtcggtgcatcgccgatgatcccaaccagcatgagtattacatcgatgggagcactaagaacaagtctttggtgctgagatacctggtgggttccaatggcaggctgttgatggtgaggaggtggatgaactgtcggcagcagtattacgcgggtgacatggacaagacgcggggattcgaggtctttgcggcggtaatctctgatggccatggccagtgggtgaaggtggacagcttgggtgaccaggcaatcttccttagttcagagtgctccaagtctgtcactgctagccaatgtgcagatggaattcagcaagattgtatctacttcatgcataggatctacgacaatccgacgaaagagtgccacggcccatgtgttgatcctcttggtgactctggcgtgtacaacatgagagatgggacaatcaaccttttgcggcccagggcggtgatgtctgagctgcgctggaaacgccagtatctgacttggttcttcccttctgatgagtaatggtaactcctttctaagctgaacatgttgctctggtctggaatattggtatggtcgatatgtagccaactatgcagatgttaaaatccttttcatggatgaacgaatgttgaaagctgtgcaaaatttagaatcactgtgatggctataaattttccttgcaagctatgaaaaatatattgccttcaagcggttaggttaatagttggtgtgcaagaaatggctaaaatttgatgcattgaacattcatcagtcctgaatgaaaatttaagtatgtcttcatctgaaggaaaatgcattgaatgtcctgctgaaatactgatatttagatggcttaacagccctaggaggatcgatctgcatctgtccatgtgttttacattgcctaaaacatttttcttcccgcaataagtgcaacgatgaaaaacatgatcaaaaaaatcatagcgctgtactttcactcccgtagtttcttctgaactattgttcaactggaagcatcatatgctgtaaatagtccagctggaaggcttcaatggaccaaaagggaatgcatatctgcaaataatatctttaccactatacgattccatgcaatcactagtccagaaaatacatgcagtactgttcaattgaaattgagtattattgtcgtcaaattatattgaaaaaccttgatcggcaaaccaaattccagaaaggattttcaaacatcattttagcccctaggcaaaattactgatctcccttaaccaaaaatccttcttatttttcttttctaaataagttcagagctctattggctagacacctctaaaagaggacttctagatgctgatgtccatgcggacatagcagaatgagctgaagccctagcgcccgctaagtccagtacttctgccaacgcccacagccagctgcatgtatggaacattagatctctcagccagatctttacccctaa

SEQ ID NO: 40281 - DNA, 1501 bp, Oryza sativa
aaagatattttggttgcgttaaaaacatatttcaagaccaatttaagcacaacaagttatatatttaatagcgaggcaaaactggtagctcgctaagtttgcatggggaatgtcttagttctctgttatttttctgcatgtgattttcgtgccgagcgttctgcatactaagcttcttaatttgaagttcgtgttgatgataaaactcctccgggattagatggaaattgagttgtagggaaattctttgtggtactctgaatgccaaaaactaataagaagaccttatgttacaaactagctctagcttatactcatataaaagggaaaccaccatgtgtccatgttactctaaacatatcaaagtcccttgttgtaaacgatttcttgatgcctctgacctcaactagtgaatatagaacagatcagggacctaagtcagagaaagcagcccatgtggccatgcattcaaagtttcaagttggccagatcggcaaaatttcaacggacccgccaccctcgtccgcgcctgcagcgccccgccgtccccggccaccatagccgtcgccgtctcgtacgcccatcccaccccttctcccgcgcccatcccaccccttcctccgcagccgccgccttcgtccgcgttctccgtggctgccgtcgtcgccgccgccgtctccctcgcccccggccgcagccgtgcgttggctgggacactgccggactgccccgtcctcacatggaagaaaaaaaagctgaaagggaaggatgggagcaagaaagggaatagagggatggtgggcggacaaaataaaaaaatatttatgttgcagtaattataatatgtctattatatcagttggctataatgtttatagagggatggtgggcgcacaaattaaaaaaaatatttatgttgcagtaagtataatatgtctattgtatcagttgactataatgcttactacagatgatgtgtccatctattgtagccgatagctggctatgttattgttattgatctcgctcttaccgatcaaccgatgggtccacgtgatttctcccccacacccagaaaaagacgcctctgccctcctggccccacgcgccccacgccaccttgatactcgcgggcccaccactgccacgcgggcggaaatgacgccttcacccctcgaccgttcaaattccgttgccacgtcggcgtgaggattttgatttttgcaatcaccaccccgcgcggcgcaaacatttcgcccctcgcggccacgttttactttccttttttttttggccattagaaaaagtgcacgtgagaagaagcgccaagccacagccaaaatttcggccatgagtcgacaactccaagcagcggccgccgcctcgctctaaccggagtcccccactctctcggtctgccaccgccgcgcgggccaccggcggcgcgccaacccgccgcgcgcgcgcgtctctcgtgctcggctccgccgccgggggggaa

SEQ ID NO: 40282 - DNA, 1501 bp, Oryza sativa
ttttgctgttcaaagtccaagtctaaaagtgctctctgctcttaacaaccttggagtgctccagtgacagcagtgtgtgtgtgtgcgtgtggtcctgatcgatctctgaacttttaaaacacacaaatgcagcaaacggttttcagaaggagaaaaagctgcagaaactcgctggattcatgtgtgtttgattgatttcagcaatgcattgggagatcttttgcgcaatttttcttcggtttctggagacgtagggtccggtttggaaccatgtgtgaaaatgaaggatcaattaaacggcttgcaataattttgctcttgctggatagtagctgagtagggttgagcttgttcttgcatgcttttcttgtgtagccttttgtgtgtaggaggcggcttcattgtcaaactaggctaaggtagtgatgcttgagggcatgttcagtttgctttgttccattctagtatggttgtatgaacttttctaggcttcctttggaatgtgtggctttcttggtattcaattccagcatgtgtaatgagaaaacgggataataggaaaaatatgtgattttaatgagaacgcaagtgtaaaacaaatatttaaaagaaagaaaaatacaggaagggccatttgaatagaccgaaaaaaatatacgaattagagcagagataaaactcctgcaaaaaaaaagaaaaagagcagagataaaacaaaatgtaggttttcatgaggttggtcctcatgtcaaatcgaaattgtattgtcttgtgccatttcacatgaatttcataggattgttgaagtcccaatctttttgtctcaaagaaccaaataggaaatttttcaataggagtcataccctacaaatttcctatgttttccatacaaatcgaaggggccttgaatggttcaaaactccaacaagtgctacaaacttctgcaaagctccaatctacaagaatttgaccagagaggacaggtcagaagggtctgagaaggttcagacttgaggcagggcagtgataatttttttttaaactagagacattgatctcttcttcccaagaagaacacacagccctaagaataaaactattccaactcacaggaggaaagagagtgttgcaaagatcatcaatggattcaatgctaatggcatcagagtggtggcacccattgtgctgatgaaagtctgaacgcttctcagggaatggagcacaaaaagatagtatcatagtggcaaagctaattacacctcataagaaagaagagaaatacatgtattcatcacagcacctgaggctgaagcacatggggaccatgccatcatattaatgaatcatactccccagcatatacagcatactaaagctgaatgcaagcagtggcaaaagctaacattgatgttgcattatacaactaacaatattaccattcaaaagctaacatcatttgctttagcatgcaggagtgtgggggcaaattgagtccataagc

SEQ ID NO: 40283 - DNA, 1501 bp, Oryza sativa
acggatttcacaagtggaagctggaaacagggagcaaaagagaccctgtccggtccaggtgagccctgcgtgcgtgtcacgtgctgccgctaagctaacggcgttaattggtggcttttccgtccgcccggcatcagaagcttcgctaacggcgccgtcatgggacggcgagccccagtgtggggcccacggtggcaggtctggctagtgtgctatgctcacctcactagggtgatgggtaggctttggctccatcacctttgtcattttcttttatttaccttttgttttacaattcatatattggaaaattctaagctgcccttacatcactatctacagtagttggtgttaaaataataaaaaatatttatatatatagtttttttatgtaaggattgatttgaaaaatgtgtctcagcataaaggttaataggtttagttttgcttttaataggttaggttctattctagtattatgtaaagcaacatcatatctacatgtcattgttttgattttatacataacacagttaggacaataaaacacaaccagaagctaattagatgttacttttcgttttacaattcataatttggaaaattctaaccgccattagaacactgtctacagacgttaggtgttaaaatagtatggttgattatgaggatcgttataaaaaaatgtgtctcaacataaagattaataggtttagtttttcttttaagagtaggttggattcttcattttaatatgtatactaatgtcatatatacactgtcatccttttggttttatccaaaatataatttatatagtagaacagaatgacatgacaaaacattgattgagttgtgtgtcttattatccaatcgaagaagcgtgttctgaagcttaagcaaaccctacatttcttgtacggttgcatgtctaattaaaattctcataattcaagatttaaccccctccagaatccttccgcgcattcaatcaaagtcaaactagaaaccacaaccactccaaacaataccctatctaatctaagctagggtcgtaaaataagacaattcagtacgactattaatacaggttcagtgagcaacccattatgtaccgttgatatcgtcaacattactcgttccccgaccgcataaattccgtcattaccgattaatcgacatcgactcttttcaccccaagagtagaagaaggtgaaaaagaaaaattacagtgctaggtaaaataccaaaaatagtgtaggaccatttataaaaggggggtgagttcaccatgggaggtgaccagaatcactgcagcacactggcaaccgtataagcccaccgcagtctcctcgcttcacacactcctcgctccactgccatttcccgcgtagccccctcggcttctcttacatttacattcaggtcctccccccctcacggttcttcacgcgcgcgagggcccctttgttttctcgtatttacaaacaggtccctccca

SEQ ID NO: 40284 - DNA, 685 bp, Oryza sativa
agaactacaagagagagctgctgttcttctctgtccctctatgcttgtaatgacttgatccactacctcaacctctagtcgtgagtggagagctcccggtgcctcctaggcctacttccatgtgaaccagcactgtttgattccatgcacttatacttactgtatgaaagcttcatgatgcatgtactaattaattaattaatgctgtgatcgatgtttagtttttttcctttcacgttgcatcttgcatgttttcggcgaaaatacaattcactatgctgaactcaccgcacatgtgtattgacaattgcaagggatggccgtcgtcattgtaaacgcttccctaaaactgctcttccatctctttctgtgtctttctttttaagatgttggaacaattgtagatcgcaactcgtttaatttctttttcatctctttaggcatataattccttttaaaagaatagataataataggtttggcactttcaaaagctccttagtgagacggctaacctagacagttaacgttagcactccctggtgtagtcttggatgtgtgggtctcggtggtgggagggcgggggtcctcctactttgtaaatattttgttctttgttttttcttccccttgaaatgaaacgcagttctcctgcattttttagaaaaaaaaaagaataggtaaa

SEQ ID NO: 40285 - DNA, 1501 bp, Oryza sativa; identical to SEQ ID NO: 40277

SEQ ID NO: 40286 - DNA, 349 bp, Oryza sativa
ttcctgcagccccctgcggcatgcagcctttaggaattccccatcatcctcacacctttgtagctgtgccaaaaaccggagccagtgcattgccctaaaaattacctgtatatatgtaatagatagtgatttgtcaaaaccaaatcatttctactcaactgatggaacgagcagtgtcaaagaggctagcctagcctgtgataacggcaatcaactgatggtaaaatcgtcacggccgccgcgggggtcgctggggcgggtttgtcgcgttgctgttgcgaagattcggagaggaaagttctaaaaaaaaaaatcggagatcgatgaaatcggctcgcactcggaccaa

SEQ ID NO: 40287 - DNA, 1501 bp, Oryza sativa
gaagggcgatttttaaaaatcccaaaaggcggcaggcgattaaatttgtaaattttcaaaactaaaaactatttttgtaaatattttaataaaaaaattctaaaacttggtgcgcttgcggagaagatatacggcgacgaagcatgtggcgcagcaacgcttctgcgtgtgaagatcgtgcagcacggatgtcgcttgggaagagcagaaacgctattgcctgaactcgacatccggtgtttcttcccaactacgcctggactattgatgatagatcgcggtagattgccggtgacaacaaggtggcatagtgacaaggagaaaaatccgtcgccgctgtcaccactgaatttgttgccgttgcttgcagtggacatgaaaatggacatatgtccagatacattgtatggtgtcccattcactttaagtaattttctatgtaacggacatataaaaccaaactaatatcaaatgtggcacatatcaatactataaatctgaaagtatatctgtctaaattaatactccatccgtcccataagagcaggtacaatagcatactattagccaactataaacatattttaatgagataaaaaatgagagagaagagcagcgggctatagatatgtagctagctgcagcacggactccaagaagcagagtgtgtatgacaggtggggtcatacattaatagtatagtaagcaattattgtatgaaatagctattaaatcggctatagatgaattggaggtagtagtggactatactattaaacttgctctaatatagaaacctaagaccggatgagaaaattcatagcacaacgaatctggacaacatgtttggattcgttgtactatgaagtgtcccattcggttctaagtttatatattatggaacggagggggtagaaattaatagtactacggtgtgtcacatccaatcctagattttctttttgagacatagggagtactactcacaaaaaccccacttgtaggtttgtgagtttaacatttgaccgtctattttattttaaaaatttataagaaaattagaaaaattagtcacgcgcaaaatactatttatattttattatctaataataacaaaaatactaattttaaaacgtttaaataaaacaaaaactcaaacgttatatcaaagactgaaaatggagtttctatggacggagtgagagtacatcctgatgaaaacgagcacgaaactggtcctaaactggagcagcagtcacggataaaccggagaaaaaatcgataaaaatgagatacttagacttgtgaggcccgacgtgtccaatccgatgccgcaaaagtaacccgacgaccgaacgggtaaagaatcccacgagcccacgccggcatcgccattggccaatccagatccagacccggtgaaagggcccaccacttatttagttctccaggccgcattggcgtcgagtcatcgaccaatccaatccgctcccccggtgcg

SEQ ID NO: 40288 - DNA, 621 bp, Oryza sativa
aagcaactgtgctactcccaatgcttcccatgctgactagctaggcagttcactgtgtgtagagtttccaacagccctacagattacaaacgtgcactcacctgttccattttcagagcctgtctcaactctcttttatggaccagaaaggatatttgtgatgatcctctatggtgtccgggataggtaaatgggaaatagataaaagaagaaccaatttagggataatttgtaatgtagttcaatgtgcaccagcctactattgaatgtttgattaacttttaaaaaattcagatgtaagatggtgaggccttccagttgccttatgggatcaggattattcaattgagcattaaaaaggttgcgatgaaattaggtgagagaacactgattaatatagggatgtttcgtgtcgtcaagaattcgtggatgactatatctgacagaaattcagaagctatgaaaattgctgttaccaataggaacaaaaacatgcgagctcagctctcaaaacatgccagattcaaaatcctatccaaattataaaaacctgtgaaatacgactataattgatcaagatgctgcaatcggttaagaacactggcattccatttgcaacca

SEQ ID NO: 40289 - DNA, 1501 bp, Oryza sativa
gtctgtttagccatgtatttgtaatataatagattgtaacgtgtactaaccacgaagataacgagttgtgtgcaatgtaccatgtttgattggaacactaatgtggccttctgccatcatcgtgcataggagcggatctaataagacataacatgtgggactgaacaaacttgaaaaactttagcccggtccttttctatggatgtatgacaaaaggaagatagggcttatatggaggctcttatagtcccaacgtcaaaagtaagggctcgagcccctctgtccctatgatagatccgtccctgttgtgcacctcaagcgtcggaatgccatcgatggtgaattctagtcatcctttggagtaaaggatttttacgggaattgactgatttgtatgagaataatacaaaattgatgtgttgcaaagaagccctccacctttgaagacggacgtgattgatggctagatcaaatttcacaatgttttttaatagtataacaaaagcagataatataaggtcaagggaatacctaagcctttagcatcaagtcttggaacaaaaaatatttgaacggttctatttgaggcaccaatttagaatgtataatagaagatattgccatccaaattaaaagaaagtctaaatacacccgtgaattgcaggtaatgtcctgctttttgtcaattctgctttagggcattcccaacccaatgactaggatgatgtccatagcattaaataagttaccacctaggataaaaaataatgtggcaagtgaataaatgaggaaagagaaggaaatcatgtcttgcatgagacatggtttctacacaatatccaagacatcatgtgagataaatagcattaaattgaagtatggaatagtggtgtttgcattggaagagtagtgtctagtactagtttcttgatgatgtggagtttatgaaaaccatgtctagtgttatgggttgggattgcccttagccttactccctcctttccaaaagataagctgcccacaattttagaaaaaataacatttgtaactattaactaatagtaagctaataatatgtatatgtagaaacatgcatatcatatctttagattcatattttaaaatagtttcatataatgttaatattaattatcgataatatattgtgaaagaaattaacgtttaaaatataatataaaaaatacgcatgtcttgtagtttggaacgaaggtgaagggagtacaaacaactctgtggactaagcacattacacacaccaccgtcattacttgtcttactagccagaggccttccaaggccggtaagatgtataaatttgcttggccctcgcctcccactgatctccacacacaagaactcactaaaccgcttaattactaccaacatttgcatcactgcatgatcaccccaatggccaaaccaccagcaacaacaacgctcgtcctatgctgccatctcgccgtggctgccgcagcagcag

SEQ ID NO: 40290 - DNA, 1501 bp, Oryza sativa; identical to SEQ ID NO: 40267

SEQ ID NO: 40291 - DNA, 1501 bp, Oryza sativa
ggtcggaacgggatccccgcttacgtagttacgggccgttattagttgggccggccgggaagggattacagcaacgaactttagcaaaagaaatgcgccttgagactaatacgcacgtaaaacggtacgataaattaactcaggaataatttagtattagttaaaaacttaaaagtgaattaatatagtttttaaagtaacttttgtatataatttttttttaaaaaatactccttttaacaatttgagttgagaaaatcaacaaaccaattcagcttgagtgtcttgattacttgtatcacttggcagtcttgggctgatgcttttttcggtggtccaattaacgattttatacgaattgattgtaccacagtatccccgacgtcaaatcaagaaaacactacacgaattcttgatttttgctccataaaacaatacagcatgtgtttcttaattatttatgtgctccaaatataataaaacctgtgattctctggagacgaatggccaatattataagcacaagtgcgaatcgtagtagcatgcaaattgaaaatcttccatgccggctgaggtaagctctgacgcatactttgcctataatttctttatatcaattattttttccgtgctgatagctctaagatgagtcaggacacgagtacaaagcagatggcagcggaatctcatctctcccatatccatcagtaataagctttgacctctgcgtgcttttttttgctcacgtagccgtgcagttacgccattttggaacaattgaatcgactatctaagtattttgctagtagaacttttgcagaaatttaaggagtatgtaaaattaaatgatataaattatgataagtcgaaaagaaaatagataaagaatatctgcattgtacgacggaggaagtaaataggagcccatgtacaattccaaagtactcactcgtacgatatcatttcctaaatttatcaattgtatctattattatcagtatgtggtgatcatgaatggtcggtaaaatataatcaagtatagctgtttgtcactgtcagtatgtcagtccctcaaacggttataggggtggctaggattgaaccaacataaattggcgcccatgcttttttagcgtatagaattttatcatccacaaacccgtcacaatccgtgaacgaacaaacttgaaaaatgaaatgctaaacatattcatcttcccttttccacacggaagaacagcagcacaataagtgaaacagtgatgcatcattgcatctgtgcatttaaagatatactcctgagtagactgaaaattctctcttcttgacgacagtaaaaacttttttagcttaacctccatgacaggttactgattaactaagcaagggtgtctcgtagtagtactgtactgtgtagcttaatatagcacgtcagcttctcagctctaacctctcaccattttcccaagagatatcgccatcacgatctcccgtaatcact

SEQ ID NO: 40292 - DNA, 471 bp, Oryza sativa
aagtttcacagatcgatctgacaccagtttatattttctgtgcaaggcaatagctgtcggaaatattttttctatcagtataccgctagataatgaatttttccatcatcttttttctgacctataattctgttgctccactggtagaaatataatttttgacagccctttttacaggagcagcaacacagtaaggaaaaaaaagacaactttaggctaaaaactttaggaagctacatttgagcaagcacttcttcccttgttctgaacaggctaataaacatgttgaccacatcttccactgtctcattgtaaacgttgttgaaaactctttatcatttcgctgcagccaaatgcaccatgatgtgtatatgatgacaccatcaaatatccttcgatgttcctttactagctttctcctgcaggtttcccaccaatgtaggatatcaccccccgaaatatagatggcca

SEQ ID NO: 40293 - DNA, 1501 bp, Oryza sativa
ttgtgctctaaagtaacacggtactgatactttatactgttacaattgcagtatgtatgaagttcagtacatattgaggagacagagtgatggatcttggaaaatctgtgaggcttctgtacgggacttgacatgattattgtcaaaagagacaacttattcatcggctgatagctcacagggcgctgttaattttataaggttcgacatggctggctctgttaattttacaaggttcgacacggctggcttgatacgccattaaatcaatttgaggtatcttgcaatggcttgcgatgcccgagctgctcatggtggccaccggataccttacatgacaaagtagctgctgatagcctgatatgccacatttgtacagactctaaccaaacctgatatcacatgcttttatctgtttcctgatatggtttgaatttgcgggaccttttttagtcgtgcccttttttagttgtgcgagaggccatctgcgtctaaattgtggcgccattgttcaaagaacaatgtaaattaatctgctcctgtgtctgtgtggttgtgttcaacggtaaaattcatgctccgctattcatccttgttaaattcctacattaagatctctgctagatctatgcttaagaaacttgtcaagttgagggattgaataaacagagcaaactgtccctaaccctgaaatattctggtggccacaggcgagctcaatggcaagagcacccatgctgggtttcggaattctgactgtttacaagttcagtttcttttctgaaatccctgaagctgcagtatgcgtcagaaagtatcaccaatgaccatctacagtttaaaaaaaaaatctcatcaggtaccggaggatttatatgtaggagtaaccaatctcctagctcattgatctctcgtagcctcaatttctcgttcattgatctctcgtagtctcattcagagactatattcttgacgttaaaaaaaaaacagaatcgggaacagaatctctccctcgcgcacggggagaggaaacagaatcggaagcgaagttgtggaggaagcggagtacataatactaatctctacttctcacctcctcttttctttctccctccttgacctgctctgtctcgtggcgtgggctacgacgacagcgcgaccggcgccgctttcgcacgtcttggtcgggaccttcgccggcgacgagcatccactaggtttttacccttcacttcttgtatgtacaccaccctataaggtgagatgcccttccaatggagtgcacccatccaatccaatgggggttggggggctcttattttagctagcccatccgagacacaataatgtgctgctgttcttcaattcatccacaatatatcatctaactacaattcaagcagccaatcaactatcattatagtccattcatcacattggaataagggctcaaaaagtagtttagccatgttggttatggtcctgtatcgataagctttta

SEQ ID NO: 40294 - DNA, 790 bp, Oryza sativa
gtagactaataacaaaacaagttacagattccacctgtaaactgcgagacaaatttattaagcctaattaatttgtcattagcaaatgtttactgtagcatcacattatcaaatcatggcgtaattaggctcaaaagattcgtctcccaatttacatgtaaactgtgcaattgattttttttcgtccatatttaatgctccatatatgtgtcaaacatttaatgtgacggaattttttgaagtttgaagggaactaaaccctgccactgttaaaaaaaacaatattctactagtatttttttttctccaatagaagaactgatatttttttttgacgcacttgaaaaacaccagctgctttgctagctgagcaaccagaggccagagcagcagcagcagcagcagcagaacgagagccgccgcgccgcgtgcgtttcgtttttttgctttcccactcccgagacgccgcagagcgcacctcgctcttcgtgctgctgctgctcgcctcgccgccgccgccgccgccgccggagtagccgagcttgtgtgcgtggttcatctggcaagagctagcgccgaaccccgcggcgccggcgcggcggtcgtgccatgcgtggaggaggaggaggaggaggactctgaagtgaactgccatggcgagcatgaagcagcagcagacgccggcgagctccgcggtgaccgcggcggcggcggcctcctcctccgccaccgccgccgtggccgcatgcgaaggtatactgcttttttttttctcttctcctcgctcgtc

SEQ ID NO: 40295 - DNA, 294 bp, Oryza sativa
ttgtactgtcatgtgtatgtaatagttgtatggctaatgcctgtgagccatgttcatcacctgtttctgtagacaagggcaattttccatttgtaagtccttttaacacttatgtgaaaaatgcctcgctcctttgaagagtaccaggctaccagcagacacataaagtttcctcgtgcccttttgggtttgtttgatatcgccgttctcggagctcagcgtctggagttatgagggattattttgtacggtaaattatttgataggatgttttctgaaaatttccgtcacagc

SEQ ID NO: 40296 - DNA, 1501 bp, Oryza sativa
cggccaagaccgggtcaagccgaccccggtagctaatcaggggagccatgatgccaagagacatgtggattcaacggggtggtatcggggagaaccctcgggcttcctggcatagtatggtctgggacctaaccgggtgttggtctgggacccctctcgttggcatatggtaaacctgtgtcggctttcgaattgccttgtcatgaaagcctcaaggtctccatacgtggccgttctgaacgggctgggtgatccgggttagtaatgccgtgtgggtaaagtgtaccccctctgcagaggttattaaactgttcgaacagccgtgcccacggtcatgggcggatgcgaggtgtttcctgtagcgtagatttgtttgcctgtgctttgtgaaaaattgttgtggattgggaatcgttactagaatcagcctatgtggcagatggatgacctgagtggtcaagaaacgaatctgtgtgattcaggatgtctgcgggcatcatagacttggcttcccgagtggaagcggatcgttgtgttgttgggcagctggactctgggagttcgagaacatgaataaggctctaggagccgcttaatcaagtgaaatggctctgtgagccgagaagtaatgatctgacccgggaggtcggtacattacaaattgagttgttgaaaaacatctcttaaagtcgaatcgagacgcaagtcacttttcggcccaaacttagaaagaaataaatcacttagtggtttcaaaatggacttcaaacaaaagatttgcaaaacaaccttgcctctcttccaagcttgcatcaaacacctaaattcccgtgatttgctgagtacgaaagtactcacccttgctctatataaatatatatagttccttcgtcgtgaagttgaagatgaagtgaagtgaagaatagggtttcgtcctggtttccagccgtcgcctgtggtgttgggtgttagaccgttggttccgctgctgctgttgttgttggtgtttcctcgtgcgcgtcgtcggttgtattcttaggctattctgagctacaacctaagttaaggtaaataagtcttctttttatttttaaggattgcaatgattcatatttgtcaccgtgggtaccagcgctggactggtactgtgatcgcggtttcgtaggaagcggttcgcgccgtttttcctacgacatgctcctatcaggtgccgttgtacggcggtgccagatttgggtgtgacatgatttgatcgtgtaatcaataagaaataaaggcaaagaaaccgcggttaaatctataaatgatagccgatcggctaggtgccgatgacatatcatttatctttgagccgatgtcatatgtgaatcgatcggcagttgtaaatagacagtaaagaattaaatctattcgatcggctgtagatatttccaatatatagttcttatatcgatatatacttaaatcaagtgattgggatagatcggtcaccatgccgaga

SEQ ID NO: 40297 - DNA, 1501 bp, Oryza sativa
atagtatattatcaaaacataccatggatgtaagcaacttcccctccccccatgtgttttggctagtgacattatcccctcttcctatcttctctcaaagtcccccaatcatgtttaggtaaaaaaaagttctattatgactaaaataaaaaaaacgattcgactatattatttttcaaagagaattcattgtgtcactgattttgactcgttatataatatgatatcgtattttgcttaacttctattccatccgtctcaaattataaggcatgtatttttcttacatggtctttactgacatactctaaccattaatttactctatattttgttgccaacgaatataaaattagcatcacatgaaactactttaaaatataaatctagtgatatacttcatccgttttacaatgtaagtcattctagcatttcccacattcatattgatgttaatgaatctagacatatatatgtgcctagattcattaatatctatatgaatgtgggcaatgatagaatgacttacattgtgaaacggaggaagtaacatgtataatacttagcgtatatatatttagtatgattgttagttaaaagttactgagcttgatttttcttaaaaggaggacgcctataatttaggacggagggagtataatataccatcgccctctagttagactccattatcactgtataatttttttaattaactcacgcaattatccatggaacaaaaagtgttcaaaattgaacaaaaatttcgaaatatcatattatgaagtagcacaagattatccatctcaaactttaagtgcagttttaaagtaaaaaaactgagatagagtggagcagctcgagtatctccgtatctcccccttcccttcgcgtaaaagaaaatcccccgtctcgtctcctccgctccttgcgccatctcgcggctgaacaggggaggggcgccgatctccgtctggcgcgcagagcagggggaggggatcctggtgagcatccacatcctctttctggttcatctctctcccaccgggagtacttttgtctggaatttgcttgcgttaaccctagtttctcttctagatctggaagaagcttcttctattgatttcagagccttaaccttaatacaagaaacagtttgtttgttcccccatgtcccaagttggatccgcccctgtctgccagttcagtagtttttggtgggattttgaggatctcactatggtgtgtgatcgcttttgtcattcccaccacacatggatttgctcattttgtaataggggaaaaagagtggtgcctaaagatagcgtggatcatatcgcaatagtctgtccaacaattacctgaatccttttgtttagtcataaatccttgcaaatgttctttatatttgttctctctactctccaggattgctgaattacttaattgacttaatcttaatcctaaacttattagctgactgtagaatttcaccttggta

SEQ ID NO: 40298 - DNA, 475 bp, Oryza sativa
cagtttgggaagtgtgctcatgggaaacgagggggcatttcagcccatagcgcagtgccaaacaaacccttaagtgtggactgtctgatccaggattaataacagttatcttccttaggttggtgtgcagaacaagacatccgatgtacattccaggctagtgaacgccgtggttattgatgccaacaagaatcaggtgcctgttattgcattaacattccaacaattttactcttttgctggatattcaattatttgcggaattgtgaatacatgtaaatggatcagcaagtcttgttttttgagtcttatctttttattatgggacctcgtgatgaaaactatatgttccctgctatctattacaaaatttccaatagaaaatcacataataccgtgctatcactggtaaaagaatgatgtgagtcatgcaaccagctatttgctgatacatgtttttatcttgaaatgtaga

SEQ ID NO: 40299 - DNA, 1501 bp, Oryza sativa
tttccttttgatcattatgcctaagtaagagaataattctctatcattgatgcaaatggtaaagctataatttaatttacttctgcctatgctgaaagtttgctttctttttttgcatatgcataggaagtgaagtgaaacattacagaatctcagatggaagtgaagtgtttcaaatggagatgatgaaaagtttagcctagacgtctagggcgacatggccgccacatctggatgcagagaatgcccatgctggtgtttgttcgtttggccactgccaagatttggtcctcttttttgttacaggaaaaagaaacagcattctcaccatcgagcctatgagccctgagccatcacatcggtgtcggggaggggaaaaatactagtcgtaccactactactgtacgggagtaaaacttgttgcgtctttcacctggaggaacagtttaaaatatgcacaaaatcagagagaaacctgaaaagccagaggtatacagtactgtacgtattcccttctgcggttctgcctgcagtttgctgctttctgccttttctttatcacgcagatgctgctaatctcacaagacaatatgtaaacccattgtgctggtagcatatcatatggcagtatccagcatatgacaattaaaaccttgctagttcaggttcaagccattctgggaagtttccccagcaaaacacatgcctcctcgtaaatgcactggtgatgcccgggttgagaaagcgatcgattcattcattcattcattcattcacacgctctgcctctgcatggaaatgaaatgaaaccacccaaccaaccagcagtttacatggaagagttgaatgatggtcgtctctggttaggtttttcacatggaacaaaatggcatgcatatacatatcaacagtggcgaaaagcctgcagcgcgtgagagagtacactgggtatgtttagttcacgttaaaattgaaagtttagctgaaattagaacgatgtgaagaaagagttagaagtttatgtgtggaggaaagtttcaatgtgatagaaaagttgaacatttaaagaataagtttggagctaagggtttgtttactttgatgaaaaaaaaaaccttactaaattttggcatgatttcttatatgctctaaaatttgatagtaaactaaatatagccactttttgataactttaccaaaatttgataaggttaaaaataacattaaagtaaacatgccctaattaaacttggccattctcctgcaacgcggcaagctgcgcctctcgcgtcggctcgtcatctttacgtctcccacccctttcactctctcaccatcaccaacacctggttggtagctgcatgccgcgcagtacgcacatactcctaccactcaatcttctcgctgtcttcttttacgtttgcgactcgcttttggtcagccttgctgcctttgaatcgaacggacgaaacacacacatgtgtgcacagtggtgtgcgtc

SEQ ID NO: 40300 - DNA, 1501 bp, Oryza sativa; identical to SEQ ID NO: 39935

SEQ ID NO: 40301 - DNA, 1501 bp, Oryza sativa
tgaccttgacctgaccttcttggtcgtcttcttccttctcctaatctacaagaacatggggagcagcagctgcaggaggaggaggagctcagttccaagctccccacaccttctccccgatgaagcgcaccagcctccccaccgtgctcttctcggcgttgctgctgctgctgctgctgcaatcgccctcgctcaacgtcgtctcgtcgtccgcatcgccgtccatgctgtcgccctcttcctcctcctcctcgtcgtcgccatcgccctcgtagtcgccgtcctcctcgccatcgaagccacaggcgtggtggtggtgttccacgctggcatccgcctccttggtggcacttgcatcctcctcgcagtcgccgcctccgcgtttgccgccgcggcggcggcggggagggcggcgcggcgggccagctccgccgccgccgctgcctcctccacggcgtcgatgatgcggtggatgacgtggcggttgggggacgcgtcccaacgcgcccagaagctcttgtagcagccgaagcacccgcaccccatctccggcgggtgagccccgcggcggcggcggcgtcccccggccgccccacctccagacagcaggtaggcgagcacctcctgctcctccgccgtgagcgccgacgccagggccagcacagcggccggcagcacaaccgctgccgccgcagcagcatccgcctgcgcctgctgcgccggcgccgggtgcaccctccgtcccttcccctggtacaacttcttcatcctcctcacccccaactactactactcactcgcacttacttcagccggagttcgccgggttaggtgcccaccaactgctcgaccaaaagccaacctcggggacgggttggtgcgggtaggtggcgggctcccgtcggctacgacgttgctgttcgcagccgctgctggatggcgcccgcgcagctcgtcctcctctctccttcgttctccgcagcagcagcagcgagagggaggagcgcgtcgtgtggtgtttggtttggtgggtgcgaactctttagccgaggagacgggggaatctgacgggtggtgtacgggaatctcttgcagtcgtgcacttgctctctcctccctccggtccaatcgggggttgggtgcggtgcgaccgcgcgtgtgtggcgccgtatcggtcgcgacggcgaacgcgagtccatgctacgacctacgaccacgtaaacggtcctcctcacggctcttctcggtcttccccgagcaaccgtgtcgcatcgcaacacgcccgtacattacatatgcgactcgtgctgctgtaccccacacacacctggtctcatgggccgagcacattgcaaattctgatctcgcaagcccaagcccagtttaacgctgttccaaactttccaatcggcttcactttgcacattcctgtcacactgccttcttcagagatcactgcagaagactgaagaaaatcgccaacaaaaagccatatatcgcg

SEQ ID NO: 40302 - DNA, 1501 bp, Oryza sativa
  unsure (1)..(1501): unsure at all n locations
gctagtcaggtacagccaagaacgcatcctcgtcgtcgagaccaccttcgtatcctaggcaaaaatgcttcctgctgcaatccaacaagacgaacatttttggaggtttagatgtactttagtcttctttgtttaaaacataagattaaataaaccatccccgcaaaaaaaagattaaataaaccacatgaatagaaaaaaaaacatgaaatgttgatagaaaaattacggagtactgtaaaacatgattgtttagttagatagcaagaaaaagatatgaattggctgagagagataaactcaacttttcagaaagttttaagctctcgttaacttttcttcgaaatttgtatagcattgtccatttcataaaatttttttaaggaaaataagaattcaatcttttatttcaaatatctttgtaggatttttttagaactaaaatcctctaaaatttttgtgtttttcatacaaccagggttttaaattttgaaatcagcatttctgccgcagctgagcaatagaaccgaaatttcagaaaaaaaatcgtacgaaattttttgaattttgacggattttgtataaatctgaataaaatttgatcaaattcaccaaaaaattacaaaaaaccgaaattttcgggcgagatgttagcatttcggtgggggcgaaatttccgaaatttcaaacactgcatacaactcacggggcctaatttgagaagattttcgtaagaaattcataggaaacagtgcgtttgaaaatgatggacgcatatgctgctgactgcaattcagggctccggcgccgctgaccattggcctctccacggagcgcactgtccctgtcgctggcgactgtgctgaacgagagtgagagcgaccgatcaanatttaacccgagtttggcccacacacacttgcagtgcagacgtactcccccaaaattgaatgacatttaggacgggagaattcaattcaagctactccaaaattgaatgagctatgataaccatcctccaaaatcgaaatcgaatttgagatcaaatctcgcaggagcaaatggagcccaataatggaggaggtatactgatgcctccgtcatacaagggtcccctgcctctgcatccgcactgcggcgtcgtcatggctctcgttttctttttgcctttgcatcttcgcagagcagcgcccgcctgccaaactgccgatcgaaaacatcagtagtagccatcaaatgcagcatttcttcttgtacgtctcgtttctttttccaaccggcctctgcctctgcctctccgtgctgcagcttgttgatctctctacagagagaggtgcagtgcagagcccataaattgtcagcaacctgcttcctgtccttcatctcgtactgtagtactacgataacagtgacagtcaggctgtgtttattcagcgcaaagtttggattttagttaaaattagagatgattgtgactgaaaaattatgtgtgtatgacagg

SEQ ID NO: 40303 - DNA, 1501 bp, Oryza sativa; identical to SEQ ID NO: 39916

SEQ ID NO: 40304 - DNA, 209 bp, Oryza sativa
atatgtttgggccgtagagattgtcacggatcgggctatagagagcagcagtaattttgagttaacaaagcaagtttagagttttgatcctgtccaactaatcgccgggttaatcgggtctacacgcgtgacatgcgccgcaacgagattaccaaaaaccaaaacaagcaaagggcgggcggttcattcattcacagaagaagagggcc

SEQ ID NO: 40305 - DNA, 1501 bp, Oryza sativa
gctccaccgccggcacgcgcaccaccttggcgtaatccgttcctcgtatggcggcgtcgaacgcctcggcgaaggcgcggaacacgtcgggccgcatgacggcgtacggcgtcgtggtgctcagaacgacgccgccgcggcccgtgcgggcgtacatgtcgagcgcgccggcttgcagggacgccgggacgttccgcccgtaccagctcaccgtgatgcctttgacggggaggtagtagccggggtttcttgggttcgtcaggagcggggtgtacgggaggctttccgtgtagttgacgatgcctagactctccgtcccgatgtacaccggcgtgtcgccgaacgcggcgaatccggggaggcacagggcgaacttgttgccgaagctgcgctgcgcggcgagctgcgacggcagcgagagcggccgccgggagaaccccgggacgccggtggcgccggcggggagcgacgccaagcagccgctctggcgcgcacgcgccgacggtggcgaacgcctccgggcacagcagtttggtgccgctgctggtggtattagccgacatggcgaaactggtgagatcgccggtggagcactcaccggtgaccgggttgaacgggtgggcggtgcaggcgcagcgcgaccccgcctcgcggccggaccagaaccagccgccgtcgacgtaccggcagcgacgcggctgctgctggttggccgcgccgcacgcgccggacaggcacgacaccgtggcgtgcgtcgacgaccggcacgtcgaccagacgagagcgccggcgaggtcgacgacgagaggggcatcgtctttcttgatggcgatcgtgtagagggaggtgttggtgtccctgatgagagggacgattaggggtagcttgtacgctgctggtgttgcatgctgatcaccggtcgccaccaagcatgatagcaacagaaccagtgacacaatggctggagtgttaggcatgttgtgtattcagaaaatctgatggatatattgggaaggtgattggctggcgacagaaatgggcatagttgaatgtatttgtactgctacttcaggagtagtagttcaattagtttttggtcaatatttgtagggtcaagatgccaccgatccatcatgcatatcaaggagttgacgatggccttttaaatgaatataagagcgagtactgtactgtacactgttgattagcacccacagtttggattttaagtcagggaaccctggtaaggatctggctgtatgtctatctgcagtagtacacaattacgcatcacacgagatcaatggtaagggaaaattgcccgtttggatcgatccaagacaatccggctcggttctggagtcttaggttataaacattgggctggattatgccctgatgaaaccatctcatacccatggtccgagcaagcactaatcaagggcacgtacggttgtctgacattgaacgattataagagatagattatatagagtaggac

SEQ ID NO: 40306 - DNA, 1501 bp, Oryza sativa
agcagggcgttggccatgactgacgggaagctgtaccccgcgcgctcgaagaggaaccacaccgccgtggcgcccgccacggccgccgcggacacgttcctccgccgccacagcaccaagtcggcgactgcgagacgagagaacacgagtgaggagaaaaccgaacccaaattctcgacccggatcggagagcgccgggaatgcgcgtgcgtacctgcgccgccgccgaggagggcgtggagggatcggcgggaggtggtggccatcgggatcgccgcggggagggttagggtttggggccgcggccgaagcgaggagaggaagtggggtaggtgagtggagctcacgaggcggaggcgacgaggacgagatgggatctctctctgtgtcctttgctggatcaggaaatggattcggtttcggagacggcgcgagcgaatgaattccgtcgaattattttgaaatattatggtgagttattgcaattttgcgggcaagtgatgcccgatggtgttggaataactccttccatttctatacttttaagatttaaattttacaccataatattcttatttttcactgatttttgtgattcccatcatttcaataattttaaagctaatcaaatgcttggaaagagagaataagtaaatttcatttaaccacccgtattatgatctacctcttaatcacaaataataataacctataactagatgggatacattatagtactacgaatttgaacatagagcatataatacccaacgaatttctgtcgagatttatagtactatgatgtgtcctatctagtactaaattttagaacaaattgagtaaattaaaaaaacatacgattttttagcacataaacatatgtattatggtcatttcaaaaaacacaatatttatcattctaactttgaattaccataattttaagttatacaatcgcatctcgaatttatgagttatttatccatcatataaatgttacatccatggccttttaaaaatttgatatatgagtatgtcaaattggttacaatgtggttttgtggaactttatatccatagtacctatgggtcatgtgctatgtgtcaaaatccttgtagttttgtgtaattttgatcataacgagtgtatttttacaaaatttcccaaaagaaatacaagtaattcgaaattcaaatgctaacaactgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgaca

SEQ ID NO: 40307 - DNA, 296 bp, Oryza sativa
atgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtggaagtggaggtaggtatgggccgtcccgtcagaaggtgattcggatggcagcgatacaaatctccgtccattaatgaagagaagtcaagttgaaagaaagggagggagagatgatgcatgtgggatccccttgggatataaaaggaggaccttgcccac

SEQ ID NO: 40308 - DNA, 1501 bp, Oryza sativa
ctgctcaggctccagtatgcaacacctctctttagaggggctaaggccattacgggcaccagtggacaaattggcttaggcatatccgaaaggggacgcctattggcaattcaatatgtgtgagcattatggtacaagactaccagtgcagagcctttttgggacactaacataaaaacttgggtgggtatccaaattgtagggtcactactcactgggtcaagcagataagttctccatcttccaacattctttttctatactccacagtacacatatctgcacacttatttgtgatatggaatatagtaagcattattctggcaaagagaagacacctttttttttctggtttgctattatgaatcagacggcaaatattgcttccggccgagtcatgtcatgctgacttcatgtttagcaaacgctaatatgctatatgaacatatctttgctcctggcccagaagatgatgatgttccacttgctacatacacacattgtgccttttgtcatgccccagtgccccaatcatatactaccggtatgtacagactacagagcactgagcccggtcgtgaggcagcctctgccctcctgccgaggaaagccgacgctattgccttccccgcactgacccatcatcaacaactcaactcaaaatcacaaaacgccttgaccgcacactgccatactattatgtgtgtattcacttcgcgagctaggcacgtagccacttcgccctggaatcaagtgcacgccccgctcggctcggccagtggtcgcgagctgcacgccgccgctgcctgcacgcacgagcgctgcttcatttcttcttcttcttcactcctaccgtcgatgacgactaattaaccgccaaccccactaccgcctctctctttgctggctgccattgcctcctctcttccccggcaaaacaacttctctcctattcccacctcttttcacccataaagcggaagtggatttttgtcgggacatcctctcgttttgtgcgtatcgtttaaaaagttatcaaaattttttttaaaaaaattatcaagatatatattgtgatcaatatatgatatatcttttcgcaaacatgcaagttaaaattcgacatatgtaatttgaaacaaaaataacaaacaaatttaaccgtaaattacgtgttcttttcacagttaaatttgctatttttgtttttacttgtataagttgaatttgaatatgcatgtttgaagtgacatatcacatatagggtgtgtttagttccacgctaaagttgaaagtttgattgaaattgaaatgatgtaacggaaaagttgaaagtttgtgtgtgtagaaaagttcgatgtgacgtttttgggattcaaagtttggaactaaaccgagccataatctgctacactaaattttttaccacctccgtcccaaaataagtgcaaccatagatatccgtgtccagcgttttgactgtccgtcttatttgaaaaaa

SEQ ID NO: 40309 - DNA, 1501 bp, Oryza sativa
gtacaccttggcctggtcgatgtgcggggagagggagcccctgatggagtcgaagagcgcgcccatgtccgggaggcgcgggacgtggccggcgcgcgcgcggaaggcggcggcgccggcgaggagcgcgacctcgtcggcgtcgccccagagcttctggacggcgcccccgtgctgccccccggcggcgggcgcggtcccgcggcggggtccgcgaacgcgccgcgctgcctgcgcttgcgctcgcgctcgcggctgcgggaggaggcgggcgcggcggcggcggggggcgggctagggttgggggccgggtggcgcgcggcgtcgcccgcgcggggcttggggcgggacgagcgcttcttcgacgacctgggaggggatggcgaggcgggcgcggcgcccgcgtccatggcgctctgggacggccgcttggatggcatccgcgcggcgcggcgcggcacggcacggtgcggcgcggcgtggcgtgggtgcgctctggatgcgcttgcggcctcggcctctgtggggagagagcttggaaattggaatgctcgatctggctgcacactgtgcgctctgtatacggatgcctgatggttttcaggccttcgggggagagtgtgtgtgcgccgtgcgcgtcaacccgatttggccgtggccgtcgtctctgatgatctgatctgcatctactagtatattcgccgtgctgtgagtcgctttttctgctggctgtccttttgaaataaggccttgcatagataaaaaaaaattagcaaaaaacgtcacattaaatatttggccacatatatgaggcattaaatgtataaaaaaaccaattgtacggtttacatgtaaattgcgagacaaatcttttaagtctaattacgtcatgatttgacaatgtggtgctacagtaaacatttgctaatgatagattaattaggcttaataaatttgtctcacattttacaggcggaatctgtaatttgttttgttattagtctacgtttaatactttaaatgtgcatccgtatacttcaaaaactttacgcctaaagaactaaacgcaccctaaaaactatttgacagcactgtgtagtttgtagcttgggcctctttattctccaatctccatcctctttgtaatggtgaatggtgtgtatatttcaccatttctgttaggtgtgcattagtacattgaaaaggctagatacattggaggaagtgaatctggtatacacatgactttatacctctcatcatctatactactactagaacacttgattttagaaagtaatgagtataattttccttgatatccctacgactaggctggaagctaagatatcggtacaattttcctcaggtcacaagatagcgtacggataacactgcgtgaaagggtgactagaaaactagttggtaggttggactggctaggaaatgacgtgtggttgtcgacccgctagaggctagccatgggaaggttgctcgggtc

SEQ ID NO: 40310 - DNA, 474 bp, Oryza sativa
tacaaagtgaacaatcagtttagaagttgaatgataagcaaatatagtttcaacattgtaatcattaaccaagatggcctaattgttttttaccacaccatgtagtaaatatcgaaatgctgaccccttacacttgaaaatgcactaatatgacagatacagaagttagcatacgatttacaaacaggttaagccactaaatcattttcacatctaaatctgacgggagaacggccaaagcaaccgttatgaacctaaattatttgatacagtcgaaaatgagttccacttgattcttggcctcgtcaatcatcaaccgagtacaatgcttcgaccagccaatacaaaaggcattgcagatatatgtaccctggcctcgtcaatcatcaaccgagtacaatgcttcgaccagccaatacaaaaggcattgcagatatatgtaccctggcctcgtcaatcatcaaccgagtacaa

SEQ ID NO: 40311 - DNA, 1501 bp, Oryza sativa
ctgtgtactccacttacacttgcgtcctactacgttgtatgttacttgagatcgaccgctcgatatttttcatccataaatatgtgcatttaatgtaatgaagaagaatacatttaatgtgtaaaattagggaatctccacccgtttctgtaaggctttcttttccttttcaatgtgttgtttgattaccttcatcagtttttctcaattgaaaaaagctcaaagagacgtgcacatgaaatctggccttttggacttatcagggctgcgcgccgtgctatatgcatgataagttatgatcaagccagttaagtgacatcaagtgatgcatcattgagtcttgagggaaaaaaaaagaattgcttgtaaatttcagaggcatttgactttgtaggagctggtacagcagccgtacaagggcccacgatctatacagactcttcttaattaaccccccccccaaaaggttatcttttataatcatgctgaattgatctattttcctcgtaatctttaatcatcagatcaatcaataccgattgttcatcatgccatgaatctccaaacgcttcattttttgttgggccgaaagctttcgacctggctgacacgtgctgaactctatcatgggcctggagacatacggcccacgcattcaatcctctctcctgggccttggcccactaggcagtcctgaactgaactctgatgatatcttgttcttatctgaaaagatcgccacatcgatcacatggccaactcatcgagcggcgcgatgctaatcaatctaatactgatacactacactaatcatgtgttgcattggcgtttgttaatcaccatcttggtcgtcgtcgtcgtcaatcgtcatcgctgagcatctttgtattgtacattactaatacgagcagcgatcgtgatcagtaaaaacaacaacgtggtcagtccagcccccttggattagttacactaattaattaattaattaattaattaattaatactcctctcttccaggtgtatacccagtaaacgacacaagctgcaattagccgaaatcctccgtatatttcaccaagccctaacacggacaaaaccatccagatgtgcctgcaattttctttcttaactgcgtgacgtgttcgattcctcgccctcgaatggacactgccacgtaccaaacttaagattcatctgagcttgcagatcgaacatggtcgatctgtgaatctataattattcctcctcctccttcacatgcgtatgtatgtataccagtatgtggatcaactggcgtaattaaaatgagtaaattaacaacaattagtatgcagctgatggattccatcttagctagctagattctccgatccctgaaacaaatcggcagcactggacagatcatgcattgcatgtatatatatgaccaaccatttcagctaacgagtagctatccagcatatgtttgctagtttcagttcagtgatcgagtgagcgagct

SEQ ID NO: 40312 - DNA, 1501 bp, Oryza sativa
aatttgctccaattcaacaaaaagtatctcgaggtaccggtacctcacggtaccaaatcgtttcttatcgttgaatctagctggacatgatgtgcattgttagatccaacgatcgaaaacgatttagcatcatgaggtatcggtacctcgagttactttttgtcgtaccagagcaaatctctctttttttaaaagtgtcaatacaatgaatgtatgatggattcagaagtgtgaattgcatggttacttggcactgatgctttccttccatcatgcatggtttggtatggaaattaacaagttggcatgttgctattgccccagatgccataatgaagtttgacttaacttaaaattaaagaagatgctagtactttggctcagtatttgcctaattggatcagcacacacaaggatccatgtaagcattgtcccaatctgagaagctagccataaaccaggccttatcaatcaaagcagtaatttgttgcaatttcaagctttcagcagagtccatataatgtgcatcaaagagttgaccgtgcaaatacattttctgaagagagctcgcagtgtctgacttccagctgtacaatgacacatcaagagtgacaggtgacttttttttgctttagatttattcttaaacgagttcaagttagccaaaatgctctgcgtagctgtaattaaagtgattaattagtgcaggagcaacatttgggcccgttgaaaggttggtgttggcttttccagggacacggggatggattctccaagctttttatataacacttgaattaatattgcataaggagagtgagtgttacatcctcggtagcaggaggagactcaaagagtcgcaatctcatttttatatgaaaacgattttgctatccatctccgtgtgatttttttctggcatttgacactttgttttggcctccatgcagcttgcgatgcgagcggcaatttgcaagatcgatgttccatgcagctcgccggccggctggcacgtcggcctgtgttacctagctacccccgcgcgcgtgatgatggagaagcacggtgccaaggtggcctctgattgagctggccgccggcagtacggccactctcgtcgtcgtcgtgaaatataaagttacagtcatacataactaaaattacatttgtaaattcagttgatatggcatgtaagtgcactgtaattttaataaaaataatatgtaagtaaatatatatttgttattttctttaaaatataaaattactgtcctatatacctaaaattacatttgtaaattcagttgatatggcatataagtgcactgtaattttgataaaaataatgtgtaagtaaatatgtatttgtatattcttttgtagtccgttagatgtaaatctaagagtaaaaaaaatctgggtaatttttggttagaaatcacccgacaaatggatagacagtcccgtaggccgcggtgcagggccctgttgacgccaaatt

SEQ ID NO: 40313 - DNA, 353 bp, Oryza sativa
tgttactcgcagccaacactgtcgccagcccactgctggcagggaatccggcagtgataggccccacgaaccgatagtgttagccggttttggggctattggtgttggtgttaccgaatggaatggtggcttatatagtcctaatttccaatatacatgagatttataacatagtcagatttagtccctatatttgtaggggtattccctcaaaaaaaaatatttgtatgggtagcactagatgctgcattttgttcatctgaatacgtgaatggaagtcaattattaaggccgtgatgtaccaatgagccttgctagaattgcattgggtgggttaaggtatgtgctgacaa

SEQ ID NO: 40314 - DNA, 1501 bp, Oryza sativa
gtttgctttttcacccacgataattgatgtgtttttctcatttatccctgatttatgtggcattgtaatttgaagaaaatcaagtgtcctaagtaagaaaacatttataaaacacgtaatttgataagtttgcacttgataaaacatattgtaacttgaataaaatcaagtgtcctagtaagaaaaccttacctttataaaactagtttctaagtgtcctagtgtgggcaaataggatccgaaaaacttggtgttcggagatggggtcaaaagctatgatcgcatattttagcactaaacaagctcatacacacttgatttacccaggttttcgcgcctctcgagagatgatagttatattcttgctttcttgattaatatctggacaactttttgcaccggaggtgtgttagaactggctaagtccagagctcgtacaacttctacgtgttgtgttcttgtgtatctaggagagttgaacctttcactcggtgatctatctggtgcttataagttatatactctcccacaatctacctaatcaccatgggataactgacaaaggtactatagtcatacatcattacctacaccgtacccgctatcataccatccaccacttataattcttccatgctacaagatgccaccttccacaggtctaccatagaagtgactaggcctccccctgacggtatagcttggtcagatggagagaaaggagacatgaggggtgaggcgtgatacaccaaatccctacattaaatacctttgacttgcggtgagcatgcctaattaatgtggaatgatgggagcgagctattgcacgcttcatttgtacctgttgttagagcgtggtcatgtgatcccccaccgagggcgcccacgcgaccaaccattcgcgtcctcgagcaatcctcccgcgaatgaccatgagatggacgcattggcccctgaactgtcgcctccgagcaatcttcccgtgaatggtctcgagctaggcgcgttgccacatactagacccgagcaaccttcccatggctagcctctagcgggtcgacaaccacacgtcatttcctagccagtccaacctaccaactagttttctagtcaccctttcacgcagtgttatccgtacgctatcttgtgacctgaggaaaattgtaccgatatcttagcttccagcctagtcgtagggatatcaaggaaaattatactcattactttctaaaatcaagtgttctagtagtagtatagatgatgagaggtataaagtcatgtgtataccagattcacttcctccaatgtatctagccttttcaatgtactaatgcacacctaacagaaatggtgaaatatacacaccattcaccattacaaagaggatggagattggagaataaagaggcccaagctacaaactacacagtgctgtcaaatagtttttagggtgcgtttagttctttaggcgtaaagtttttgaagtatacggatgcacatt

SEQ ID NO: 40315 - DNA, 1501 bp, Oryza sativa
agcatgaaccatgagacgacgagttggtgtcctgcactcaagcttgttgagcctttgaggtttggtggtgataatggtgtggctcctcttcatcgacagatgtctttttatggcgattctgttgggttgcatttgtctcaatgtacctttgccttttttatataagatggtagtaatacactacactctatcttcctgtgtcctacactctctcttatactccccttcgccttccccttttccttggctccgatgagtcgtttctatctccgactattgataacggcggtaccgtggcatatacttcatcgtgatcattgtcttttttttttcatcacccccttctttcaggacccgttcttcttgtcatgatattgctgaccttgctcgttctgggcctccgctaccattgcatctctttagaccgatctccgtagcctgcttgtcctccttcatcacgcgccattcctatcctaaccgcattttaaaactaattagcatgattatatcatcggtggtacaaaataattttactcgatgaaggttgctcgggtggtctattcagtttggaataaggtgaggtacggattagaagtacggatgatgaatatatagatgtggtacaagtagcccagcaaagttttcgtttttttattagtggaacagtcgattcgtttagtgctaagaatacacgaaagaatttagttactgtcatgactttcttttataaatagagaatatttataaccgatagaaaatatattaatctcttatacagctggctaaaaaagatctaagttttactaagcctgttagcgaattgataatgtctacaactgctcaaatcgattaccaaattattgaatacctttttaaaacaaaaaaaaaactccacctccctaatcgtccaaacaaggtagcattcaattaagcaacctcacatatgatgtacaaatccgttttttccggcttttcgctaacgcggttgatttagaattcacatcgcccttgcttctatacttaaccatttccgttcgtccattttgttagatgcacaggttgctggcaactacaccgctggcaacatcgagagcactgtaaacagatcaggggttatgattcctgcctcaaattgagagagggtgatcatcaacacgacatataatttagatcggattacctgaaccaagtcaataatgaaacatgcttctctccgtttcacaatgtaagtcattctagcatttctcacattcatattaatgttaatgaatctagctagatacggaggaagtatctttcttttaggcgcataatgcagtttatcttgttctacctacccacacttaagacggtgacgttgtttcctttgtcaaggtaagagaggtgatgcaacatgaggagaaaacggtggccccattctttgatgaaatcctcccaacaactttggttcagagagttttgtcatcagctactacccagtttcacttactgatgtgatcct

SEQ ID NO: 40316 - DNA, 1501 bp, Oryza sativa
tgcctttgcctgctgctagtactagttgtactactgtgatctgaacatggagctttgcactttttcttaagaagatatcaaatcatacagctagtgacaattaacaaatcagattgtgatttgtgcaatcgatccatatcgaggtcattaggaggccagagacgctgcaatttggtgcttgtagttggagaggaaatcaggaaactgaactggcacctaacagcggcactgatacagcagcagcagcatggatactgcaggcgatgaggcgtggctgcatgttttgcgaggaccgaacgaacgatatggattgcctcgtttcaatatccatcaaaaaaaaaaaaacaagatagcaaccattccatacctgtcgctccagacaaacagtggctaccaccaaacctgtcaaaactaaaatgataatgagaagtccgcaataacttcgtcaattttaacctgtgacaacacatcaagtatttgtaaaaatagagtgtgcgtgtttgtttataggatgagtatgcttgtgctgtgagcgcttacgtttacatcgtgttttttttaaaaaaaataatcgctctgttcttttcaaatttgcagcccgtgtcttttgtacgtcaggatcacatcagtaagtgaaactgggtagtagctgatgacaaaactctctgaaccaaagttgttgggaggatttcatcaaagaatggggccaccgttttctcctcatgttgcatcacctctcttaccttgacaaaggaaacaacgtcaccgtcttaagtgtgggtaggtagaacaagataaactgcattatgcgcctaaaagaaagatacttcctccgtatctagctagattcattaacattaatatgaatgtgagaaatgctagaatgacttacattgtgaaacggagagaagcatgtttcattattgacttggttcaggtaatccgatctaaattatatgtcgtgttgatgatcaccctctctcaatttgaggcaggaatcataacccctgatctgtttacagtgctctcgatgttgccagcggtgtagttgccagcaacctgtgcatctaacaaaatggacgaacggaaatggttaagtatagaagcaagggcgatgtgaattctaaatcaaccgcgttagcgaaaagccggaaaaaacggatttgtacatcatatgtgaggttgcttaattgaatgctaccttgtttggacgattagggaggtggagttttttttttgttttaaaaaggtattcaataatttggtaatcgatttgagcagttgtagacattatcaattcgctaacaggcttagtaaaacttagatcttttttagccagctgtataagagattaatatattttctatcggttataaatattctctatttataaaagaaagtcatgacagtaactaaattctttcgtgtattcttagcactaaacgaatcgactgttccactaataaaaaaacgaaaactttgctgggctacttgtaccaca

SEQ ID NO: 40317 - DNA, 1501 bp, Oryza sativa
ctgctcaggctccagtatgcaacacctctctttagaggggctaaggccattacgggcaccagtggacaaattggcttaggcatatccgaaaggggacgcctattggcaattcaatatgtgtgagcattatggtacaagactaccagtgcagagcctttttgggacactaacataaaaacttgggtgggtatccaaattgtagggtcactactcactgggtcaagcagataagttctccatcttccaacattctttttctatactccacagtacacatatctgcacacttatttgtgatatggaatatagtaagcattattctggcaaagagaagacacctttttttttctggtttgctattatgaatcagacggcaaatattgcttccggccgagtcatgtcatgctgacttcatgtttagcaaacgctaatatgctatatgaacatatctttgctcctggcccagaagatgatgatgttccacttgctacatacacacattgtgccttttgtcatgccccagtgccccaatcatatactaccggtatgtacagactacagagcactgagcccggtcgtgaggcagcctctgccctcctgccgaggaaagccgacgctattgccttccccgcactgacccatcatcaacaactcaactcaaaatcacaaaacgccttgaccgcacactgccatactattatgtgtgtattcacttcgcgagctaggcacgtagccacttcgccctggaatcaagtgcacgccccgctcggctcggccagtggtcgcgagctgcacgccgccgctgcctgcacgcacgagcgctgcttcatttcttcttcttcttcactcctaccgtcgatgacgactaattaaccgccaaccccactaccgcctctctctttgctggctgccattgcctcctctcttccccggcaaaacaacttctctcctattcccacctcttttcacccataaagcggaagtggatttttgtcgggacatcctctcgttttgtgcgtatcgtttaaaaagttatcaaaatttttttaaaaaaaattatcaagatatatattgtgatcaatatatgatatatcttttcgcaaacatgcaagttaaaattcgacatatgtaatttgaaacaaaaataacaaacaaatttaaccgtaaattacgtgttcttttcacagttaaatttgctatttttgtttttacttgtataagttgaatttgaatatgcatgtttgaagtgacatatcacatatagggtgtgtttagttccacgctaaagttgaaagtttgattgaaattgaaatgatgtaacggaaaagttgaaagtttgtgtgtgtagaaaagttcgatgtgacgtttttgggattcaaagtttggaactaaaccgagccataatctgctacactaaattttttaccacctccgtcccaaaataagtgcaaccatagatatccgtgtccagcgttttgactgtccgtcttatttgaaaaaa

SEQ ID NO: 40318 - DNA, 1501 bp, Oryza sativa
cttccacgaactatgtgagttggtatgggctgtgtttggatccaaacttcaatcattttccatcacatccacctccacctgttatacacacgtaacttttcagtcacatcatcttcaatttcagccaaaatccaaactttgcgctgaactaaacacagccaaggtagcatcggaccgattactcggttggcgttggaacgggtactcatgttccacgctgttgttttcaacaaataggaagaatatgtccatgtttggacccataattcggcttgatttaaacatgtcgtcgtcaaatgctagcatccactaatctgttggtttggatacttgttttcttcgaaatgacatcgtatctaaacaaagcagcatgaaagtgccagtcctccaaattgaacggcatgaaactagtagcttgcatgaccaaacgtatttatggccatgatatatttaagagaaaaaaatcattctaaacagtatatatttactgaatgtactagaaggtccaagcacataattactccatcaattttaaaatataaggattgttacaataaataatttatttttttcacttcagttgttagcatttgaatttcgaattacttgtatttcttttgggaaattttgtaaaaatacactcgttatgatcaaaattacacaaaactacaaggattttgacacatagcacatgacccataggtactatggatataaagttccacaaaaccacattgtaaccaatttgacatactcatatatcaaatttttaaaaggccatggatgtaacatttatatgatggataaataactcataaattcgagatgcgattgtataacttaaaattatggtaattcaaagttagaatgataaatattgtgttttttgaaatgaccataatacatatgtttatgtgctaaaaaatcgtatgtttttttaatttactcaatttgttctaaaatttagtactagataggacacatcatagtactataaatctcgacagaaattcgttgggtattatatgctctatgttcaaattcgtagtactataatgtatcccatctagttataggttattattatttgtgattaagaggtagatcataatacgggtggttaaatgaaatttacttattctctctttccaagcatttgattagctttaaaattattgaaatgatgggaatcacaaaaatcagtgaaaaataagaatattatggtgtaaaatttaaatcttaaaagtatagaaatggaaggagttattccaacaccatcgggcatcacttgcccgcaaaattgcaataactcaccataatatttcaaaataattcgacggaattcattcgctcgcgccgtctccgaaaccgaatccatttcctgatccagcaaaggacacagagagagatcccatctcgtcctcgtcgcctccgcctcgtgagctccactcacctaccccacttcctctcctcgcttcggccgcggccccaaaccctaacc

SEQ ID NO: 40319 - DNA, 899 bp, Oryza sativa
cgaacgcgtcacgccgcgtgtaatacggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtggaagtggaggtaggtatgggccgtcccgtcagaaggtgattcggatggcagcgatacaaatctccgtccattaatgaagagaagtcaagttgaaagaaagggagggagagatgatgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctctcgcgaaccttccacagattgggagcttagaacctcacccagggcccccggccgaactggcaaaggggggcctgcgcggtctcccggtgaggagccccacgctccgtcatctggcgcgccaggtagggggctctgtgagtgatcttctgagctctcgcactctttcgtgttcgccaagcttttcctgttcagcccaa

SEQ ID NO: 40320 - DNA, 1501 bp, Oryza sativa
cgtcgcttctcttcttgaagacgttgttttggcatcccctagggggcgatctcgtctgtgtccctttgttggtctaggtgacggtcggtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaagtatactctctgaaattttctcgaatttttcgaagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaagattttttttaatttgctaaatctcaatataaaattgggcgagataaaattttgttaaatacttctcttgaatctttagttcctagatttttctggatttatttgagccaagaaagtatttttaataaatggaattgcatttcatgaataatttaaattgaaaaaggtttttaaaaagtctcttttggctttgggccgaaagccggcccaaaacctctctctttctctctccctccccggcccagtcggcccagcccgtcgtcgcttccttctctctcggtgccgctgacaggtggggcctacctgttagggctgtcttcctcctccagccgtcgcctggccgaaccctagccgagctgcgccgccgccgcttcccttccaaattccgccgcccctctctatttccggtcaaattgattgagggcaaatgatccttgagatctcctcttcctttcctcttttggaatcatcgcctaattcggtttggaaacttgtggattcgatctcgaatcggattcatctctctcccctaaccctagactttccttctcgtcgccggtcgccgtgggccttcgccgccgccttccaacccctatataaggatccccaagctctcctctacccgccgccaccctcgccttcgtctctcgccgtcggtagcgccctagcgccgtgtaacctcgagccgccgtcgttgccgccgctccagccgtgcttcgccatcgtttcagtcgtcgccgtcgctcgggaaggtcgccatcgtggtcgccgtcgcgtcgccgtcctcgtccgccccttcgccgtcgctgtagaccgccggagcatcgccgtcgtcgtcaagccgaaggactccgccgccttttcctcgacgccgccgccgtccgttcatcttccgccgcttctttggtcatcggtgagttcgccgcgtcgctctctacgtgctggtgccctccgttcgtgccgtagtgccgtcgttcgccggcgagcaagtgcgcccgagccgccgccggaggtgacatcaccgctgacgtcgtcgtcatcgactctcgtgg

SEQ ID NO: 40321 - DNA, 399 bp, Oryza sativa
attttctgtcagagtaaagcgcacaatccgttggaactaaaccaatattcacaggtgtgtgtagagaccagatattaatcgtagtgaagaaagaaattgcagtgggggcgtgctgaactcacgtacatgtacatcgacgtcctcgtagccacaggcagcgtcgttggcaagacaaggtaacgtacgaccgttgtcatcgtagacgcttcccggattggaaccgccacgtcgtggattgccggcgaggcgagctcctccggagacgagaatagatatcagtgtgcatcaagatgatgccgccgcttctggccactccggggcaaacccacgatcgaacaccttgagtgcagccgtcgttcgttgttggtggtggtggcgggcggaagatgcggttgcagg

SEQ ID NO: 40322 - DNA, 1501 bp, Oryza sativa
aggaggaagttctttgagccgcaaggactcgtgtcattatcaaccagcacgactcgatcaagatttgccagctccatgacatgctccctcggattggccaatgtcgcggtgcagaatatgaatgttggattgcttccataaacatatgaacagatgcgctttaatcttctcagaatcaacgcagcgtggcagccaaatgcgcccttgtaggaatgcgcctcgtcgatgacaatgtacttgaggttgaagaggaccctcttgaactgagcatggcatggcaagatcgacatgtggagcatgtcagggttggtgatcagcagcctcgcggtgttcctgatccttgtccggtctttcatggcggtgtcgccgtcgtagatgctgacgtcgaagtctgagcggaacgccggcttcatctcgagcagtgtcttgagctggtcttgggccagagccttggtggggaagatgtagagcgcgcatggcgcggagctctgggagatggactcgaggacggggatgttgtagcacagcgacttgccgctcgacgtcgaggtggacaccacgacgtgctcgccggagacggcggattgcacggcctgcgcctggtgggcgtacagcttggtgacgccgatgcttctcagcgcgtccctcatggaggacgagaggtggccggggagttcggcgaacgtcgcctcccttcccgggatctcctcgacatgggtgatctgtccggccttcccgagcccttgcctgagatgctccaccatttgggtagggtcgagaggttgggtgccatggcaggagagcggcctcggcggcgctgggttcgtcggcttcttggcgtagatgtcttcgccgccgccgtcgtgccaagaaaacttgcgtttcctccatggattcggcgcgctcgacgacggagggtgcggcggcgctgacttggcgttgaccgggatgaaagagatggactcgccggggccgacggggaggttgccgaccttggcgtcggcgatgagcttggtgcccttgaggaagaggtggaagtcgggggaaaccagcgcgggagcgaaggaggaacggagcgccgtcctgaggtcgctgacggtggcggaggcggcgatcgtgacggtggtggagcgcccgtcgtgggcgcgcacccggatgactctcggctgcgccattgccgtcgccgttgcggaggaaggaaatccgcggcggatttatagccaaattacgcgcaatgccgcatcggaatcggatctgctgcgatactccacatagaaaccaactccgatgctgtgaagtttgaacgtggccgacatcgccggtggcgtgctgccgccgtttagccggcgccgcgcactcatcactcctccatggggcttgggctgactttaccacgccggctgcgtcgatgagattgagaatttgaggcccattccaatttattcccgcacggtaaccctggtaaattttggcccgttttcatgctcgagagaaaggccca

SEQ ID NO: 40323 - DNA, 824 bp, Oryza sativa
attttctacccacactcatataaatattaatgaatctaggtatatacatatatctatatatatgtgtgtgtgtgtgaatatgggcaatgctagaaagttttacattatcaaacggatggagtataaacttaaaaataaatttatctaaatttttaaaatgacttgtatataaaattttcataaatggtatatttcgtggtttgaaaaaacatgctaacggaaattaagataaaatatgtatattgacgagaaaagaatattgcctaagcggttatttctgttctaattgagaatttgacagcaaacagaggatcaccattcctctcaacaaggaaaatataaaaaaatgttgctaaaaaaaggggagaaaacaagatcaccgttactcctcgctcctcctatgctccaagattccatttaatttcttccatgttcttgtcgatcacctgctccatgatagtgttggtgttacgagtaagatatactatatgctatacatggttcatattatatggaaatagcatatacctaatattataggagaaagcatatgcaaataaggtgataaagcgagccttcaatccatgcgaagaggatggcacatatctagccttgagcttaatcgatatcgtaagggaaaggggttcatacaagtatatactagaggtttaaccgagatgatctttgtgcatgcccggtcgatcaatacattctgctaggggccgctgttgacacgtagaccgaaaaggagttttcgggttgcagccgagtgtacataaatctacagggtcgcacgcttaatgggccggaataaggggattaga

SEQ ID NO: 40324 - DNA, 1501 bp, Oryza sativa
tataggaatacaatttagaagtaactgaaattcgaaattgaaaattaaagaatattaaaagataagtttagagtccacatagaaatataattagaaataataaaaattcagaaataaaaataaataatattggaagaagagcatagcgtctatatagaaatacaatttatagaaaattcggaattaaaaaaagaaatattaaaagacgagtctagagtctatacaggaatatatataatttaaataaggaatattagaagtagagtatagagtccatatagaaatacaattaggaagtaatagaaagttggaattaaaaataaggaatattagaagtagagtatagagtccatatagaaatacaattaagaaaaaaatagaaattatgaattaaaaaataaggaatattagaagtagagtatagagttcatatatgaatttaaaactaactaaaatttggaataaacataataaaattaaaagtagagtttagagtccgtataaaaatacaatttacaaataactaaaattcgaatttaagaaaaacataggaagaagagtttaaagtcaatataggaatacaatttagaagtaactaaaattcgaaattaaaaattaaataatattgaaagataagtttaaagtccacatagaaatacaattataaataataaaaattcagaaataaaaataaataatattgaaagaagagcactgaaaattcagaattaaaaaaagaaatattaaaagacgagtgtagagtccatataggaatatatataatttacaaataactaaaatttgatattaaaaataattaataactaacacgtatataaaatacaatatgaatattacacattagtggttttataaagttattgcaaaatttaaaattatgttgtcattttaatatatttaaataatataatgagaaaacatatatgctattatatgaaagaaaatataatgatgctagccgcacaatctgcatggggcaaccatgctagttttttaagtaacatacagataacgagagatcgaccatccctagagtgatcaaaattcactcccaacagtctgaaactccaaaagaaataggtcattttctatctagtacaagaggaattgaaaggacgtattagatgggaggctgctacagggatggacgtcacgtcgccggtattaatctggaaaatgaagaaaaaaaatccggccgaatccccctagaaatcccatcgcgcgcctgcgcgtgtggtgacgccagctcgtggcctgcttgggtccgtgcatgcatcagagcagaggcaactactacgacctcgcgttcctcgtccctatataaaccccagaccaccacctccactgcttccaagaacagatgccatcctgagcttctagctcgcgagtgatctcttcttctagctcagtaaccacagctacaacctacagcttacagtgtccgcaaaattgtaacattgtgtccttccatcggcaacaa

SEQ ID NO: 40325 - DNA, 1501 bp, Oryza sativa
ccggctctctctctcctcccctcccgcgcgcgcgtgccttgggccgccttgggccggccggcccatttagctcggccgaaccgctccatttctctcgggccgcgccctagccgcccgaggaaagtctaatttccctccctcttttcttttcttttcttttccaaaaaggatttaattaaatcctttttcctttagaccaaaaatccaataatcttagaaattcaatatcttcccaaccgtaaatccgtttgactccgttcaacttccaaaattcctcaaatctcgagatctaactaatggcacacttagaggtcattaatagggctttatttttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatttaattatgttgcttgtaaaatattatgcattgataggatcgcacttaatctgttgtcccgtctgcaaggcagattggcggacctacctaatttgttgcatttgatccttcctttgttaattgttatatcatgtctccttgtatccatctagttgcgtctcgatattcgtgcaccctgtgcgagtatcgacggacgccttcaaacttaaaatctgaataacaacttgggtaaaacttgggttttacaaaagacttggaaaacccgacacctgggtcggtgcttgtgaactaaatgaatttccaaaaccgcggaccggggaacgtaccgggtgtacggttttccgctcttgcacttaaggaccgtttccttggaatttcatccaaacataacacaagtacgaccacatgggtggaatgggacacccctggctgagtaactagcttatcaggggagtcttgatgccgagagacatgtggattcgccggggtggtgtcggggaggacccctgggcttcctgtcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagagattaacaaactgttcgaacagccgtgcccacggtcatgggcggatgtgaggtgattcctagcgtagttttgtttgactactgcttgcgaaattactgttgtggaaaggggttcgatgtttaaaaaaaaaatctgcagctgatgggatcagctaggcccgggtggccgtttgaaagtggttggcccgggtggccgtttgaaaagctgttggccgggtgccaaccttgtttcaattctaaagactgatacattgcacatactccgaccggacgagacgcactgtcccatccgtgtcgtttgagaagcactcacttagttgttttc

SEQ ID NO: 40326 - DNA, 1501 bp, Oryza sativa
gctgagtgcccccaccccaactcacatctacagatgaacaaatcttgcgagcaacctgatccataaaaatatagtaacatcattgactagccacgttttttagcaaattcgagagggtaatcaattgtgtaatgatacatactgccggcaagcgttcaatagtttgcgccttcatacactcccccaaggttgcacgacagaattcacacacaaggttggtattgaacactgaatattcagcaaccaagagaatggcacagcgacttaatgcattcacaagcagtgtcagatacttcctgctgacatcctcagccagaatcctgcgcacacagaagtacactttaaaccactcatttcctattttattaatcaaactgaatgcaaagcttagctgagcacacaatctcaccgaagccatggctggagttggtcaacaaggctgacaacccgttcgtatggggcagcttccttcaccttgcacttgctggcacaattagcaaagcacacggtgagctcaatcgcgaggatggtgacttcagggtccgcaccagcctcccctgagatgccaggatcaggaaggagggaagcaaaactcgcagtcgcagcacggcgagactttgaggccgtcggcactgacagcacagaccgaagcgaatccagagtggcagcagcgtccgcctcggcgcgtgcgtagtgtccgcgcgactcgaggcagcacacgaatcggccgcgctggagcagcacggagtagggcttcccggcgaggcacgccgatatgaccgcgaggcagtcaaggaggagggcgtaaacgtcgagcagctcgtcggtgcacccggcgtcgcctgagctagggttggggcggagtagcagcgggagtacctggagcgcgcggcacaggaaggggaggaaccgcttagcgagcgggcggaccgtggccgcgtcgggtggcggcggcggcggctgctgcttgcgctgcttcgccgtcctcttcgccggcggtttggcgctagggtttagcgtgggtaggtagggggagaagggctcgaggtaggcggcgaagcgggaggtcaggccggattgggaggacggggaggagagcgcggcgaggaggtcggcggcggcggcctccattgccgtggtgcggattgcgcttgcggcgccgcgtgtggggaaatttttgtgcgcgtatttggggatttcggggacggggatgggcgggaaaggaggaggatttcggagctctgcgcgctggacagaggagataggacggtggggaccggcgaggaggaggcgtacgctggaagatttgattaatgggctggtaaattatcttgtgggctgccagtgggcctattctgatgacctctatatgggcctcacttcaattcaacaatttggttagtgatgcaagaagaaaacattagccatttccaaacatttgaaaaatatcaggcagaggagtgagttttgccgacagtcaacacaatgtaataacagattg

SEQ ID NO: 40327 - DNA, 1501 bp, Oryza sativa
gtttaatgcaggcttcaaggaaaggctgttgtttttgcaattgatttttatttgaactcttttctgaaaacaactaagtgagtgcttctcaaacgacacggatgggacagtgcgtctcgtccggtcggagtatgtgcaatgtatcagtctttagaattgaaacaaggttggcacccggccaacagcttttcaaacggccacccgggccaaccactttcaaacggccacccgggcctagctgatcccatcagctgcagattttttttttaaacatcgaacccctttccacaacagtaatttcgcaagcagtagtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgacaggaagcccaggggtcctccccgacaccaccccggcgaatccacatgtctctcggcatcaagactcccctgataagctagttactcagccaggggtgtcccattccacccatgtggtcgtacttgtgttatgtttggatgaaattccaaggaaacggtccttaagtgcaagagcggaaaaccgtacacccggtacgttccccggtccgcggttttggaaattcatttagttcacaagcaccgacccaggtgtcgggttttccaagtcttttgtaaaacccaagttttacccaagttgttattcagattttaagtttgaaggcgtccgtcgatactcgcacagggtgcacgaatatcgagacgcaactagatggatacaaggagacatgatataacaattaacaaaggaaggatcaaatgcaacaaattaggtaggtccgccaatctgccttgcagacgggacaacagattaagtgcgatcctatcaatgcataatattttacaagcaacataattaaatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaaataaagccctattaatgacctctaagtgtgccattagttagatctcgagatttgaggaattttggaagttgaacggagtcaaacggatttacggttgggaagatattgaatttctaagattattggatttttggtctaaaggaaaaaggatttaattaaatcctttttggaaaagaaaagaaaagaaaagagggagggaaattagactttcctcgggcggctagggcgcggcccgagagaaatggagcggttcggccgagctaaa

SEQ ID NO: 40328 - DNA, 1501 bp, Oryza sativa
taattaaaactaaatcaatcatacgttaatgccaccttgttttgcataaaaaacttaatcttattgatccatatagcggtgttaaatttgaaaataagaaattatgcataagaaaaaataaccaataaaaaaagaaaacaaatccaatttctaatactttcaaattatctatcctctgtaagataatatattactatgttgattttctaatatatagttcagctagttctctagtttttttaaaatacaacgttaacaactcggtatttttttccaaacataactgctcgatcagcgtatgttgcattttttttttagcaaaattactgcagttagggaagctgatgttgccaagtcagcatggtcatgccgtatatgccttaatgcagaggtatcgtgactataataacatgtggtaacgttctttgtaatcgatgctcaagttcggtttcaagatgctcatttagccaccttgattttttttaagggtctgtgtatacaactttcgctgctacttgtatgtagtcacggtagttgcttaactggaaaactataggcccgtaaatcatgggtgtaaatatacattatggtccatgtacagctacgatgcattttactgtgtagattctttaaaaaattgaagtgtttggtttcagtttgaggcgaaatatatatagttataagccgctcagtggaggggcaaaattcaaaacagcaaatttcgaagtacaatcattctcttagcaaattgttgcatggttggtccaggctatagatggccaaacgagctacccgatccggcacggtctaggcacaacccggcttgggtcgaggtcagttgggctgacacaacccgatctacacgccgagctaggctgtgccatgtctacccacgggctacacctacggcccaagcagggctgtgccggtccggtccgaaggcacaacagttcatcgtgtttctccatagaataattctgtttttcttccctcatctctttgggttttgtcttatatggctgaaatttgtattccttgtctttgggctgcgacttgtctggctgaattaagtctattttcgatccttgtagtatttttattgactgtgccatgccgggccaacccaacatgccaaggcatcagcccaggcacagtccaactgttggaccggggccaagccaaatggacgtgccgtgggccgtgccgtcgggtccggccatatggccatcgatagtccaggcgttgccgcaaccggggcaaacagcaaggggaaaatatctgtgccaagcagcaagagcaaaaagcgaaaagcgcaacgccgccgcgaaatatctcacctcacgtagctctcgccccggaagacgccacccagcgatcacttctgctgtactactggccagtgaccagtcacttacttgctcttctcccccattaattgagctccagccgtccgggagacgagataattccgttcaatttcaagttaatcccgcggcagcca

SEQ ID NO: 40329 - DNA, 963 bp, Oryza sativa
taattataatttattttattatgagttgttttagcattcatattactttaagtgagatttatatcttatgcatttgcataaaatttttgaataagacaaatggtcaaacatgtgataaaaagtcaacggcgtcatctattaaaaaacggagggagtattaatatattttttaagtttataataattaaaactaaatcaatcatacgttaatgccaccttgttttgcataaaaaacttaatcttattgatccatatagcggtgttaaatttgaaaataagaaattatgcataagaaaaaataaccaataaaaaaagaaaacaaatccaatttctaatactttcaaattatctatcctctgtaagataatatattactatgttgattttctaatatatagttcagctagttctctagtttttttaaaatacaacgttaacaactcggtatttttttccaaacataactgctcgatcagcgtatgttgcattttttttttagcaaaattactgcagttagggaagctgatgttgccaagtcagcatggtcatgccgtatatgccttaatgcagaggtatcgtgactataataacatgtggtaacgttctttgtaatcgatgctcaagttcggtttcaagatgctcatttagccaccttgattttttttaagggtctgtgtatacaactttcgctgctacttgtatgtagtcacggtagttgcttaactggaaaactataggcccgtaaatcatgggtgtaaatatacattatggtccatgtacagctacgatgcattttactgtgtagattctttaaaaaattgaagtgtttggtttcagtttgaggcgaaatatatatagttataagccgctcagtggaggggcaaaattcaaaacagcaaatttcgaagtacaatcattctcttagcaaattgttgcatggttggtccaggctatagatggcca

SEQ ID NO: 40330 - DNA, 1501 bp, Oryza sativa
tgcaaggagacatgactcttctacaagaaaggacgcaacaccccggagcatggcgcagctgcgagatgagggtgcgggttggggcagcgtgtctaggagctcatggcttgagcttggtgttgcggtcccctcgttccaatcagtacgtagtacaagattgacctctcgccctaatctcacttcgttatttggtaaggctagaaattacctctctatgactgttgggttctggctacttgcattatgggctataacatctttaacatatgctttggattgactatgacccatctaaacattttccatgccatacggagcatatgcgctttttttttctcgtgaaaattgacaaattaaaatgcaccgaaatatcacctttaattggtactattgattaggtaccaatttggtacaacccttaatacaaggccactatataatcctaaagatcagcacaaacgaatatagcagtatcaatgccaattactcctgaaattaaacccgttcccgttatccatatccatacaacttactgtagtaagtgattccaaaaataatacgaacaacaacactataaacgccacactcccattcggtacacctaaaagaaacaaagctgcagctaagcaccggtagcagtagcagaagtcacaaggaaaaaaaaaagccaatggcgtcagagtcagagatgaaggccttccacgcagcactgctcctcctcctggccatggtcctcgtcgcatcatcttcatcaggtagtacacaacactcggagctactactctctctctctctctctctctctctctctctctctctctctctctctctctctggcttgtgatcagcttggtttgaaccttgaacgaaatcgcttcaaaattcaaaaaaattgaacgaaatggcaggcgtgatggcggccaagatagcggggcccaagtacttccaggacacctgctcggcggtgttgaacccgggcgccccgtcgtgcgacagcggcgagtgcgcgaccaattgcccgcggcagtacaaaggcggcgtgggccagtgcatcggcacgcagtgcaagtgcgtctacacctgcgcttccccggcgccggcgagcaactaataacccggccggccggccgatcgatcggtggtcgatcgacgacgatgtgcagtactgtgtgcacaggggccgatcatcactcacgcgtcgatcaggcttaaattttacatacagtgtgacgcgtgcgattgttaaattttgtgatgcctggagagatgttgatgattaaataaagagactatttatatgggattgtcctattttcagcagcgctaaatagaacgctgtgtgaacctctctctgttttttttttggtgtgtggggggggggggggtctcatgtgcttcattacagcgttggccacgagagagttcagttgctttgtttttgcagattttcttttagagtgaatttagttaatatggtcctcaatttagttcctaacatttt

SEQ ID NO: 40331 - DNA, 387 bp, Oryza sativa
tcgaggcaactgaatttttagagaaccgttggttcccacacggacgccccacgaaaggacggaggtagcgttgggaagcgatcgggaactgaatagaagtgttcaaccgaaaagaccggaagagatcgggagggcaaggataggatatagagaaaaaacaacctgcaccatctattaaattgaaatcaatatgtttagattaaggttaatatgaaatttaatattagttatgtgcgacatacgccatgaatctttcattagttagatgcatcaatagtggtctctgaaaaagaaaaaaaatattggttggtttctttaagtatatttattttgaattgtcatcgtgcttagtttagatatatatctaagcactacttttcttttagt

SEQ ID NO: 40332 - DNA, 224 bp, Oryza sativa
ggagtttttttaatattttgacaaggtttgttctaactattttttgcaaaatctagcttcaaaatatatgttttgatgggcaaattttgcatgtaatcaattgtacatactagttacatgtattgttgtatttttttttgggagacaaatgcatttaaacttttgtatgaaatacctgcggtctatttttttatctgtaacttttttgcctttatataattaga

SEQ ID NO: 40333 - DNA, 1501 bp, Oryza sativa
gctagcaccgttagcagtagcatcgatcagcacaagtgaaaaaaaaaaatcaacagcgtcagagatgaaggccatccacgcagcactgctcatcctggccatcgtcctcgtcgcttcatcatcatcaccaccaggtacgcaatacttggcgctagcttgtatccatctctggttttttttggtgatcgaggctagcttgtgatcagctgcatggttgggttgaacgaaatggcaggtggcgtgacggcgcagctggaaacctgcacggaggtgatcaaccgggaatacccgacgtgcgacagcggcttgtgcgtggcgaactgccagcggcagtacaggggcggcattggccagtgcgtcggcaacaagtgcaagtgcgactactcctgcgccttcctgccgccgccgccgccaccggcgacggcgagaaactaaccggttggtcgacgatgggaaagcacggcggcgcgtgtcacgtacttagcttacagaggttgaatcaggattaatatatttactcctgtgttttagtacagggtgacccgcgcgttgtcagtattgttatgctcggagaggcgtttgatgaacaaataaatgaaagaaagggttcccgttctcatggtatacatcggtttgcatgggaaagctagtcgtttcacccctcaagtggaaggccatttgacctcctaagtattggctacaataattatattttcatagtaacatacctttttttaataattaatattaaacttgacctttgcttcaactaaagctaaatccacttattacaaagtttttggcttgaaactcaaacacgacagaaataaacaaaggtacatgaaaagatgacacaatcacaccaaccaagaaaaataacaacttattcaatgattcggaatttctcgtgcacgaaaaagaagggatttcacaatacgatttcactacatccccaccctgcgctgctgactacccatcccagtgcgccaccgctcagccttgtcggcaccggaagccgccaatggctctggcatgccccttccaagcatgcaattcaactcctcccttctacccctctcttgtttgattttttttctcccattccagcaatgtcccggtcctttctcatctccgacggctagcgccactaaatccatcccctccgccaaccgtcaccttccatcctcacggctcaagcagcacccaagtcacctacctgtctctgcacccactaagatgtttccaccaccccatccatccctctaaagccaccctccaaaacccctaccctgctccaccatggcaccaacttctaaccctaaaactataaaacctaggtcctctgctggagttttatcgtccgaggtcacctccaccgctgtcaggggaaactcgtcgccaccgtggtgggtgagttacccactccttctcacccgagctctaggacgactccgtgacaatccaagagccatggagcatgtgaatgacaactatgtcttat

SEQ ID NO: 40334 - DNA, 1501 bp, Oryza sativa
tgtagatattaccaatatatagttcttatatcgatatatatttaaatcaagtgattgggatagatcggtcgccatgccgagacagtataaatcacctggatcgaaatatatattaataacaggactatatatgtttatagcatagccgatcatatagatctagcatgtatcggctaatactccgatactactctatatcaggatattaaaacaagtataatatatcaaataaaagcttaatatacttaaatataataagatctttgacataaagggcggatttaacatgtcattgaagcatatagagcgaatatagttaaatcaaataagataggctgaaactccgatactaccctaatcggcaaccagaaggcaggctagagattgatattctaagcacgacttaatagatcaaactcaactgatgcagcattaagtatgaaaagaagaacaatatctagacaatcaagccgctggaagtttcatagagtggtagatttcttatataatctaaatcaacatcaaaatctaacctaatcggctgccctctactaacagatgttagccgattataggttagatagcgatattgccagagattatgtatgatatatgataactcgacgaattacgtaaacaagattagagtatcataaagatggaagcactaatcccgagaacacaagccgtcataacaagttttacctcttgttgaagatcgaaaccgatgcagctcaacccgaaagcaagaactcgtcgaaataaaactaaagcaaaaagatggcgatgcgccgaaattgtattgaacgtgtgtgtcttttttacatagggctcagggtctatttatacccgagaattacaagatatgtccatatcggacacgactattatctctaacaaactctaagataccataagtctttgcggcagacttttgccctaagcatatctctaaggaaattacataaaacatcctaattaatagatacaattgccttttcaggactctatgcacgtgcagcaatcatcttgaagcatatcaactcaaacccaatgttggatacgagtcatattgctggaatcggctatatcacctaacccagtctgattcagatttagccgattctagtcgtagccgatctcgatcccatcttcacctccgatgttgatattaccaaatttggtcgttaacaaccacgaaatagtgtatttcgtgcaaaagtctttatataaaagtttttataaaaaacaaatttatttttaaagtttataacaattaatatcggattaatcatacatgagtgacttatcttgtttttgactgccaccgcaaatttcggttgacaggcagaacgagcgcagcctttactcctactacttatctcttcgatgatttatattccaaacgttctccatgtcacgcggtacatgcgctttccattccttgtgaaaattgacgataagcaccgatacatcaccattagttgatactactatacaa

SEQ ID NO: 40335 - DNA, 1501 bp, Oryza sativa
ccaccatgtcctgcaattaaacttggtagtggtaggattgtcattttcttcagcactaacaccgaagatgaatggatcggactgagttttcaaagaaaaagaaaaaggatcagacagaccatgaaaagcgattgacgcgaaaaaaaaaagattaactagattaccttaaattcatcaaattaaatgatgttacacaggcaatacttgagaaacaaaaaaaaacttattaaaattttaaaattcgtaaacttctaagatattacagaaaaagtaaaaatgacggtatgtaaattcaaaagtaacctaaggaacatacttgatgtgcggaccttagttttataaaagggtaatttttttatccttaaaaaagtaccggagttgccatattttctagtataaaatttgatacctcgaggcacataaaatttagtgtaaaatttagatgcctcgaagtactttttcaagaaccataaaatttctctttataaaatccttgagcatgataagttattgagtgtaagaaacatatataacaattgaccatcttctatggatttaaagatgcataccacatcaccattcttcctccattggaatatccttgatcttgatggcagatatactagtatatgggccctatttggggttgtcttataataggtgtggcttctttcagaatctctaattctctcaacagtccaagattttattcagattatgagagtatgtattataaaattcagaaaataaactagaaggtaaaagttgggaagctcatctttttgtattatcaccagctaactaatcaccacatgcttcttaaaatagttgtgatcgaagtgatagacttaattgaccctgcaaatcaacacaccaattattggagcctctaaatttataatcgcggactaaatgattgagtatctgagacaagataaatgacacttggtaaataaagcccaataattttagaggaaaatagagctagggacgagctctggtcgtgggggtggagaaaggttcacacttgagatgaggcttaactattacaaggtccaagactcaagttaaagttcggtttcagcagtaccattgtcttgttttgacgatatccgttaactcaatatgaatttcgatgtaaggttagatgaagtggaaatatgacgaggtaagatttccgtgaagtatcacaaagtgatatcctaatcataaattaagaggtagcacacgccttatgtccaaaaataaataaggtgtaaaatagcatgccttattttggcataaacatatgttttagatctttattagaatcaaagtattgatggtatatcttatcccatgaaaaataataacattccgatatggtaaacacaacatcagtataaaacacctccattacacacactgtatatagtactaccggaggtagagcaccatcagacacaagcaaaattcaggatagcaactactgatccaacgctcggccaacgtttgctggaga

SEQ ID NO: 40336 - DNA, 1501 bp, Oryza sativa
gtgaaggacagaagtgaggagagagattatgagctacttctaaattaagaggtaacctccacacaaacttaaaaaaagatgtgtgagtattagatgattgacatttgtgtgttggaagtgacatattgtatatgttgccttttagtttattaatgaataatatggataaaattaaaggtggcatttacgtctatcatagtatttgctcttgtagtcgccgcggagtccggcaaataactgtcataactttttcttttcttttcatcttctttatatatggctgggtgcttaattgtacatagttactaagtatatatagttagcttaattatcatgcctggtttatgtatcggtatgtctctgaattggtctcgtgtaaaagatttgccgtttgatggaatttcagaagttgccgtacaagaccggtactactagtgttggacatgtcaactgaaagtcgtttggcccaactgagaaagtcgaaactggctcttaacagactagataccttaagaaagcaaaagaaggaacagcatactgacctaattaaaagctttctgtgtcactctatggttcaattcccgcgttttgggttacttgtgcacaacaaaagtactagatcctggagcacaaaaatccaagctgcaaccgagggaggctcaatctacagagtatatattcctgattatctaaccggcctgtcataggtggtgtttggttggagggactaaagtggagctaaactttagtccctctcacaaaaatataagtccctatggtagggacttatgtttttgtaagagggactaaatttagtccctagttcccaaacacccccatagtattttcaggctgaactcttgttgcttgggtcatgtgttgcttgctgttgattaatgagggtgctctgcttttttgagcacttgtctgcatcacatcatatgccaaagtctctccacttaaagtaagctagagacggtactccaaaacaatcatcaaattccagctctattgatggagctccctgtcccctttagcttttggatgagactttggatgctgccgcttgggaccaaacatgcagctagccacagcccaattaaaccttgaacgcagtaatcaggatgtgtccttttccttcttttcgtgtgccatcaatcccattgcctcatagatctatgcatcaacaagcatcagaaatataatacattttcttagtgaaaaggcaaaccgaaagaagatcagaatccctgaagaaaccgacatgcacaccatgcagatagtactaaactggagcacgatttaacacgttgccactacaagataatcgttgtggatccaccagtttattccagataaattaacactgttactctgatagatactcctcctatctctcacctgtctctaccatatatatatacgtggtcatgaggtgatcactaatagtactactatatatagttgacggcaaatttttttggcacagaagatctgaaga

SEQ ID NO: 40337 - DNA, 1501 bp, Oryza sativa
catagttgtcattcacatgctccatggctcttggattgtcacggagtcgtcctagagctcgggtgagaaggagtgggtaactcacccaccacggtggcgacgagtttcccctgacagcggtggaggtgacctcggacgataaaactccagcagaggacctaggttttatagttttagggttagaagttggtgccatggtggagcagggtaggggttttggagggtggctttagagggatggatggggtggtggaaacatcttagtgggtgcagagacaggtaggtgacttgggtgctgcttgagccgtgaggatggaaggtgacggttggcggaggggatggatttagtggcgctagccgtcggagatgagaaaggaccgggacattgctggaatgggagaaaaaaaatcaaacaagagaggggtagaagggaggagttgaattgcatgcttggaaggggcatgccagagccattggcggcttccggtgccgacaaggctgagcggtggcgcactgggatgggtagtcagcagcgcagggtggggatgtagtgaaatcgtattgtgaaatcccttctttttcgtgcacgagaaattccgaatcattgaataagttgttatttttcttggttggtgtgattgtgtcatcttttcatgtacctttgtttatttctgtcgtgtttgagtttcaagccaaaaactttgtaataagtggatttagctttagttgaagcaaaggtcaagtttaatattaattattaaaaaaaggtatgttactatgaaaatataattattgtagccaatacttaggaggtcaaatggccttccacttgaggggtgaaacgactagctttcccatgcaaaccgatgtataccatgagaacgggaaccctttctttcatttatttgttcatcaaacgcctctccgagcataacaatactgacaacgcgcgggtcaccctgtactaaaacacaggagtaaatatattaatcctgattcaacctctgtaagctaagtacgtgacacgcgccgccgtgctttcccatcgtcgaccaaccggttagtttctcgccgtcgccggtggcggcggcggcggcaggaaggcgcaggagtagtcgcacttgcacttgttgccgacgcactggccaatgccgcccctgtactgccgctggcagttcgccacgcacaagccgctgtcgcacgtcgggtattcccggttgatcacctccgtgcaggtttccagctgcgccgtcacgccacctgccatttcgttcaacccaaccatgcagctgatcacaagctagcctcgatcaccaaaaaaaaccagagatggatacaagctagcgccaagtattgcgtacctggtggtgatgatgatgaagcgacgaggacgatggccaggatgagcagtgctgcgtggatggccttcatctctgacgctgttgatttttttttttcacttgtgctgatcgatgctactgctaacggtgctagctttgtt

SEQ ID NO: 40338 - DNA, 1501 bp, Oryza sativa; identical to SEQ ID NO: 39891

SEQ ID NO: 40339 - DNA, 1501 bp, Oryza sativa
ttttggaattgaatagtataggtggatggttgggcctgttgcaacgtggtatagcgttggacagtggatgattaatattgattaattattacaactgtttactactttcaacttctggttataaatgaccgctttatgcaaatgaaccattatagctatcccttgataattccctgcatcatacccctattccggtatgacttgctgagtacagtgggtagtactcaatcttgctctattttccccaaaaccccaaagtttaagtatgcgtcagatggtggcttctccgagtaggcttcgtccgtgccgtcgaggatgcctgtggagtggtgttcccgctgcggtgcaagtcaaggcttagctccagttatctttttattttccgctgcatttatgtaagacttttataatgtttgtaagacatggatctgtatgtcaactttgtcgtttgtgtaccccggccggtcctggacggggattttaatgcacattttacttgaaattctattcggaaatttctgggcgtgacactaccaagcataagtcttctcagatagtaaaacagttgaactagacatgaagacatatacacgaatagggcgcgtgttatgggtgcaccctgcgccgcgtgggcctgcttcttcaacaagagacgccgctcccactcgcgctctttcacgactcgccgcttcagcttcctaaaccgagcgggcatgcgacggtggaaaagcttctgcagacctgcctcagcggcctccaactcctcccgccgcgccgagtactgagcccacgttaacaagccgtgctgcttgatccactcctggagcttccgtctcaccttggacatcgccgaaccgagcgcgacgaacttgaaataccgcgtcttcctgatgtacttttggtttcgccgtgaccacacgccgaaccggttgcgcacgacgatgtcgcaagcgtgggcgtgggtccccaatcctgcgtacatgtgccgcttcatcgcaaacgcccgtctccctttgggcaccggtgagcagcggtggacgggctgtactccggctgcttgtttcacctggccgatctccatgcttagattgccctagctggaccggatgcagacgaaattaataacccctctcacttctttcctccttgcgtactcttttgcttatccattgcggatggatagctaattaaccaacgagacaaagttgtagtcagtatgcacatgtagatcaacaccgactatctagatcgatgtaggtgactaaccgctgttaacttcgattcggataatttcacacaaattttgacaatttgaccctttccaaaaactaattttataaataaatcgcggccaaaacttatttaaaaaataacgttcagcgccatacgatttggtgctgataaaaaagattatttctaaaataagttttggccgcggttcatttgtaaaattagttttcggaaaagatcaaattgtcaaaatttatgataatttcaagtt

SEQ ID NO: 40340 - DNA, 1501 bp, Oryza sativa; identical to SEQ ID NO: 39893

SEQ ID NO: 40341 - DNA, 1501 bp, Oryza sativa
gcgatgcttgatgcttgcaagttggtgaaggattctcccggtcgtacgggctcttttcgcggtgaacgcgcgcgagaaaaagaaaagcaacggtttaactcttgtgcatggcttgtggaccatagaccacagtacacgtggccaacggctgttctactgctccagcatgtactagtgggtactactcctgccagtttcacatgcatgtgagcccctggtttcacccagaattttatcgagcagacggtgcacacttgttgggtgaactgatgatgaccagttgagtgtccattgtccatcaacttggacataaacatacacatgctgcataagagacaaaaaaaaggtgatcagtaaccagcttaccgagaagcgagtggttgcagcttgcaggttctgactctatcaacttgctaaaatgggggatcgattgaacgattccccttgtcatttcctgttccacgcacgcgcgcgctcgatcgttcgggccagctgctgcttgtatggttcaagccacatagccatgcaaagccaaagcaaacctctctgaactctgggtagatgtctccattatttttgctagctaggttaacagtggcgcataatgcagcaacgggacaaggaggtagccggaggagcccaagagagagacagagagggagagagttgagacagggtcatgtgcggcggtcagaagagccttggccgccgggtagactggcgctgtggcagcagcagcagctgcgcggcgcggccggtcaattatggacaaatgatggcgccggtgattaggtgaggggacgacgcgggccacaacgccagtacgtacgtcttcggcttcgatcagtcgcttcccgccgcgcgacgacgccacacggcgccagttaccagttggccgtttgggctttaggaaattaataattttatgattaagtttatttcgggcggtgtactgcttcctcttctcgcggccatcggctgctgaagtgctgatcatgtataagccccggcccgttgagaagttatgatgtacattgaatattctgggacggaaggaaaccgtggtactaaactcctcatcagtgacggaaattaaaccagcactactaaactttcggcactaccatccttaagcgtgtatataggaagacgcaaaacccctacttacttttcttcaagtccaatatacacattttgaaataattgatagaagttatcacggagcgaagatatgatatgaactcatggcgagtttacacggtgagtgcgcaaacttgtgacatgttcgcaatgttagcgcggagagaagtgaactatcgaagttagtggctcgtatatacgagaacttgaaattatcataaattttgacaatttgatcttttccgaaaactaattttacaaatgaaccgcggccaaaacttattttagaaataatcttttttatcagcaccaaatcgtatggcgctgaacgttattttttaaataagttttggccgcgatt

SEQ ID NO: 40342 - DNA, 267 bp, Oryza sativa
caggcgcttctagtgaagaaacatggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgaga

SEQ ID NO: 40343 - DNA, 373 bp, Oryza sativa
attaattttttttaataatggagcacgttggattaattctgaatatgttttgttttatctatggggttctctgaactacttgttccctgcttgattgagaaatgagaatggtaaagtctactcaacttagcttctctgaaatatcagtgttagtatggggccgttttaaattgggatttacttagattctagcagaaatttcagaatgtgtgctttacggaaataaaatatgagaagcagctctaaagcctgtttggattttattttcagattactgaatcaattcaaatatgcaacagtatgaattttgagctttcgaacttcttggctctacattttgaccttgtactagtatcaactgtggggtggggtc

SEQ ID NO: 40344 - DNA, 1501 bp, Oryza sativa
tactgacaatcttataaggtcccacaaaacgcggtgccaattttcccttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgatctttaccttttcttctgcttcccttaggatatccgtcccgaaaacctgacgttctcccgtttgatcccacaaaagcggagtgcgacacgcactccgcttccgaccatacagtgcttcgtaaggagccatctgaagactagcttgataactgttgttatacgagaattctgcatagggtagattcttatcccaacttccactgaaatctaaagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactgactgcctcgatcagacactatcttcttggggacgccatgcaaacacacaatccttgccatatacaattccgccaagcgacttccggaataggttgtctttaccggaataaaatgagccactttggtaagtctgtcgactatcacccaaatagagtcatggcccgatgacgttctgggcaaaccagtgataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactaccagggtgaatggagtataaagtatcgtgagcttctttcagaattgcatctttcaaatctttgttgtcagggacacaaattctttcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaactgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaatttcccccttcctctctttgggccccttttcggcccaagtcttctttcctctcccgcggcccgcgcgccttctccc

SEQ ID NO: 40345 - DNA, 187 bp, Oryza sativa
cgaccaagcggtggcggcgcgagcgcatagggatgactcctccccgcgcgtatggctccggcgaggtcggccacttctgagcgaggcaacaagctcgtgattcgcagcgtcgccgccctcgcaccaactccccgccgccaccgccctcgcggctccacgccgccaccgcagccgccgccctcgcagc

SEQ ID NO: 40346 - DNA, 1501 bp, Oryza sativa; identical to SEQ ID NO: 39901

SEQ ID NO: 40347 - DNA, 1501 bp, Oryza sativa
taccattgcccaagaaagtcccagtcaaactgaattccaaacaaccgagtctgactctgatggacttatgcaatccgattgcacaacttgactctaatggccacagaaaaagatacaactcagccaccgtgtccgcctagacctctgttgcgttttcctcacgtccaacttcctctcagcaaatagcttgccacaccacgctcatacacaaattatgcacctgcttgcatctagcctcccatgcattagggcctttttctttccgcttaggatttattataatccagcttattagaagtaagctgaaagaaacaggaagattatttttacagcttattataatctagatgatgggttattgtaatctaataagctcaccaaagggagctttttctggattattagatggcaaaagacccactgcccctgattaattctaattatttacctgaattgccaccgcgtaccgcttcgtttctttttttcgttgaccgtgtgaccgcttcgtatcctgcgcgggagtcgcgagatcccctttcccctccactttctcttcttccaccgagaagatcggcaggcgagggggctgtgcgacggcatcggcctaggcgagcagagggcgtccggtgcgcggcagcagcgaactcgggggcatgctgcgtgcggcggcgaggtccatagcccattccgacggagatggatcctgcagatggtgaggactccctctcgaaagcatttcgataccgtgatgatgtggtgaataagcgatcccaatcaggaggcaaccatggcgtctctggcctacatggctccggcagcttctctgatggattttggggcgacggcgtcggcgaagatggacatataggcgatcttcatggctcacccggcgtccacggccaccatgtctcgcctgccccccatggcgccggcagttctggcggatcacccgtcttccatggagccggtgccgggcaccgcgacgccactgtgttccaagcggtggcagatgtgtctccccctggcagaggccgtggacggcgtggcgggcatggtggtggacctggacgtggtaagagatcggccacacaaccttccgcacgtggtggccgaggaaacaaggtgccatacaagccaccaaggccatccagcagtgcaactgttgtcggcgacgccgagggagcagctggtgtagacaatgacttcacagaagaaacaatggacagtgcgcctcatggaatggtacgtctacttcatttctctacttcaaaaattaaggtttaatgcatttatctactgcaaggattaggttgaatctaattgaatttaacgtgtatgtgtactacatatgaaaaattaatgtgtatgtgtctatgctaattggtcatgtatttaccatttctaatatagaaatacttgtgaatatataaacactagtggtgtaaaacaacatgtaaatctgaaccttgatgtgtttgatttatcaaatagaaggaggagc

SEQ ID NO: 40348 - DNA, 1501 bp, Oryza sativa
gtgtaagtgacgcattaagagaggagcatatgtattaggttcccatatatggagattattgcaccaactagaaatgggcgcaaaaggagtatcgattggctgtgagggagaatgatgttactggtccaggagtccactcgtccagcacaaccgcaaccaccaccataacagtgcgatctactaacagcgacttacagaaacaaccatcgccattgtgcatttaaagtgaagaattaacgttcgcatcacacgtcttaattttggggtgaaacaggtaatgggcctgtcacagctgccaacatgacagccgagcagggccagattaaattcctatgaaattttgcaaaacaaggcttatgatagtactaccatatttttggtagtactacattatttgattcatcaaactactagtctactactactctaccatgataaacttgctagtacgttttcttaatgagaccactgactcgaaaaacagcaatctcgctagatgatcatcatcaaaccggagtaaaccgtcgcctccccctacgcaacagttggaagagaagagagaggcctctccttccgttccgtaccaccccaacgcccacaaccaatcaaaatccacggaaacccctaccccagtgactccgacgagtcaacatccactcacctacatgtggacccatcagcgccctccccacctgtcagcctcctcttccccacccacccaccccgtcctgctccctcccgtggcgtaataaacccaccaaaagagccagttggagagaagagagagagagagagagagggggagagagggaggatttcttttcttctacattttgcagcggcgtccgcgtcctcctcctcctcctcttcctcccgcatcgcttccgacggaagcaaaaaggcgtgagtgcgaaagccatccgaaagccgccacccacgagtgaagggggggagtgagccagacggaaagggaaaaggggagccctaggaaaaatcccgcataaagcggcgggggggggggggggggggcgattagcttggtggatacttggattggatccaatggcgggtggtggtggtggtgccgccgcgtgctgctagatctcgggctgtggaggcaatggcgacgcggccggcttcgcggcagcggagggcgtcttcggcggcggcggcggtggcggtggtgaggagttcgccgcagccgcagcagcagcagcagcagcaactgccgataccgcagtcggggtcgccgacgtcgacgacgaccaccaccacgtcctcgtcgcggctcacgccggagctctcgctcgacgggcccgcgtcgccgctgttcgccgggcttgacgaggacccggcgcccaaggagaatgtcaccgtcaccgtccgtttccggccgctgaggttcgtctcgctttgcttatggtggtggtggtgtttcgtttggtcgcgcttggattttgggggaatgcagtttgatttgggttttggttttcgcttgtga

SEQ ID NO: 40349 - DNA, 1501 bp, Oryza sativa
tatatataatataatctttcatgttttccttactactaactgccaaatactgcaacagttagacacatcatacatgactactcgtgtactcagggataaatggctaacataatttatggtttcttactaatatatttttctaacctaaatgaaggaagaaaaacaaatagaacagtggtgagcagggtattgcaactagggacatataacgtggaaaccatcgaataattgaaaacccgtaaaaaccgaatctacaaatttgtgtaaattcatggaaaaaattgctactacctctattctaaaataattcaaactagataaaatgtgacatatttatttatccggatatattgttgtagaatagataatattactagggccctgtttaaattccaacttttttcttcaaacttttaacttttttcatcacatcgaactttcctacacacacaaacttctaacttttccatcacatcgtttcaatttcttcaaactttcaattttggcatggaattaaacacaacctagaaatagatatatgcatggatagattactagaaatagaaatacatatataccttccttgttggtatgaatgtatttcatgcatatatttatttctaataatctttttacgaactagaaaggtagccctcacacgtgcgtgggttaccttatttaatgtgcgtaaaattttattacgaatatctatgggtggatgactttgtattaaaatattcttttactatatctaaactaaaactaaacatattttaatgtgctctgaacgttggttacaattttcttctagttataaccttacaatacatatataaattctaaactaaaattacttgaaaccgtgcagtgttcaaaataaataaaatgccctaactaaagctccgttcccatgctgcaggcctgtttgacacagctccagctccagctccacccttcgtggagctgaagctcagccaaaaagtgtcagcttcattcaaaatggaagcggagctgggtggagttttctcacaaaataaactggagttgtggagctgggtttaggcagttccataactctactacagacccaacttctgaagctaaatttagaagttggagttgtaacaaacaggatatcaacgcgctaaggaactgtcattaggacgtgccgtcgagctgtctctttgagatggcaccggagcaaggagacactgaggaagcctttgtgagttgctaatattataaacagaaaatggcatacctcctgaactttctagaaacatagctggtaaatgttagtaaaagaaacatcgctgtaataaaatagaatccagaaactccccagatctcactactgaatagtataaaaatcaaactcaaaattccaaaaaaattctcaaaaagtggaggcgaccagttcatcctccgctcgctgcacacccgacccgctcaagtgcggagacccccccccccccccccccgcgtcgccgacggccgacgg

SEQ ID NO: 40350 - DNA, 1501 bp, Oryza sativa
ttgagctgcgctttacttggcgggagggggattccgcgattccttcacgagggaggtgaggtgaaacgcgagagcggacgaaccgcgcggcgacgcgtgtgccgccgccgaggcgtcgaccagtcagcttgggcttggaaagcgtcgcgcctctattgtcctactactacgagagcaggtacaatatcagcttataagcaagctccaaacatattttaaaaagataaaaaaaaagcaaagtagcgaactatagatctgtagctagctgcgcatgaactctaagatgtaatgtgtgtatggcaggtgggaccagattctaattttatagtaagcgactattatatgaattcaatattttattggttataaataatttggagctagtagtggactatagtcactatactattaaacttactctgaaaggatgtgcctttttgttttggaggcacttggcgagttggcgaaaaggatcttttgcgatgaggcgatgaccatgccacaatggcatagacggtgagggcaatggctggcaagttggaaagcttttggagaacggtgcgggtgactgggttgagtatggtgatgaggcctttgttgcctacgggttacactgtcacttgcacacttaactgtgaaaaagaacccaatggtccagtcatataatcaacgttaaagtacacaataacacatatataaaagttttacctaaaaatttatttttatttttggtttattagggaaaaagccaacgatgagagcctgaaagagaagtagtctcctatctacacccaagcaacaaagtgaagctttgctcaaggattagtacagcgctgcctatgaactacagtacataggacaacaccaggtgggcctttttttgttgaaaggccatcaggcagcagtttggttcctgcatggctgcaccggttgatttacgctggctttgtcagtggtcacccgagcgaggtaactgtgttggatgcgtagtactatggcctgtatggttcatgggcccggtattgtcggtgttactgcgtcccacccgactatcattttgctttcccagtatcaccatcactgttcttttttatatgatgttggttagtccatatatttaggatggagttagtaacatgccagaagaggtgcgcacttcaaggcaagaaaagggtatgcatgaaggtatcaccacatgccagcaataaaagatcatcatcctcatgttgcatcgcgaattctgtttattgaaccaaatgaaggcagggctggtatcaagtatgagcattgtatggaagtaaatggagcaggtatgatatgacaaagcaaacgtttgcatttccaaaaccaacgccggaccacaagaggcctgactattacattattactgaagcaagcatcccacaggaaaaacttacaaaaggttaactgatgatacaatcaatgtgattcactcacgcggaatatattcacaaaccgatgttctccccaagtgcaggat

SEQ ID NO: 40351 - DNA, 1501 bp, Oryza sativa
aagctcctagtctgtgtgtggaaggttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctctttttttctaagtgggcaaggtcctccttttatatctcaaggggataccacatgcaccatctctccctctctttcttttgtgtggggactcatcctctcttccctccaacttgactcctcttcattaatggacggagatttgtatggctgccgtccgaatgaccttctgatgggacggcccatacctacctccacttccgtcggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccgggaccaacgtgccatctccaggagctaacacgccggctccggctagggacgagtgcttggaggctctcatcctgacgggatagggcgaggcgtgcgtcagaccgcctgtcgccatctaacccacgatctgatcggtctgtgactggtcactgaccggataaacaagcgcgctgcactgcgttacatgcggcgtgacgcgctcgtccaaaccgcaataaatgtggttaggtgagccccgctatgctcacctacccaatatacgcggcgcaaaacccacaaggggtcggtgcgcctcggccctcggggccgagacgggagcggtccgacccctcggggagacaaagagaagggcggccgtatcacccttgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgtgagaaacgaggagccgggcacaacgttggcaagggtataaagtcgccgaggaagagatttgcttccttcctctcgccattattccccttgtcttcgccgcttgcgccctaactccttatttcctgtgccctaccttcgccacacgcgctcgctctcaaacatctcttcttccggcgtca

SEQ ID NO: 40352 - DNA, 1501 bp, Oryza sativa
tgaataagacaacatactatgactgcatcagtaattgccctgaaaaatacatcaatggtttttaaagaaaaatactcagattagattgaagagtaaacgataccttgtaacggtttataatatctttgaggattttattcagtgcatggcccatatgaagatcaccattagcataaggaggaccatcatggagaacaaatgtagcctaatccaacagtcaagaaaaccaacaaagtcaggtaaattttaattttacttttagctttactcgaagaaatactcaccccagtgttcctttctgataccctcttgagcacctggttctcctcccacaacttctggagctccggctcccgcacaacagaattagctctcaagccaaaagttgtctttggtagatccaccgtgtgtttgtatttcccctcttcttgtttagcacctagccagaatcaagaagctaaatatataattatatcttaatgaatttaactctgcaagcagtactaaattgaaactgggactcaacctgtcaaactaccaactactattcattataaaacagccagataaaattaattacatgtctctacgagattttcattacaaaatacaccataacttttgccagtaaaagcttcagtattgacacctactaagtaagcagagggtctcactgcatttgaatctcaatggaatgtactgaaataacaaagtttcaactaacaccagataacaaagttattttcaaaaatcaatctgattaccgaattctgggtatacaaaacacatttaagcttaaacagctttcatcctaacaagcataagcatcaagtttcgactttcgagcactagttgatgctactccaaatggagaaaatgagaattaagcttaatctgatacgcaaaacaataataatcttccaaccatggtgcttgagacctaataagtgcattttggtgcgaactgagaagtccaataggtgtgtacattcttaaatctgaaaagtacaccaattacaaaaatcccaggtcatagcatacttaaggctaaaccaagcagattgagcctaagtaacacacatcaatcataaaagtacaaatgtaacagaaaactgcagtaaaacaagtttggtaatgagtttaataagccctacgtgcttaagctgaaaataattatagcaattgcagaagtggaaactacaatcacatatttgaacctaaattaaccaaccagtttaagctgtacgtcacacgagttcaatatctgtaatcatgtgcctcaccctgtgatcaatcccatcaaaacgtgaacagcaagaacgaaaatctccaggccatagaccagcttcaacctccaacgcctcaccagacaaaaatggctggcatccccacaatccacagagcaagtacgatatacattgaccacagacacagagtaatcccaagaaaaatcggacgcctaatgcacctactccacagccaaaactcacatcactgaaat

SEQ ID NO: 40353 - DNA, 617 bp, Oryza sativa
gtgagaagttgagaagagaagagaaaaataaaagaaaaaaatggatgcggggcccacatcattttctctcaataacatgtgggccccacatatttattttattatttttgctgactaggatgccacgtcagcaaaacatgcatctatactgccttgggacctaaattagacggttttgtatagtttagtggtgaagatttctggttttgtggttaaggcaccttaaaaaatctcgctgttaagttgagggaccttcagtgaacttattccgacgcacaaaacagcaagcccaacaagatctgacgacttcaatggtaggacgccattcggcgcgttgattcccgatccgacggctacagagcgcgctgggcgagccgacgcgcaccagaacaacggcagctgctcgacgaattgccgcaccgcaaccaaaccatgctgcgcgcgctgctccgccggcggcggccgccgatcccctccgccgcggtcgcggtcgccgttgcaaccttctttgcgagctcaggaggcgcccgtatagctctccctcctcctcctccccgtcctgcggcagacgaggcggagcgggaggggtcgctggcgcagcgggtggagcggtcggc

SEQ ID NO: 40354 - DNA, 213 bp, Oryza sativa
tgtttaattttgcatgagtaaccattgtaataaaagacatgatgttgctaccccatttatacacgtaataatcacatatatttatgtgtgttttctatatttttcttttattcttatgaatttaagtttcgcattatatagattattacgggaatcaatccgatggaagaagagatgtgcctagtggacagttgtaccactaacactatactt

SEQ ID NO: 40355 - DNA, 1007 bp, Oryza sativa
aagcagtttgactttgaccaaagtcaaaacatcttataacgtgaaacggaaggaatattaattgatatatccaatcaaattgaaacttcatttattatgcatatatcaaggccttatatgcagagtacatttgtatacacacaagcttcaaatttcaagatcctaggctagaatatgatgatgtcatatatcaagtttatgaccaaaagttgcatacatcatcagatatcttacaatcttcttctactccatgtccgtgcattgggcgaatcaatcttgtctagtactaaaaatatagtgttcgatgtcaaaaaaagacatcctcctagtgtagcaagccagagtgtgcgtgaactttgggagcataaaaatagggaggtcttatcccgattaatatagatgcagtagatatatccaatctcccaaagaactcttcgtatcaaatctgcatccggatcccccagtcgaggcatatccttggatggaagtaatgtctacctgaaagcaagtgggttttagggaaaattaacacagcactctataagttaatttcatacaagggaaaaatcagcactggaagatgccacaagtgtaggccaaaacaaatcattcaagccaatcaaaaagtttgcaagttaatttgcaacagtgatcaggatataaaaagaaattaaactttcccaagaaagaaattagaataaagtagtaacgcaaattagccatgccatgccacggtccaaaccccaatcgcaagcgttaaaccttcttcaacacatcattgcatcgtgagaaaccttggcagacaggtgtaatataaatatgtaaaatctaacacatgcctcatgaagcaatcaattacagaatactcttatcatacatctgaatttaaatttgctgtcgtcttcttgcttggtacacaacatacaaagtgtgcaattaaacccgacaaaaccggaccgaatcacatgaagactcacaaaccacagtgactactctgtctcctcagc

SEQ ID NO: 40356 - DNA, 1501 bp, Oryza sativa
cacgattggattaacagatctttctttgcaatatatcccaatccacaaatcctgttattacattacaagcacgcgtacaaaggcaataccgaatcaggacgaacgaacatcggtacacacaaacatagcattagcaatgtcaaatgtccttttctatgtctgatatctggaacagtaaggtctactatgccagtaatacagtgtttcaagtagtctgattcctcgatcgtccatgtaaagaactcgctatccgttccgtccctgtattcttctcagtatggaataatcgattcgatgagctcctggagtggagccagctccttcttgtcaatcaggccaaattcctgcaccacataccaaaaggccggaaacaaatgaattttgctttccccagatttctatgaaccaagagcaaatatgagataaatgtaaacaatcctggtaatgagtttacaatctacaaacaaaagagacttacagttgtaaacagaatgaagtgcttgaagcacgtgttaagatgggcctcctccttgaggctgacaatcttctgaaaactggagtgatatatgtgggcataaacacgaaacaagcgcttgaaaattgtctttacaacctccttgaagtttggcgggaatggtgtgcctggtaaaggaattaaacccatatcagtgtcatgagttgtgtcaaaattggacaaatatatgagtagtgcctgcactatttctaaggtacacatgaccattccaacatcaaatgtttgtgacaaacaatgattaccaagcttttggggaaatatagattcatcatcaagttggccttcaatccagtccattaggaactccacatattttggcgctgacacttctatcggcttctttatctgtacaccatcagcccatctgtactcatatctgcataaattccatgtttctgttgttactttgttatgacgtgaccaatatatttaagtaattctgtacaaaaaatgaatcaggggcttgttgacatgacaactccactttgtaataggtggatataatacaaagtcactttataataggtggggtataatacaaagtgttcttggaaatttttgttccaaaaaggacccatcatgcttgtccatttagtcaatgttctagcctttaattatatcaggacaggtggaaagaagcaaagcactgtggacaggctaaaatggacagattcgaacatccttacctgaaaattccagaaaatttcctaaaattttgcttcggtgggctggtccaatcgacgcgatgcccacgggctggaaagtggaaactggctgcctcatcttgggctgggccgaattttatcgagaagattagacacgagtatgggctttgggcccagaactctccccaagcgccgcatctgctcccgagttttccgcttccgcaaagcgggaaaacgaagcgggaaaccgggcaaatacctcccatttcttcttttttttttttttgccttcgaaattcct

SEQ ID NO: 40357 - DNA, 402 bp, Oryza sativa
acattgcaatcctacttgcgcttttgaatatatggtgctaccaggtttcacctggccctgtagtattaggccaaattctcttctaggtctgagtgtccgacttttggtggtcattatataactgccagttgtatattgtgttggttagaaatgtcagaagcgtccaggtcaaatagggatagaacccagaaggtttgcagctttgccatttggacaagacgatctttgtgtataattggattgaaaaatagtttggaaaacccatttacattgtaacacactatcatttactcttgacatatgttaagctacactgaaatggttctcgctgacatgctgaaattttagatatgcagaaaagacgatttctcactaaacgccttgttattttctttatacaga

SEQ ID NO: 40358 - DNA, 1501 bp, Oryza sativa
gctaaacctcttgatggttacttgtgaaaatacctgattattgctcacacgaatgcgctggatctctgagtccttttcatcaatcagactacgtgcaagttgaagctctgaatgcacttgattcatctgtgaattcaattagtatggtattagtagaagatgaaaattttaataaagactttacacctttagttatggtgctaaagatgaacaactcaaatagatggttctcaacttatcatttacagctacaaagttgagctataatataattttaagaaattatcgtgctataaacatctatagtaatagcttttgcaagagttcataaaaagtaggccaaagacaggtgagattttggagacctgcctggccagaatatagaaaattgcttggcttaagataacaacgcggtcaaaataacaaggactggagtgtaagcaggcaagttaattatgttttgtgatcagaggcattatagcattacaatataggtttaattacctcagcggagagtgctctaagttcttgatcacgcgatgctaatagatgagcaagatcggcctgtagaattaaaagggggttgatgcaagtccatcaattcacataaacataatagctacaaagttcctttctctaattttgcacctacgaagctggtcagttaattaatgcaacacaatcaatcagtgttgtgcagacctgaggagtgctcccaacatcagttctctggtatttgcttaagcattcttgcaagcggagcacctttcaggaaaataaaaggtttggttattcaacaagaaattttctggaagttccaacatattattattgagaacttcagcactgactacagaactggccaattaagttaatgtagaactaaatacaaggatcagctaattcctccatgaaatagtaatgctagtaatctactgttgtcttgtacaaatatttaaataataacacaatctaacataatcaaattttaaaatggatatactgcattgatcttccaagtacctcctcactcaggtaatgaatattctccctttggtactgaagcagagccatttgctggtcagaaaaacgaccatcataatacctggtgaaaagaaaaataacttgtgaaactctactggcagtatgccaagtacacatatgacatattcggcaacatatcaacacttgtaactcatgtgaaggcacatccttctagatataggttcaatacagatgtttctgataaacatggactaaagaatgcttttccaaactgccagaaaatcaaacgccaagcctgaagtggtagaaactgtgcatagtacatgtttatacgtgtcttcaaacactactccctccattttttaatagatgacgccgttgactttttctcacatgtttgaccattcgtcttattcagaaattttatgcaaatgtataagatataaatcacacttaaagtactatgagtgataaaacaactcataacaaaataaat

SEQ ID NO: 40359 - DNA, 1501 bp, Oryza sativa
tgcacagccggagctcagctcgcccgccgcgtcggatggacgccgcctcctgctgccgcgtaagcgcgggcgcgctcccccgatttccgttctcgcttctcgaacgttctagagccttctacggtgggggatccgtgtggtgtgacccatcgtcgcttctctcgctctcgcaggtcttctcgacgcagagatgccgcttcccgctgcggaggctggcgccgccgatttcgcggcggccgttcggcacggagtcgacgagtgagctgttcgccgcgtcgacctcgaagcggcgctcccgggggcccgtcatggcggcgaagaaggccgccgagggtgagtcgacttgatcccattgctgtactgttcttatttttggttcaggttgagggtttggtgagggttttagtagggggattggtgtctatatgttggtatttcagtgatgtgagttttggctgtggagtaggtgcattaggcgtccgatttttcttgggattactctgtgtctgtggtcaatgtatatcgtacttgctctgtggattgtggggatgccagccatttttgtctggtgaggcgttggaggttgaagctggtctatggcctggagattttcgttcttgctgttcacgttttgatgggattgatcacagggtgaggcacatgattacagatattgaactcgtgtgacgtacagcttaaactggttggttaatttaggttcaaatatgtgattgtagtttccacttctgcaattgctataattattttcagcttaagcacgtagggcttattaaactcattaccaaacttgttttactgcagttttctgttacatttgtacttttatgattgatgtgtgttacttaggctcaatctgcttggtttagccttaagtatgctatgacctgggatttttgtaattggtgtacttttcagatttaagaatgtacacacctattggacttctcagttcgcaccaaaatgcacttattaggtctcaagcaccatggttggaagattattattgttttgcgtatcagattaagcttaattctcattttctccatttggagtagcatcaactagtgctcgaaagtcgaaacttgatgcttatgcttgttaggatgaaagctgtttaagcttaaatgtgttttgtatacccagaattcggtaatcagattgatttttgaaaataactttgttatctggtgttagttgaaactttgttatttcagtacattccattgagattcaaatgcagtgagaccctctgcttacttagtaggtgtcaatactgaagcttttactggcaaaagttatggtgtattttgtaatgaaaatctcgtagagacatgtaattaattttatctggctgttttataatgaatagtagttggtagtttgacaggttgagtcccagtttcaatttagtactgcttgcagagttaaattcattaagatataattatatatttagcttcttgattctggctaggtgcta

SEQ ID NO: 40360 - DNA, 1501 bp, Oryza sativa
cacaggaaactggacttaggatccacttctctgcatcctcccattttgatggcagcttcctcccattgttgaaaggaagaacaaccccactgcccccatacctcctattggtaccacctccaagtggcacccgctctgagctccatcccttagggtactgcatggtgctagcgcaatgccggtggtagtttggggtaccggggctcgggaatgtgcctgatctgctccgtgatgacgctgtggagctcttgctcattcctccaacattacccccaaccaagcacctcggcgagagcaccagcagttctatgctcccaccacctccgccggtgagctcatgcttggccggtgaaagcagcaacgcagccccctccgctctgagcttccgctgcttctggcactctaccaaccaacagattccaaaccgaagtcagcaatcacactcaacagagcacaaaagcagcaaccgtactacaagggaagattaatcacctctcagcgagtgggagaaggagtcactgaccgcttccccctcctcctcctccgagcccgcgtcgccgtcgcctctccactcctcctcctcctcttcctcctcacctgcgtgtggaagaggttagctggcgacaaatgtgcgggcactgggataacacagcacacaccaagccgatcgcccgcccaccaacctcgcggtgccgtgccacgcgaggcgtggctgccgatgccgatgccgtgcacgcgcagcggcgagggcgctggatctggatcggtcgcgccgcgaggccccaccgccggctgcagaaaccgccaagagagggcaatcgcctcagcaatcaggagaaatcaaaaccaccgaacaccactgcacagtcgccgcactagtcacacactcacactaccccaagcagcagagacgaattcgaaacagcgagcgatccgtaagccggcgaatcgcaccaaaatagcaatgatagaaaagcgacgaagcagtcagatgcggcgcttttgcctagctttgttcaaattcgcccgccctctttctcctttttggctttatcttttgcttgggcgggatggtttcgccactaacctcggatccgccatgtgagcggcgcgcgtggctggattggatctattgacttctaccgcgcccgcccgccccttgcactaaaatactcgcgatgcgcgtgccgcagccatccctaacacgacaatgcggcggaggaaggggaaggttaagagcgggatatgtttattactgctgcggccgccgccggtcgccttcgccgctgcggcggcggcttcttccgtcgtgcgggatggtggcgtcggtcggccgcggcggcggcggaggcggagtcggggaaccctagcccgggctcgaggcgtcgcatgctcgagcgcgcggtcgcattccccgatgaagcagagggggtggtggcagtggagtgggggaactgggaaggagcagccgaggtgtggacgcggctgccgacgagtgcgg

SEQ ID NO: 40361 - DNA, 1501 bp, Oryza sativa
ccagcatcaaatgcttcattggaattccatatgtttgaaagtttaaagattaccaaagtgtactacgtacttcaactcatgaagaagtatttccaaattataacgaacaaaactcaaactagaaatgtaaacagaacatggagagtacctgctttttctggagttcatcgttcagctccttaagttttgctacctcagcttccaattccatcatatatgcctgctccatatcaggaagcacaaattaaatccataaaaaatgacaaaaagttttagaacatcaatagcaacttagcaaggagaaagatatgcttatgttttataaacaccactttgttttatgtttatagcgtgtatactaattttaggctaggcttaatacgtgcaaaagatatgtttatagcgtttatactaattaaatttcagtatgtttgaaccaaatacagcataaactttgcaaatatgaggcacatatcctagttagcaaataaaacgatcagcatgatgataaacatttctcacggttattactatttgttagttgtcgcatcgaaaagaaaagaaatgcttaaaagggaaaatatatgtgctacacatgtcactacaggcaagtactagaaggcaaggcaattcgacaagtaaatgctaaacagttgcaagttgcaacaaaaaggacttttcacctgtttcctctggcgcgacctcgcggcagactccctgttcttgatcatccgccgctgtcttctctcgacaaccttctcgatgcccggtgccttccttcccctcagcccacctttgaaaacgtacggcaccggcgatggcgacagcgacgacaggtccccgccttccatcttgccgaagccattggacgagaccggcctcaccggcgaaaccaacgacgcggcaccaccaccgccgtgtccgacagctcccgagaccagcccatttcccagcgagagcggaggcaccatcggagggaacacattgctctgaccgaacaacatcggcgtctgctgctgcggcggcggcgggggaggtacagcagccgccgtaggagtcggcgccggcgggacgggcgggaccgacatgtcctccctcaccacgccggcccgcacgaggaactcctccagcgtgatctccccgagcgtctgctgccggtgcgccggcggcgggggctccgcggcggccggcgcggtggaggcgccgccgccaccgaagcacatcatgtcgcgccagacctcgtcgacggtcttctggctgagcgtgcgggggagggtcagcgacccctgcctctgaacgggcggcgcccccaccgccgcgtgctccgccgccgccacggacgccgtcgtcgccgtcgtcgtcgtggcggcgccgacggcgtgcgactcctcggccgtccagatgctgcggaggagctcgtccatgttcatcgacccgaagtccttcccgaccccgcccagcgtgctctggaactcgtcgaacgtgagcgagtacaccgacc

SEQ ID NO: 40362 - DNA, 1501 bp, Oryza sativa
ggggcggcgcggggcgcggcggcgggtcgatctcgtggaggaacctgccgaagcagcgcgggcagaagacgtcggtggacgggtaggagatgatgcggatggcgcggccgcactggtagcaccagtacatgcggcacgtccggtggtgccgcacgccgccctgcgccggcatcgtcgacgacatggcgtggatcgatcgatcacacagctaagctataaccacttggatcgctcgaattctgtacgggaaaatcttgcgtggggtatgcatcttgcatgggcacggcgccggttttaagggcacgcgcgctattgcgccatggagagggagagctcgacggttgattgggtcggcgcgcgcgcggggaaattaagcgagtgcacgggtgggaagggatggctttgcgaggtggacgaaagcgattccgcggtcgcggcggcgtgtggcgtggtgaggcgacggcgtacgtagtagagaagggcgcgtgcagtgttgggcgcgggtgacttgtgcgtggtgcaaaagcgcgcggcttgcttgccggccaggaggaagaggaggacattggcgctcgcgggaagtaactgtgtcggttgggccatgcgggcagcaaggcccataggatcggcatgtgaatgtgggcctattctggagagaatcaggcaggattcgaataaccgtggacctggaatgctgtcgggcccaaagaggtcaggctggtgactggtcccgtcccgtcgggtggagcggatgggcgggcggaataatgctgcccgtgccggtcacgaatattcacctgcatattcttgccactgtctccgccagtcgttgtgaacgttacgctatgaactggtcgccgccgccgacgacgacgcgaggcatctgctcggagaaatatactcctaccatgagtccatgactttacagtactcgtagagtctcataaacctttcagccaaatataaagtcgacgtattaattggtcggtattttcatatcgaaaatagtagctcttgacccccaaaaaaaggaactgctgggtagctcttggccaataattatttctcataacaaaaaggagatgactaagaaaaaaataagaggtagtgcttgatcgtattcaaaagagtgtacaatacacgagaaaattttggcaccgctaccattctctagccataaagtagtccctccacagcccagattccaggcaccaacaacaaccccaacagacgctgacacatcgggcccacatattaacgggccccacacgcagcgaccctccggttcatctccacctcccaaaagatcgatgccctaacaacttggaagcccatctcgcctcgccgccccccttcatattcaccctccgccgcctcgtcaattccacgcgaacgcgagagctctcggaaagcaccaccaccagcacagagccagcgcgagagagagagagagggagaccaaaccccatcccggatctctcgtcgtcggcggcgtctgcga

SEQ ID NO: 40363 - DNA, 1501 bp, Oryza sativa
tagagcaggtacaatagcagactattagtcagctgtaaacatattttaatgagataaaagatgagagagaagagcagtggactccaagacgcaatatgtgtatgataggtgggactatattaatagtatagtaagcaactattgtatgaattagctataaataaattggagctagtagtgggctatactattaaacttgctcttagacgaagtacaggcgtactgatgacgatgatgatgttgatcgtgcagttctctcgatctataccactgtaacctgcccacaaaaagggtcaggttcatatgaccaacccttcatatattttggtttatcccccctttcaaaagacgctagctctcctcactgcttgtgatctattttgtcaggacccaggattgattccaccttataatcaccataaaatatgtgatcatgtactaataatactactcctcctaagtctaaaatatccaccaaactcttaactaatcagcaaagataaccaacacactggctggccagtagacatgcatatgaaaaaaataatatgattgcttcgaatcgaaccgctccccgcgttgccggcagccgattcgatggatcgccacgttcaaacgccgccgttggctcgcacaaagaatcaaggctttcccttcgaacttccaaaaattcggtcacaatatgcatgtagcattaggggttggtttgttttgaggcctatattggccttaccaatatttagcaatttcaatagtgtttattgtctatttggtgtggagctaaattttgacatgcctaagaaaataggccatttcaaccgttaatttaggctattttggcttcaatccaaacacaatttttcctttgccaaaattagccatgccaaaagttaccaaaatttgacattgacaaaaattggtaaggccaatttaggccacaaaccaaaccagccctagatatagacaaaaaaaactaattgcacaatttgcatgtaaattgcgagacgaatcttttgagcttaattacgccatgatttaacaatgtagtgctacagtaaacatttactaatgataaattaattaggcttaatagattcgtctcgtagttgacagacgaaatctgtaatttattttattattagtcaatgtttaatattttaaatgtgtatccgtacacttaaattttttttttgaaaaacaggcggcagcgacaccaactctctagccgcacgctgcactcgcgagtcgtcgtctcgccgcattattattttttttcttcgtctcttgcacacgcagatcccagcgcggccaatggcgccacccgagtcaaccccctctcgcggcacaaacccacccaccccgcaatcgcaatgccatcgcgtcacgccgcctgccgctcccgcctcccccatgagatgacccctcccccgccgccgtcccatgtgctcgccaccgtcgatgcggcggcatccgctgctccctctcctcgccgccgtccttg

SEQ ID NO: 40364 - DNA, 1501 bp, Oryza sativa
tatctacttattttccatttactaatgatgtctagtgctttttcagtggagagtaagatccaaaatggttcatccatttcgtctgaatttgcgagatatacacacaaagtgacatacacctgtttctgtttggaccataatttccatgtggatccacatccactgtatcaaacagcacacacgtagttgaagtgagtgtagcacgagtgcacaactggttaggtttcttgtggtgaaaccaacccaccttgatacaagttttaaacttaacacagtactcatttatgactaattatttttttagtgagatattcatggtgacttcgtcgattttaagatatatcggcataatcttctaaacgtgctcataggggtagggtgtgcgtgtgtgtttaggcgggatgagtctgcgtattatgaacgcttacaattgtaccgtgtttctaaaaaatactgcacacgtgtagcaatttaactatgaacaaaaacatcacaccatttttttaagtaaaaacagtaggaaattaaggacaaattcttaggagtatcacgcggtgttttccaccaaatttgtttgcttgaggagcccggcggggatcgaatcgaacgccaagaccaagaagaaatggaaatggaagagaagtagctagccagccattgatgcctcgttagttgggagatcactccaatgcttcgtgagcctcacgtaacagccggtgatgcatattgcatagctagtttctgaccgagatggtggggggtgaaggaacgcatcaagcaataatcgagctgcagcaactggggtggcttgttacggatatggtgatagcttccaaggatgaaattgccatgtcactctcttaattgcttctattgaatcattctttcaggactcgttttccagccaaatgataccccatctcgatcgataatacctatgtctactgctgacgaaatgtacacaaactttttttgccgccagctgaacaatgcctatactagtactagtagcaaggttatgacaaaggaatcgcattgttaattgtcagataaatctgtagttaatgatgaactgttggctaggtcgctatcgttgcacgcatgacaggcgcactagctagagatcagtacatctacgcttctccgtgagaactgtgactggccaatcccctttatgctgagaaatattgcaagaaagaaacttaagatgcacgtcgcataccatgcacgcacagcaaaaaccaccaaataaactgttacgaaattgtgaaatgcctcaggatttcaaatatcgcatcttacaaatgtacgcaaaaacaagagtctgacttggctgaaaaagatattgtgtgtgtgtgtactcgcgtggacatgaacacggttttatatatcatcgttgatcggactgatcactttgaactggttaattaaactcatccaagctttgcactaatctcatacgctaattggcagagttgacacggctaggtcagctgctaat

SEQ ID NO: 40365 - DNA, 1269 bp, Oryza sativa
aacggcggcgagcgcgaaggggcaggggcggcggcccgagcggagggacgagaggtagagcgcgacggcgcggcgtgggcggccttggtccgcggcggcgcggatggccagcgtccacgtcgagttgacgtctccggcggcggcgggcatgggagcgtcggtgatggtggcaaactagcaatccgtcgaacagttggtgactgaatttgaactcaaggactgacaatttcgcagctcttttttgtttgataggaacaatttcagctcttcatactagtggataaggctgtgtttagattcaaagtttggatctccttttttatcacatcaatctgtcataaacacacaacatttcagtcacatcatcttcaattttaactaaaatttaaactttgcgctgaactaaacacaacctaagtaacatttttcaaaagcttctcaaataaatgtaaactaggaatacaaaagtcccaatttaactgtgctgttagaaaacaaattctggtcacttgaagagattacagttgggactatcttaaaaactaccgcaagtattttttatggaaaactttcaaatataaatatagtataattgtaatataattacaccttaactatactacaaccaattaaccttattatgacttatttcctccttccctaatggtttgacgccgttgacttttttaaacatgtttgaccgttcgtcttattcaaaaacttttgtgaaatatgtaaaattatatgtatacataaaagtatatttaacaatgaatcagatgataggaaaagaattaataattacttaaatttttttaataaggcaaagagtcaaatatgtttaaaaaagtcaacagcgtcaaacatttagggatgcaggaagtatatagcttgtttatgcctgattagttaacaatcatctttgtctgtacggcagtttttattttacttttgctaaaaaaaattctcctgctctctaaacactcctgactctttcaaaaaaaaaaaaaacgggggtgggttgggtggggaagactactgccattcattgttgcaactgttctctcctcttcacaatctttctgcgattgtacaaggcttgaatggatgctacggctgttgccgagtgaaagtacataagttgtattatctgaagaaacgcacagatttttgcatgaattcagttggttcagatcagtcgaaaatattgttcaataatctctctaagaaaaagaagttgccggcatccgaccatttcaatttcagcga

SEQ ID NO: 40366 - DNA, 1501 bp, Oryza sativa
tttagtgacaaaagaaaaatatgtcttatggctggtttggcaacttgaggaaaaatgattggaagtttagatgagggaattgatggtgagattaacatgtgaatttgatttttagtcacaattttatttttgatagaggtggtgggaattgacaaggagtttagttggtgactagattttaaatgaaaatggatggctaagatttatttaggcaacgtaaaggagaaatttcctatcaattactagcccctacccaaatattaaaaaggagggagatcttccctcaattccccatcccatcccacgaaaactcatttgtctctcaaccaaatagaatagttaataacctcatccttttaaacttctaatctctcataaaaactcaccccaaccaaatacacccttagacttttggatgaagggattacataactacaaccattttaactaaacgatcgtaaaattacaaatttaaggtattttatcacaaaactatagatttagtaccaaatttataataaaactacaaatttaatgttgagtatcataaaagtatagatttaatatcgaagaagtcatcaaaaaattataacctttattagagtttaaatccataacactacatttatgttggagctataaatggcgtagttttgtggttaacttggtactaaatttatagttttatgataatttagctacttaatgtatagttttataatacaacactttaaatatgtagttttatgatagtttggtcgaaatatttgtagtgtgaataagctattttttcaaagaggatgcccccttgtttttacatgtcacgaaaacgccataaaaattgaaaaaaaattgatagatatatgatatatatcactctacaaatctaaattcgacctatacaagcaggaaaaaaacaaatacgattgttgatagtgcacattgttaaattcaccgtgggtttttgtgtagcatactcttacatgcccaccatgaagatccaacattagcatctatagcatgagtcgacaagagaagtccatactcatattggaagatatactttcaatttttctttttttacaaaagtatacttttttaaagagaaacgtatatactagtactaaacttgctgttatcaccaatcatatattcgaagttttgccatcaaaaccacagttagccgtggttttacagtaagcatgcaaggcgtgcatgcatgccttcttgtattttaatcgattgcttcattatttatcttctaaagttgataccagtaaaaaaaggtacacgttacttttgtagctaaaggttagtttaacatatatagaccagtatcctcatgaaagggagctgatacgaaaaccatgtattgcattataaagtttatgttctgaaaaggggccaactaaaaaaaaagaatcaacacgtttgcatcgatgacctataatttatcatgttaactttagaaaaagaaatatgtacgcagtatattgtgatg

SEQ ID NO: 40367 - DNA, 603 bp, Oryza sativa
cctaccttacacatggagcaagttcagaatctgccactacttctgttaacaacaaatcatacagtggaaccatgcaaaggtctgatgatgtcacagtggacagtactatttctgggaaaaaggcgatcaggttttctctgaataacagggatgctgagataaacacagctgatagctcaaggacactgatatcgttcaaacggaagtttagtgaaagaggatcacttgctggtaagcagctcccgcgaagaccagttacctcacagaaattggaagctggagaaaagaagacgaaggataagaaggtttgtacttctgttttcaggttttttacttcttttctgtaccttgctaatgtgtagaccacatggtttttcagaatagggaaacatttcaaaaggagctttttatgacatctgatcaagcttctacacagaaccaacgtcttccgaaggggtatgcatatgttcctcgtgactctctttctaaagacaagttgcggaatcgaaatacacaggcccatgaaccacaagagcctggtggataggagcagctgagatcaagatggttaatcttgtctcaagaaaggccagaagacgtttg

SEQ ID NO: 40368 - DNA, 1501 bp, Oryza sativa
cgttataatatgtggtcgcgtcgatcatcgcatccctcctgccttcgtctggtcttgtcgcgcgccacaggcgccggaacttggatcggaggagtactagctacgagtatcatatggttcgtgctcccatccatgcaccagagccacgcctgcccccggccggtaacatgcatgcactgccggaaaggctacgagtcaaacaccctctgctagctgctcgtactcgtagatcggtcagtacagcgacgacgtcgacgtacgtacatttttcaatggtactagtagaattctgcatgtctgcttcttcttcttcttctctctttagcaaccaatattacacagtttcacagtgtagaagaggggaaagatattgacttagtagccatgtcagataaaattgatgtcaaaactaccgaaggatctaaagtgaacggttttttaaattgagagatgttatatattttatggttgaatgacaattttgtaattcgatgacaagttgacggaccttcggttgtactttttcctgtccctcaacatataaaagggccatcctacttcgctgccgcacacgtaacaggccggtggagagttctacctggcccaacttgtgaggtcgtctgttcatgggctatgccacaccgtcccttgggccacaccgctgcctgactcattgcagcccaatccgaaacacagttcgcgactctgccaccaagtcagcgacagcccgcaaggccgcaagcgccaagagatcgtgaccgggtcacagcccgcacggcaggcgaggccgtcccgtccgttctctgccacgcggcccagttcagctcacgtcgaccgttgcgccggttcgccctcttttcgaaaggcaaagacgcaccgcaccccgtcaacctcgcggttaaccaaaaccactccatgacatgtgggctccatggtatcctcggacccaccaggcagtgactcagcctcgaaaccaacgcgtggcagaggcaaagatatggtgtctctgagagcaagtttaatagtttaactcactactagctccaattcatctatagccaatctaataactcatccatacaatagttatatactacactattaatatatggtcccacctgtcatacacatactgcgtcttggagtccgtgctacagctagctataaatctgtagaccgctgctcttttctctccttatttatctttttaaaatatatttgcagctgacttatattatgctattgtacctgctctgatgatacctttccctcctcccctcgcttggcacagattcccccatcgctgccaaaagcggacgcctccagcgtcctcccgccattactcacccagcaaccgactcgctcctccctttccgccgctgaccggtgggccatcccccccaccctcctcctctcagcttgtataccagcgcttccgcagagtcacgcactgcacagttgaagttggtggagtgtggagtggagtggagtggaatggcgg

SEQ ID NO: 40369 - DNA, 1501 bp, Oryza sativa
actcttttgcgcattctcgaaaaataaaagctactccaatcagcgagagggtagaggtggagccacactacactaaaaaaaacacaaaagcagcaacgccagtggaagaccacagacaatcctctgagaggatggactcgaaaaccacggagaccgaggagagcaccgagttgaaaaccctaaaattccgctcctttcacagctactaagagaccagaaggaccagagagtcgaagccgacacgaagatgttcaagtaatcaggccctagaagacggccaccggtcctgaagcgagctgccacgggcctcaaactctcaaagataatcccaaagaataatctgtgttcaccaactgcacacatcacctccaaacacgtacgtacggacgtaccatggccgccggcgacgtctaatccaaaatttccaaaccaatgaacaatagccggtttgacacgacgaagaagcgacagaaatgcagatagacgtgtcgaggccgattggctggcctcttggacaatttacgaggagtatctgtctagctgatggcctgttgctgcagaagtagcaattcgtgctctcccttttcgttgaaagagagagcgatcgagaggtagcaattacgtgctcaactgatcaattgacaaagcatactatacatttgtctcaaactgaaggattccgcgagaagatttgtggacttgttttcagagatgctaggcatcatatgaaacactgctcatgacgcagatctcagaaacttcagagttactagaggatcacattcacggtcatttttcgtcgccgttgtaaactagcttttactactacttccattgacaggcagggaaaacttcagagcgatccaatctgttcttttctgttaatggtactaaaatatttgcgaaaatctcatttggaaaagtgttctttgcactaataactagtactaacagaagcacttttattgcgagaataagacgagccatccaatggcaactcgttacgctggcacgagctctgaaattccgatctccacttgggcagcacatccaaataaacaagctgcttatgttgtcatctctgtccattactttgccctgcaattcttcgtgaatatcgttatctggaacatggatcagaacaatctagtggcagccagattagttgctgccattatctcttggttaattaaaggctaagacaagctcaggttaaagcgcaaaaggaagtggaaagaacaaatgagcgagctgaggattggttctgacttctgtaggagatgatagttgaagttaaaaaagattaaacttgagaccactcatgcatgcatcgaatgagctgaactgcactttgggtgatttttacggcagtagtatatctgatctgatatttgtttactctgaacaaagcagatcaactgcacaaatggagtgagatcacgcgcctctgctagccttgcagctggattagtacggcaactagtacaagttgacagtattg

SEQ ID NO: 40370 - DNA, 1501 bp, Oryza sativa
gatcggatcggcggtgatggcaacggattgaaccaccgggctttgaattcgcgcggatcctgccatgcacgccacgactgattgatacactacatggatggattgatttgatcgtgtggcatccagaggagatcgggtccagggtgttgctaacccagaagccaggaggttttgtcagactaaaaactaatcaaatcaaatatggccatcaggagaagcgattagtactagtatatttctttaatctttcccagcaaagagccagctgacctttcaggaatgctaatctccgaaggacaaaatcctctcccagatgttggcattgtctggttcacactccgtattgcctttcgggttaagtctccattttttttaatagtaaaaaaccgtgtttcaaacagagacgcctaaaaacaagcgatctgtatcatcagtcaaacccgcactgcagaagagatcagaacaaaacttcttccgaaccaacatatcaacgatgatacggatttggatatcgacgaatcctatttgaactgaactaaatcagccaaaccggatagctaaatccaagaccaatcaaaagcggattgtgcaatcgagagagaaaaaaaagcagagaagaatcgcacgcggcacccatgcatgcaaatctccggcacgtaaacaactctcggattcgccttctgataccgcgagcagcagcacagcaaccacagcattcaaaagcgaacattcaaaagcgaagaagaagagaggagatcaaaaggccaaaaaaaaaaagaaaagaaaagaaaaacagctgcgcacgcagaggagaggagaggagaggagaggaggaggcgaaagcgacgggggagagagaggggcaggaacggcttctttggtttgaagccaattttgaccttaccaaaaattttggtagtgctaaaatcaaatcttgacaagttttgacactatcaaattaaatgctattgagtttaaactattgtgtcaaaaaattgatagcaaactaaatatacatttgttactattgaacctaccatgaatttggtagggctacaaattggtacgaaaccaaccaagcccgaaaatcccaggcggatcgcggggtggcggtgtctggcgtgtggaccccgcggatcccgtccccggatcgagccgtgtgggtgtgggccccacccgctgtgagggtgagggggggtttactcgatccccgagcctcggatccctttggagatctcgcaggatttctcccatttattttttcttttttctttttcttctttttctaattacgagtcacacgacacgcatatcaccccgcctgtatatatacgccagcgatggctgcgcctccaactcattgcaaccgcaaagcctcttctcctcttcttctcctactcgcttactcaatcgctcgaggattcttggattggattattgggttggattttgagttgatcaatggcggcagcggcgcaggctccggcggcggcgaaggtgg

SEQ ID NO: 40371 - DNA, 1501 bp, Oryza sativa
tactatgtaagaagcatataagatgctaaactaggtcagctgaatcctaagaaccagatgttgtaatctaacattttcttccccacaaacccccacacctaaacattgcaggtgatgtacactgcattttcaaagtaggggaatagtgcaaaggaaaaattgcatcagatggaggacaaacacttccaagcaaacaaaggtagtcaggatattacaatgaccactgcttagtggttacacaacatgttgcaggtttcattgtgctacttcaaccatcttcacacctcggccccctgaaacacacatcgacctggtgtttttaatgtgcaaatgacggaacgagatataaaggaaggcaagataaccattataaagcttaaggaaacagtgctacgctgcccaaatgctggatacacaaggagtaccaacctccatttgaatggcagcaaatctagcagcatgcaagtctaacccaagcagcttgtgctctgagcatctgactctggagcaataattttaagataaatgcctgataccgagacatgtatgttgtagctagttgcatagcaccaatctgacattgttcttgtacaaaaagaatccatgcaaagaagttacaataaacagtggccatatgttccatatggtatcgagtcagtgggatagaaattattacgcagaagactgatttcgtcaagtaatttcatttgcatcctgtccgggcataatcaatgtgcatcctgttgcagaggctggtacattgacaaggtgaccttcaaagagtaattcgcaaacaatattattatggagccatggggaatatatatgttttttttttgccaacacaaatgttcagatgtacctgaaatgtaaatgattattgacaagtatacaattggtttatatgtttttgatagcttttacatttgcaacaaaatgttagttcatgacacacaggaactgattatgccccatgagaggttcagatcaaggagtctataatctgtcaggcctcaacataacatgatcttgtatgctacagtattcatttatggaatgtcactgcaaaatagacataaaaatacatcttaaaatggttaacaataacatgctgacacaaacttgaccacctgaatactgcaagttttgctctcattcaaaatggagctgcaatcagaggaaaacaaaggaagagacttgtacctgactctgagtaccagtgattttctgaactctagttaacttgtaatagtcatagtgtcaaatttaaattgaaaagcataatgcattggttcctatcttcgatctcaacagtacaaatctagctgaataaaaggatacacatgacttggctccacaagttttgtgagtttcagtaccaggaatcacaatagcataaaggtacatggtgcaaccagaatatctgaaactcattatcagaaacagatatcatgtcagaaaatattatcctggaatacacagcgacaaagagatccatcca

SEQ ID NO: 40372 - DNA, 559 bp, Oryza sativa
aaaaaaccggatatgttggctttgtttggttcatcttgccatgtactaatgccttcttttgtcagtatggctcctaatctgaaactaatcaaggaatttgctaatgaactgaaatttctaatctgaaactctgaaatgaatccaattgattgcataagctttttacaatcttcttagataaccattagaataaaagcagttgtactgagtccacaactactgagtttaatcagtttactttgtatggttgaagcagcccatggtaaacttaatgatatcagccatcattttctgttgctaagctaagtacctcccaagtctacatggaggcaatagaagattttgttccagttaataaccccagccaaaccaaacaaaaacaaagaatgacacatacatgaaaatgacaagacctacaaatcactatcctctatgccatctttctctaaaatcagttcatctaccagctttaagcaggtccctacctcaactaaattccaagacaattgacatcaggacacaagcaggtagttaaaattagttggaacaagatgaacac

SEQ ID NO: 40373 - DNA, 1501 bp, Oryza sativa
aggtgttgtgcacggaacaccacttgccaaacttttgaccggcctccttctttttgtcgctcgcaggcctcccctttcgggtggcccgcgaagcgccctcgacggcgaggacgtgaccctcgtcgtcggaatgggccgacctcttcttcttcctcctgtcccgccgccctgaccgagcggcggtcccggaggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgtgcagggatgcatggtatggtgttgcggacttgacagaaccgctgaacatacgagcgaagagactcatcgtcccttcgctgcaccgcatgcaagtccgctttttcgcctgggcgcggatatgtgccctggaagttcgtggtgaactgctggcacagatcctcccaagagtggaccgacgcgggtggcaagttcattagccaaccccgcgcctgacctttcagggccatgggaaagaaattcgccatgaccctatcgtcacccccggcggcctcgatcccagtcgtatagatctgaagaaactcggcggggttgacgcttccgtcgtatttttcggtgatggtgggccggaaccttgggggccaacggacgttccgaaggctcgccacaaaggctcgacagccggcaccgccaaccggggacacggggggctggcccctgtgcccgaaccgaagtggcgctccggacgaggaggcgccctccattgcgtgggcagcacgacgaccattgcgccggcgctcgatactggggcgggtatccggccccccacgcacatcttcttgggtcggaggcgttgacgagggaatggcggacgaacggcgggaaacggccgccgctcgccgcgccctccgcctcgacgacacggagccggtggtagcagcaccagaggtcttggtggcggaggaccgcccaccggcgcctaggcgctgctgcgccgtcatgaccaagtcggccacgtcatccagccaacgtcgggctggagtctctggatcggggacgatgggcgggtgacgtaggagcgcgcccgcagcctggagcgcgccctggggcgtgctaccatcgccgtagacgaggaggcgacgctccccgtctcgccgtccttctccatcgcccgcgggcggtgaagtcgcggatctttcgaccccttcgaacgcctcctcccgcccaagacttcggcgagagggggacggtggagtacgaactcgacggcgcgggttctgctccccgtcgtcaccgctagcgctcggagagaggttgtgcgccactgcccgttcggccattgggccgagcgggagaagcttggcgcacacgaaagaggatgagggcttagaaagacacacgcgccccctacctgg

SEQ ID NO: 40374 - DNA, 1501 bp, Oryza sativa
ctaacatgttagcaaaggtatcatgtgagcatctctatgacatgccacatcaaatattggattgatgctaatacatttaactagtttatggggggtataatatgtattttttttaagtttgtggacaaacataactcatgtttatttactcatagaactttgcatccacgattcacccatccataaatcacactatggatatgacccttggagtcaaaatgcccttgtttcttgagaggaataagtctatttcgcatccctcatcttttatccttgatcgaatcgcctcctccaaccgcaaaatcgggtataacacatcccccatctttgaaaaccggtgcaaatcaactcattcggtggtgtcggaagtagttttcataggtggggctcacatgacaatgaggtatggcaaaaatatatggccccacctacaaaaaccaatttcgaaaccattaaaggagtcgatttgcactagtttttaaatatgaaggaggtgttatacctggttttgcggtttgggggatgggattgatcaagggtacgagatgagggagttaaaatagacttatttctttttgagaaacatcaacaggagaggaagaattatacttgggccggaaaaagtacatctaaggtccctcatcttgtcatcggattacaaaattatcccccaatcgcaaaaccagatatatgggatccctcaacttataaaaccgggtcactttgggtccctagacggttttgacccggttttatccgacgtggcagctgagtcagcatgggtcccgtatgtcagtgtgtccactttatcactccctctttttcccatctctcttcatcctctcttctctcccttaggtcccgttcttttctccaacaaagagttggatgaagattaagattttcgtggcacgcttttcaaactgctaaattgtgcgtttcgtgtgaaaactttctatatgaaatttgctctaaaatatcatattaatctatttttcaagtttgtaataattaaaactcaatcaatcatacgttaatgccacctcttttgcgtaaaaaacttaatcttcatctattcatcttcgggagaaaagaacaccacctactcggttactctctctctctctctcaatattctttgggcaggccgacccgcgggtgcgaggtgggagagagggagggcggccgatgctggggcggcgacggccaatgcgggagaaggggagacggtgtctcgtcctaccgccacaacgacgccgtccattccttcctccttgctaaggcctctggctctgatttcgtcttctcccttctccgccgcatcctctcgttctccccacccgccgactccctcttccgccaacgccgtccactcctaccctcctccgccacatcctcataacctcgccagcggatggttgaagatgaagtggctggggtcggatgccccgcggtcatcccgcgcggcggtacctggtaccgcccgagctcctccagcatc

SEQ ID NO: 40375 - DNA, 654 bp, Oryza sativa
tgtgtgtcttatttgctctatatctctctcccacatatcaaggagacaacggaaagctctagaacatcatcttttatccaatgactaagatttattttacctgttttgtttgtttattgatttaacggctattattcattagatgatgtggcacattcttgttctgttttgggattgtcttttcaagagttaaaataagacttgaaagatttatttatgtgacactgatattgcctatataatcacaatttaacataatgcccaaccaaataagataatcacatatttttacataatgtctgatcacataagctaccttcaagttactacttgggagccatcgtttcttttattcgtggaataagcggaatggcaaatttacaaacgaaaagtgatttataaataaaacttttatataagtgttcttaattaatgatctaaaagcaaacgctgaaaaataaacttcgatgagaaaacctcaaaatcagctctaaatttaatgttgaaaattcaaattttggttgataaatataagcataagcgaaaagatgaggccccatgattacaccgaaaaaaaaacctctcgattaaccatgcgtcatgtccaaaaagaaaaaaagattaattctgcaagaaaatgcttgcaggttcttg

SEQ ID NO: 40376 - DNA, 385 bp, Oryza sativa
  unsure (1)..(385): unsure at all n locations
ttcctgcagccccaagcgaggaaatgataaaggctgctcaacgcctcacgccaaattaaccataccagtaaaatcaagctgcagttaatctccatgaacagccgtcgtagccaccctcccctagctgcagccgcgacgcgggctcggcgaacccgcacacaaatgagaatgtgaagagagggcaaaaaaaaaatcccttgcggcgctggcgctccggggctccggcgcggcgcgacgtggggcgctcctcgccacgacccacgcctttaaactatacgccccgacccgccancggccgcgatcttgatctcctactcgcgtgcgtattcctgtggccattagccgccgccccccccgattctcatttctacttctccccctcagc

SEQ ID NO: 40377 - DNA, 153 bp, Oryza sativa
aaatatgccgaattatgaccaaagttccaacaatccaaaaacctgctaggtcattttcggtagttggctttgctgcaacactgaaaccacatgcttttgatggttctaattataagagatggaaagcacgtgcactactgtggttgacaggga

SEQ ID NO: 40378 - DNA, 181 bp, Oryza sativa
ttagaaattattcatagttaaatattttgaagttcgatcttagccttgtccaaaacgatgaatattataaatccagatagagtacttgtgttagtcttttttcactttgcatatatgaagaaatttatatttcaaaaaaattgagcaaattttatttgtgtttactttttcctctgctaga

SEQ ID NO: 40379 - DNA, 1501 bp, Oryza sativa
tcgaaaaccccttccaatatccggtcaaacatccgatgtaacataaaaattttctttccgcgaactaaacaaggcctgagtatatgttactacagtaatatcgatttggaggggaaaaatgtaaaatgggcaatggcaacaaatttctcttgattgatttgatctaacaacagaaattaagtgcaaagtttagcagaccctggtccaatatgcaattaaggtgagaaaaggggcgcaaagtgcaattccactagaaaaaaaaggaaaaaagaattaccagttggccaactgcacacaagcgaagactcgatccagggtctctcaggcctacaagcccacgattaagcccccatcccgtaatcccccacgctccatcgatcgtcgccgcagccgattccttccaaatctcttcacccgattgaggatacatctaatctgagctctctagtctgcaggtaatcttcagtttctttccaaatctttcctggtccattcaaagtgtactagttcttgttctgtttagttctctttttttttcttcgttttgaacgttggttgagttcttggcgacgcacgccatgattgaatagaagtagcttgtttgcttaagattacttggggttgtgtagccatcgcaagattagaaagatttggtcatcttggggtcggggttgacttggggatgaacgaggagaaagaattaattgcgcattccttctgctgaaatttcagatgagtttggtgtttgagctgtagggccttgctctgaccagtgatctgtcacaatcgagtagattcttaaacaggaaatgtgaaattggatttgctacttggggaaaggagggaaggtgattttaattttaggcaagttggtggttttggtttcttggtgaaacagacaggttgtgggacgccggtgggcgttttactgaagaatgtcaatcaacacaaatatgtcaatgatttgaaaattttacttaacctatatcagtgtagtttgtaatctgagtaagttaattataactctgtgttttgataaccttaatcaagaaattgttttgctaagctgtatgatgatagcactatggatgcaacctacttggatactgaagtaatcagcttgtgcttcacttgactattccatctggttgtagtctgttgtttgtgtcatcttatataatatggcattgtgatctgtttattaatattaagcgacaaaaagaataaagtggcatacaaaaattgagtgaactcctacaaacttttagtgagagttgagacccatgctatgcagacaacaaggaatttctcttgagtacatagactgtagtaattacttagtagtcatatccagattctgaaactataattcagtacttctgaaaattttgtatgaggagatccatcttatcaaattcaagctgaaagaaggtgcaatatattcatattggtgtgcattattgccttaatcattatattctgtgttccacttacccagata

SEQ ID NO: 40380 - DNA, 539 bp, Oryza sativa
  unsure (1)..(539): unsure at all n locations
cgactactgtatacacacaccagtgcttcgcatcgcagccagggtttcacttatcgcacgataatcgggcgagtatcgcgcttattgcggggatacggtagaggaaaccggcgatatggtttggatgaattttgaccaaattcaaaattccgaaaaaaaatcaaaaaaaactgaaaaaattcatggatgtagttcttgatttgtaattgccaatggtgaagaatttttttaaatagagtaagataaattcaaatttgaggacaaaaccaaaaatggttnnnaattgaaaaatgaagaggatattggccttaagtatcctgcatatttttgattattctcagtttctagttttctacacatattcaaccgtatttttgattttttttaccctatttattttacatttacattatttcagctacacagcccgcgataaccgtgcgaatatcgcggtaaaccgtgcgattatcgcggtgaaaccgcgaaaccgttgagttttgaattcaaatttttggatgtgatttttgtgcgattttaga

SEQ ID NO: 40381 - DNA, 1501 bp, Oryza sativa
aatacataattggaaacgtacattcataatctaattaaacatccaataaagctatatagttttgtagtagcctccgactaaaggctaggcaggtgggaggccgtcgtggcattggcaggggtctcgactgatgaggattttactggcttggatataatcattcttatattacacatcaacaagcgttcacatgctctatatatatattaggtttatttactatatatttgaacaaacattcgataatcaattaagttgattggagaccaatcaatatccttcaccaagtctactccaacgtccccacgtcacttttggtccatttaaagcaagagaataacttctccatattttggaatcagattcgagcctcatgacaacatcaacatcaaacggacctaactactgatatagaaggactctcaggcttgtgagtacttttgaaaagcttatggagtctactatcatatggttttggtcacacattaaaattcttcatgagcaatcgacaatctgcaaaacaattcgtatcttatctagtttgagtctgatttggacaatgggccttataattatgtcatggactaagtgcaagggggtgtgcgacctggggttaaccctaaaatgttcctaatcctatttatttagcagccttcatcgtttagaggggagttttgcttagtttattctgccaatgtagttttaccgctagtctggtttgtcgaaccctaatttgtgagattcatcttatatgcacaatatatttagattgcatcttctacactcttgcttgtgttctcaattcgcttgtaggagatagccttatcgacgaggtcattcgtgtgtgaggggtctgatcgtcctgatcggagcctttgtatcatcaacgtcaagtctttctaatcaacctatcccaatacctaatgaaagctcgagaccctagtcctcatcaggaacctatccggtgttgagcgagaggtgatggaggccaacatcgtaggcaggttaaattggaggcagtggccaaagcagagtggggaggtcgcttgtccagcttcaccacgcctatagatggccaaaaggcccgaggcccgacggctcggcccatggcacggtattttggcccggcccaagcacggcacggcccgacagaggtcgggcccgtgccggcccgggccgaccaccgggccgtgcctgggcccctccaccggcatgttgggccggcccggcacgatgggccggcagctaggcccgatacacaaaaaaaataggggagtaaaaatagacatattatatgccatggacgaaagaatagggatctaaaatagactttttttatctctacatatgtcagccaaagaggagggacataaaatagacttattttagctatacatatgtcagcccaaagaggagggacggaaaatagacttattttagctatacatatgaaatagcccaaagaggaggaacgaaaaatatacttattttaaaaaaggcc

SEQ ID NO: 40382 - DNA, 354 bp, Oryza sativa
ttcttaaacttgctctaagttgacaagtaagttctcccaaaaacaagaaattaattaatcccataagtataagatatgttaaagtgttaatccttcagacctaagtacccaactctacaggatcaagcaattaagtatcataggccggcttcccaaatgatcacctgaccatacacatagtgtgtgtgtatcgtgtcgctaactgtgttttgtcctggagcaccgtatgcatgttgcatcatagatacatatagccccatgcatgtggccgaattaatgatgaataaacatgccatgagagtatatacgagacatacacatgtgcaaaactattatattactgtatctcacagg

SEQ ID NO: 40383 - DNA, 1501 bp, Oryza sativa
gccacgggccgggctgtcgggccacgggccgggccatgggaacatggttaccttcctgggtaatttggaaccatgccattataattttgtaaagtttaagatatgccattggtatcttaatgacatgtaggacccacatgattcaatgatatgtgggttaggatgatatatctcaaatttgaaaaattataatggcatgattccaattttccctagcttaaatgtggaccccacacagtgttcctggaatcttcgcatgcatgcgccgctgatgtcccgcatgggccccacgctgcaacccatgagatcgaccagccaacggcgatggatttattcgggaaaaaccgaaccgatttttttctgtgtttgttttttcttttttttaaattacatcgctgtttttatttcggatttttttcggtgtttctatttcggcttttttttctcaatttttttctttttttttaaattacatagtaacaacgcagacactcacaacgcatttaggtgtttctatttcggtttttgttttttctcaagttattttttataaatttataacaacactgacactcacaacgcacgtgcactcaccccctaccactgaaagcacaatgccgataagtcctagaaaaatcactgaaagcacaacgccgataaatcctggaaaattcactctcatggataatcgaacccagaatctaagatgctactgagactcttgtaactaccgggctacgggccctttcgcagtttcttcggtctccattctatgacaaccgagctcatgagaaaccgaacttatgaagccaaaaaaaaaaaaaaatcgacgcccaccctacatacacctgcacagctgcaatgaatcaatattcctgataaaccagaccagggtttaaacttgaacaaaaaatatcaattcaacgaactgaacttgtggaaattgaacagcagaggtaaccgacgtgtacaacatactgaaactggcatgtatcacttaatgtcataactcatgacaacgatgattgtactgatgtgtggaatatcataagaggtaaataatacatgattattcttaagtagacaaacgtagagcttatatttgggggcactaaataaaacagagtaaacaaagtgttggacacctagccctccctacattagattgatccccatgctacatgaagaagtaatcgagatcgagctaacatatttactggaaccgcccgttccagtattattatcaactcgagtttagaaaagtgaactgttgatagtattggaaaaccaaagaacaatgtgtgattacatgtaggaagaggagtgtgattggttttatatacaacttttgtgtgcagtcctgacaaagggtacgggtagctaacctataagtttccattgctagctgtgaaggcagcacggttaaattggattttttgaatatactctgatcgacaggatattagtgttcatttcattcctatatccttctattcctacc

SEQ ID NO: 40384 - DNA, 395 bp, Oryza sativa
tcaagcttgcatgcctgtagtttgttttcttaggggagtttttcttcctttgtaatcacccaaaaagatgaccggtgggcatccatagaaacaactgtacaactgatcagtaatcctatgagggtatcacgaaaataagtgatctcgaccattaatttattagttctattatcaagataaaaattgatcaaactataccaaataatctgtttcctatatctcgcaagtcagaatcaactgtttctgtcgagaaatggaaaaccaacgattgtatttaattccgggtgggctgccatcgttacttgctttttttttttctatctgaacttgctttttggttaaaaaataatttaaccgaagactagaacagatcacattgcaggcgtggttataga

SEQ ID NO: 40385 - DNA, 1501 bp, Oryza sativa
ttaacacaaaattaattaagtattagctatgattatggtaggaatagaaggatataggaatgaaatgaacactaatatcctgtcgatcagagtatattcaaaaaatccaatttaaccgtgctgccttcacagctagcaatggaaacttataggttagctacccgtaccctttgtcaggactgcacacaaaagttgtatataaaaccaatcacactcctcttcctacatgtaatcacacattgttctttggttttccaatactatcaacagttcacttttctaaactcgagttgataataatactggaacgggcggttccagtaaatatgttagctcgatctcgattacttcttcatgtagcatggggatcaatctaatgtagggagggctaggtgtccaacactttgtttactctgttttatttagtgcccccaaatataagctctacgtttgtctacttaagaataatcatgtattatttacctcttatgatattccacacatcagtacaatcatcgttgtcatgagttatgacattaagtgatacatgccagtttcagtatgttgtacacgtcggttacctctgctgttcaatttccacaagttcagttcgttgaattgatattttttgttcaagtttaaaccctggtctggtttatcaggaatattgattcattgcagctgtgcaggtgtatgtagggtgggcgtcgatttttttttttttttggcttcataagttcggtttctcatgagctcggttgtcatagaatggagaccgaagaaactgcgaaagggcccgtagcccggtagttacaagagtctcagtagcatcttagattctgggttcgattatccatgagagtgaattttccaggatttatcggcgttgtgctttcagtgatttttctaggacttatcggcattgtgctttcagtggtagggggtgagtgcacgtgcgttgtgagtgtcagtgttgttataaatttataaaaaataacttgagaaaaaacaaaaaccgaaatagaaacacctaaatgcgttgtgagtgtctgcgttgttactatgtaatttaaaaaaaaagaaaaaaattgagaaaaaaaagccgaaatagaaacaccgaaaaaaatccgaaataaaaacagcgatgtaatttaaaaaaaagaaaaaacaaacacagaaaaaaatcggttcggtttttcccgaataaatccatcgccgttggctggtcgatctcatgggttgcagcgtggggcccatgcgggacatcagcggcgcatgcatgcgaagattccaggaacactgtgtggggtccacatttaagctagggaaaattggaatcatgccattataatttttcaaatttgagatatatcatcctaacccacatatcattgaatcatgtgggtcctacatgtcattaagataccaatggcatatcttaaactttacaaaattataatggcatggttccaaattacccaggaaggtaaccatgttccca

SEQ ID NO: 40386 - DNA, 490 bp, Oryza sativa
aaagtctgaaacactatgcatgtacagtagcacaatccatccaatctgacaaatgatctactgctctgcgtccgaagatatagcagtttctagcattttaaaattatctcaaaatataataatttcttggcatacttattcatctcaatcaaacacaatgtatctcttgtttaatttctttacttactctttcatcttaaccaattacgactagtccacctatttaattttacctttctcttcattacttcatgaaaaaataaaaaaaatattcatattttggtcagtaccattgatcagtttcgccttgaaagaagctggctggatctgtgagcggcaagagccgaatcaggttcagagaaaaacctgcaatgcaaagacgaacggcaaaatttgggccagtcctcaagtacggcccactatgaattatgggccttctcctcttccgttggaataagttcactttggatccctctatttgtcgcccagt

SEQ ID NO: 40387 - DNA, 960 bp, Oryza sativa
  unsure (1)..(960): unsure at all n locations
tatgttgcagtcacactaggtactgcaccggatctaaatccgtctgcatgtgtccaaagggaaaaaggcaccaaattacttgcagttgcaggcttgctgtattttcttaatcactggttgattcagtgtaaggaataaacatggtgactgtttggagtactaacaccgtgtttagttctaaaccttttttcaaactccatcacatcaaaacttttctacacacataaacttctaattttttcatcacatcgttccaatttcaaccaaacttctaatcttaacataaactaaacacggccttaagttaataatcaccgaaaaggacatcattagaccagagtttttggacttggtgatttactctagtggctctcctttgattttttttagagaaggttattttctacccgacctccatatccaaccggatatatacagccattgagatagggaacttagccccgtaaacaacctaatctgaaattcactccatagaagattttaactcagaacctcgtactacttttgtactactcaggctctcctttgatggggcagtatattactctctccgtttcattttaagtgtaaccatgagtttacatgtcaactttgatcgtccgtcttatttgaaattttttataattagtatttgtgttgttatgagatgataaaacatgaatagtattacttgtgacttatgtttttatatttttttaaaaaaaatttnnncagacagatgattaaagttaggcgcgtaaaatcatggctgtaataagacggagggagtatcactgtatcgtatatttggacacaatcaagcaagtcagtactgagaaataaaaatgatctgtactgtaaatgccaagttaagtacatcagcacgatgtagcacgttgtacttttgtaccgcggatcaggtgcagattcagggaatgattgagtagtctgctctacagc

SEQ ID NO: 40388 - DNA, 845 bp, Oryza sativa
agagcaaatcatcattgccttttaatatcccatttagagtaatattaagtacaaagatagtcatggaggtcaattgataggttttctaatcattttatagtacatattgtcggtaagaagtgtcacagcattgtcacttaaatttgatatagaaaaacagagtaaacaaaaaaagaactcctgactttggttttgttcctcttgtccattaatttagaaaggaaaaaactaatatcaaacaaaataggaagatgagataataatcagtgcagcaagttctattatcagttatttgttcttgtctggcaactaagcagtgataccccgctatatttaaagacatgcatttagtcatggcattcaaggaaaactgaatctaagtggcaattcaaacatttccaaagattgtgtataaaataatacatcttgaactgcaatgtagctgcttagcacaatataacatgagaaagcagagccacaaggttgatagataaccaaaaatcaacttcaagaaactcctggaattttgacaaacttgagcaccttctatggtagtagccaatcctttttacgtggacaaaacaaaaggagtcatcagatttgatattcacatttataatcagattacacctatttctctaaaaaaaaagattccactgtctattaacaaccatttcacataccaattagagtagaaggcaaactagaaagaaagataaatattagcaatttttatccttttaacacagaaacacaattgtaatgtagatccaaatctggtaatctgcttttgcattagtcaatgaggatgataattctaacagagttagcttgatacaaagaca

SEQ ID NO: 40389 - DNA, 289 bp, Oryza sativa
cgttgtcatctattaaaaaacggatggagtatgttttttcataaaacgtttatgacgcacatgcactctcaccaaatacatacacactctagtacgttctctaatccaacaaaaaattcttgttgaaatcatactgctatgtaagagaaatctgacatgacatggtgccattgtcaacagtggatttcaccaaaatatcacttcgcagaagatattcgataaaataatgccactctcgatccatgtctacaagctacggagtataatgctaactaggaccaaattgcca

SEQ ID NO: 40390 - DNA, 389 bp, Oryza sativa
ttgtggagctgcaatatctgaagtggacttgctagattaactgaaaagaactccaaatgccatcaattgtacaattcagagtctatcttagtgtagttatctgcttctttactgaccattttcatctattttataagttggtgctggtgcatccttcgtgcgacagttatttgcaattttgtatttaaaatactgtattatgcttattctatcaggataagttcttccatttttctaactatatatattttctcattatgagctatatagatattacacaatatatttgtggcatgtacttctcaatggcatttaattgactgtgtattcatcgatatagatttgacttacattttctcccaaacaatatcttcattcttgtgcttgca

SEQ ID NO: 40391 - DNA, 825 bp, Oryza sativa
gtaaggagattgccattgtggggagtcgaaatgcacaaagatgtcatggtcgggattgtgcaccaacgaagacgcaagaaggcgtcgcttggcgatagtgatggcacagcaaaaggattagcgtcgtgatcttctccgtgccggacggggaatagtatccagttatctcgtgagatgtttagggagttgttagagttagttctttttgattagcagattgttagttatggtttgcaagcctataagaggcacgtttagatcattcaagggataagtcagatttaatctatttcctcatctctgtttctcatctcgtttcatcggcgtgcccatcacaggtcgccggtcctccaagccaccgaagccacgccctcccaccttccacacatatccaatccgatcacttatcgcccataacaaaagatgaagcattatttcttttgttggcaaggatcaaaagtgacattttgatgaacatctctgtcgtgaaataccaggatctgtttcggctaatttgaacatcaaaatgcttgaactggggccagcagtaccttgtcatcactcatcaataggggccagaatcgcgttgtgacaacttgccggccttgctaacgacgattttcatcaagacgaataactaggtttggcagaattaggcactggattcttactgtgcagaatttcttccttcatcctcccgttcctaccacagttcctatgtaaactaaattttcatctgagaactcaataattctggagaggggtgtatggtgaatcttattactagtgtcagtgggaggatcgaggcgaaactaccatatggga

SEQ ID NO: 40392 - DNA, 1501 bp, Oryza sativa
tctaccagcaacagataacatgacaaacaattggagaggaacatcgagagcatttttcatgttaagtcatgtcacttgcctagtaaagttataacatactagccaagagcccgtgcgttgcaacgtagacagttgagtttctagcttattaagtcaattaagcacacatttaatcaaaaatagtatttttatgattttccttattgaacaagtaggtctttttgaaatttgggagagccgaccgtgaaaccgaggactcgttgaagggtgatgtaacagtagagattgtgagacccaaatatcaataggggtggtatggcagacttggacaccgccaccattttaaagtagtatagatatagatgtcagtttcaaaatagatatccccttgccttcattagtcgttgtctctctccatccaaaaacataaggaactccagaaattgaggtgaaaagtaaaagatgcttgttaaatgagggatgagagggtggttgggtgtatgattatgtgaaaataaaatcataagtggttagtggaaattgtattctaatagttctttatttatatggacgaatttcaaatgccagaatctattatattttcaaatggaaggattcaatggcatttggtagagtatttagatcgagtatacctattagagtagagtacctgtcacgcccagaaattcactagtaattttcgaactaatttgtgcataaaaccctcgtccaggaatcagccgaggtacacaaactgacaatttaatatacagaatcatcaataatacagcgttacatacttacaaaagaaaagaaaaacagcagcggaattacaatctagcgaagctccggctccactcccacaggcagctcaactggggtataagccaaacgtcttctccttcgcaacttgtctttaactgaggtttgattgattattgcaaggtgagtacatggaatactccgcaagccacacaacaaatatgcaagtgcacaaggataccaaagaatggcataatatagggctcatttgcaaaagcagaatttacaaacatttgagaattgtaaaacagtagagtacttaatcatcaatattaatcaacactgaacagcacacccatgctgctcaggcccaaccatcctgaacaaccatacccggctgcacagatctatctccaaaccaggaaatgtaccattgcaaaccaggagctaatcaaattattaccagttataatatcatttattatggtgagaagtgtgagactaatcacaacagacattgttagacctgcgcataaccgcgggcatggctattcgaatagttttactctggccagaggtgtaccactgtacccacaagacacagccccacaacatgtcaccatgcgcctcaataccaccacggtacctcagaaaggagctgtgacagtacccctcgcacaacataatccaccacagcgcaccgttcctggatcataatcacccccttataaacaaggca

SEQ ID NO: 40393 - DNA, 1501 bp, Oryza sativa
gtgatacgacgtaaacatgaaaaatcagcctcatcttttcgtttatacttatgcttatcagccaaaatttaaatattcaaccttaaatttgaagttgtttttgaggtttttttcatcgaagtttatttttcagcttttgcttttaaattgctaggaacacgtatataaaagttttattcacaaattattttttgtttgtaaatatgccgtttcgcttatgcttaaaataagccaaacgatggcttccaattaatgtcgatgttcctctctaattatttgccatgctatctgttgctggtacaaagaacgtaactggccggtttcataaaatgataatgaggtggctgctcttttaggacaaaaactgttccttgcaactctcatactctactaatcacttctttcatgatgttatttatgacctaatgttctttatactatttctcatccctcgcatccaactagagtctttgcacacactcaaattgttatctgcaatccacaaattctgaaatgtgtattattaacccaaaaaatagagaaaaaccacagacaatatctcactgcatgttactatcgttttctatttttcccttagcaggcatcacattatattatgctcgctctccgggtggaactaccagcattatctgaagttgtaacagctttgcagtccaagactccaagtggaacaaatctgtgtcagagacgttattttcctaagtcctctcgttcccattgtgtttctatctcaattttgtaagagaaaaatacatagtttcgagcaagatatgctctggttggcgtctctgtttaacaatgttttaccgtttatatttcacgatcatcatattttcaacttatccaaaaccaagagtgccttcaaatataaaacttaaatggaaagcgcatctaagacaaacaaatatgcatcacaaattgcttatataaatggtgaccaagttaaatagatgagctggtcatgcaatctcttactttgttgtagcctatgttgtgagctggtcatgcaatgtctcttactttgttgtggcctatgttgggccactgatacaatgttgatgttagtataggcatctgaagtaactaaattgatgagtaatataaatgtaatagtactttcctttagtggaaaacagtatataatttacgcaatggaaccaagagcgaaacaaattccaagatactcctttggcatacaaagaggactactaaagattacataagatttttcggagcttttgggtattcattgtagctaagagcctaagacctctcccaacaataagccaacacacagcagtggagccagtgtctggccacccaagtcactcgcctgggctcatcggcatgaaacaaagtgtaaggatgcacttcaatttaatctatactagtagtttgtcgtagtagagtttgcctaagcgcactatagaatttttttgatcaatcattgttgaagcagaaccctcatgtagaacgcgat

SEQ ID NO: 40394 - DNA, 1501 bp, Oryza sativa
aatgaggatcaataaagtgttccttgatcgatgaggatcaattttagaatgatgggtgttttggtatccttggtcttgatgccctttatctagagaatgaccaaactaggatgggggagtattacatatcctctcttgctataaagttagagccccctaaatcttaaagcttaacatacaaagatgtcacatcattatccactaacaattattacatttaaatataatgcaagcatgttatattatctattatttcataatttattaaattttatagtttttcaaatgcaagcatgttaaatcatcatctcacataattcacgtaatatttgaatatgtctcttcatttttttataacatcttatatccctatatatatagttcatcctaacttcaaacttagttagtgggttatctcttctctcattaagctgtatcacatcaattgttttgtccttagatgattatctatggtccaaattatctcccttcttttcttctctaattaagtcatatcaactccattatttttagcccatagatgattaatctttgatccgaactatcttcctcattttattctctcataaattcatatcaacttacttttatatttaaattattctatataccatttaaatttaaattatcataaaccacatcaacttacgtaagtttatattgtctagctagcttacaaattacttttacttagtgtatcatactaaaatcctacagcaacgcacggggtttcacctagtaaactgtgatagttcacctcttcgcccacatgccactcgaattctccacgcacccctctgcacaactgttgagttcatacatgaaaatttaatttacaaaggaattgtggtaggaatggaagaaacaatatggtggttactttagccaaaccatattgttaggacaaaattttgtaagcatctcttttccaaaatgcaggcacaactacttttttatgatgtgtcataatataaggtgtgtatgcatgcaacaccaccttctttcccctaaattccaccccacgcactattcccatccgacgtggcatcgcccagcggccgcctcaggagcgccttttatttatcgaattatcttttaaaaaacatcctccaccctcaagatttctaattctattgggtgcatggattatatttattgggtgattcaaataaggaggtgacaatagttgtttcattgtctttaggttaagggtggttgtgccttatattttagaatggtgggagtaataggcatctacatacaaagccgtgcaccctaatctggaactttttgaattttacaaacaaaaatatgcacaagtggaacatgaaggattcaaacccgagagtccacactctccatccataccattcttaccatcgcacctacacaatccttcttgtagaagtcatatgctattcttgtaactctttttgttcaaaacatgtattacatccaggacattcttgatgaattaaaa

SEQ ID NO: 40395 - DNA, 697 bp, Oryza sativa
cgttgctgtagtgctatcgtgaaatttcatggtcagtagttcatgtgcatggtcgccctgatcaatggtggtaggacatctctggagctgtttttatgcgatattcctgcaaaattcctagtacgaattcatgcgttgcaaacaagcccgtatgtctccttcatttcttgatacgacatggatggattgtgttttggttgacaaaatccaaggagagcaattttatgcatgaaatgagaatgagcaattatcaggctgcgcggccgcccgccggcaccaccgtgccgtcaggcccggcggccggccgcctccatgcacccccggtcacggcggtagggcagggcggcctagcgcctctccagtcgcggtggcgcgcctcccggctggcttcgcgggagcggccgacaagggcgaggtgaagcgccggcgtacgcggacctgagggcgaggcgaagttgagtctgtctcaggctgatccggcgtacatggacgaggacgaggctaagtgcgtcctgtgcgcgtgcgggcctcctgttaggttgaaacggagattctttttgcctgcgtgccggctcaaacgccatctccgttggattcattctggacgcccgagatgcatggtatgtcacgttgtgacttgcctatgctaagtaaccgaagctgagtccctccgcgtttccacgctcatgccccacca

SEQ ID NO: 40396 - DNA, 1501 bp, Oryza sativa
agaaccaactttccatgggaaaatgttcaaaaacatcaaaagtatattactatatacattttccatgagaaatgtgcagaattgtaatttgtaaagagaaattttcctgtccttaaggagggaccaagagtattaaatcactccatacaaagcattctattttcaatgatctactcattgcccaacttaccaagtatcatttgcatgtaccataacttattactctctccgagttgttaatacttctcggacaaggctatggtcaaactttaaaaactttagctataaataatatctaaaatctttatcttagaagtatggtggagatttcttaaaaaatagttcaataaaatcatatttttattgatataattatatatattgtaataaaaagaatggtcaaagttactttatggataacatgtccttgtccaaaacgataactattatcaacccgaaaagagtatatcgtataactgattggggcatatgcacagttgcagaatattgcacagcaaaattatgctctctaatgaagaagatgctaatgaagtttgatatttagaaggctttttgtatttttaaggatttgaatagcaaatattgttatacctgattgaacataggcatcaagtcatctatctcgggccttctttttatgctaatgatacgatgttgttactagattgtttatgatgcctttgccattagaactttgtatcaagaaaaaaacggtttttcagtaatttggattctggaaatgcatctagcctgcatagaaacctacataaatatttgaatgcgccaaattatatgtatcttgcagaataatgcatgtgaaggtacagccatttgagtttgagttcttattttctaactgatgttttctttgtctaacagaaaatcaactttgccccccaatggatcatatgactggggttcagggttctaggcttgtttggctatggctggagcccgaccatgcagaccatggatattctggttacacttgaattgaaaaatgtattgtcaccaagtatttaggaagattgctattctgggaggacaacagtgctcaaaggtgacaagctcattcaagggcgcattatgcttgcaaggagcacaagtgacacaaatcttgcagaatatgatattttttacttcaatttgcagaaccaaaatgcgaaaagaagggccattgcaatccacccgtcaacataatacatatggcacaaagctatagttaagtattacagaaatagaggcgaatgatatcaggaagctataccgtacctaaggtatcacaaaggcatggcacatagacgtatatgttgcggatatgcatatcattgcttaacaagcaggtgcggtaaagattttaatgaatgcactacctaaatattcatgatatctttgataaatgtagtctctaacaataatcttgtggtacagagcttttactctataagtaagaatatatattcaggatctctcacagaag

SEQ ID NO: 40397 - DNA, 556 bp, Oryza sativa
ggggagggggcgtcgcctcaagtacctgtaccaacgcaacgggttccttccaccagcgcctgtgcgaaaaggagctgggggagtgggaggtctcctagctgagggacacgctctctcgcagggggacgacgctgacggaaaaggagacggccatcgctaggggcacgggctgaagcaccgcattggtgatgaccttagccttgtacactccacacacacacacaatgatacaaaacgatcacatctctttggactgggtgacggctacaccacaaaagtacaaagcttctccccaagatctcgtctcgactctctcgatccagcgctgtcacagtgtcacgccaagcaaaacagtgcattcgacgacgaaatgcacacggatacacgtgtcacatatggcttcacgctaaacactcggtcaaggtcaagcataaagcaagaacagtcagaggtctccaatgtccaatctccattttccaccggcatgatgcaacaagcagcagcagcagccgaagcacacggctccggtcacccggcggcgtccatggctgacgac

SEQ ID NO: 40398 - DNA, 384 bp, Oryza sativa
acacatggtaattattaattcgttctgcaccaagttctaaacatatcaatttcaagaagacacaaaaatttctctagctgacagctgtccatatatatgaaattatcgattactccaaagtttgtcagtttcgtgtctttaaaatatgctttagtaaggccattcatctggatgttttgtgtattttttttaatttttttatgtatggaactaaacattgacgccttaaggaaggtatgcacacaagatcatcttcctattcatgaagtgtttttggaacagttttaacacaaactgatgttccacacttttttttagaagcaaccagtgtaatagggtaaaacatttcgatattccaatgtttatcctgctgagcttttgaga

SEQ ID NO: 40399 - DNA, 1089 bp, Oryza sativa
caatattcttcttcactgccctaactgcgagtgctgaccgcccaagattatgtaatgttcgcatcgcattaagttttgtatatctgtgatgaaagctaggctcaactgttcttgagaacaggggtggtgactggtgggtgtccggtgtccctgtatcggtaaacaaggacacatttgactgctggtcctcgttgtcgttggtggcgatatactgatatagtgagtatgatggcagtatagtagtacagctcctctaccaacttactcactataccgtatgctcaactaaaatacaccatttcattcgacctggtaaagctgaactgaaaatgagtaagctcttccagttaccaacttaccatatgctcgatagaaaatgtagcatcatcttactgcaactctaaaaaattaaaatccaaagggagaacgaaccgggcgtgaagttatgattaagagctttgatggggaacgaacctggaggcacatggacaggaaatcaggattaagtgatcacttaattaatcccaattccaaacgtttccgacattgattaaatcatcaaacagcattaatcgacctcatttcaaactttgccaacattgctcaaacaacataggagtacaccgtattagtcctggcagaaaaagaacagcaaaccaaagagagatcgtcatcgatgatgaatacgagtacaataaagtagcaacgtttctggaacactccagaagtcactctctctcgaagaaaagatactgcaccgaaatcaccttccgaaaggcacaagccaaatccatcgttggtgcaggcggcaggtccagccagtgtagtgcgcgtcactacgaactctagtgcgcaagtggcctcggccagataaccacacagtcacagcaacagaaaaaaaaaatcgcctcggcgcggcgggcggagacgtcgatacccccgacgaatcctctctctctctctctctctctagatcccatccaccccttccacctctcctctattaaatccgccgctctcactcccacccaccgccgcgacacacacacgcacacctgagccgaagcacgcacgaatccaacgccgaga

SEQ ID NO: 40400 - DNA, 1501 bp, Oryza sativa
  unsure (1)..(1501): unsure at all n locations
ttgggtgagagccgcgctgcctctctctctcgatctcgatctctctctctctcgaaaccgccgctgcctatagctcattgccgacgctgccgcacgcggccgaccccgaccccgactccgcctcccgccgattccgaccccgacttcgacgcggctgccaccgctgacgacataacgttcacgcaactgccacggcgacgatgcgacacgccctgccacgccgccttgagctcgncacgccgtcgcgccacaccgncgcgacgccacgccgccgccgcggnatgccgccgggtcgcccgacgccgncggaacgcgcgccccgacaccgccggacacgccaccaccgggccgccacgacgccgttccgcttcgcgccactgtcgcgcgccccgacattgccgaacgtgaacgaatgtgaacgaacgtgattgaaaacgtgacgaacacgaacgaacgtgaacgaaacgtgaacgaacacttaacgaacgtgaacaaaacgtgaacgaatgtgaacgaaacgtgaacgaacgcgaacgaacgtgaacgaaacgcgaacgaacgtgaatgcacttgtactaaaagtgtgagaacgaacgcgagcatatatgattattatacgattattaaacttagcatataatatgattatatatatatagttgaaaacgtgaaatacaatatatgttcctttgcatttagactaatacattttcctggtaatgttgtagagaagacgtcgtcgtcgtccctcaagctgaagttgtagctagccatcgaaggaattcgcgcaggcaagtgatgtaaagaagtgattgttagagatttaatataagattattagagttttaatataagattattagattattagcatatgtgagtgttagattattagacttagcatatgtgagtgttagagattcgtgatagacttagcatattgtattagacttagcaaatgtgagtgtcagagattattatattattagacttagcaaatgtgagggttagagattattagattattagattgttagacttagcatatatatattattattacaattttaatataagattagtagcgatttaatataagactgttagacttagcatatatgattattacaattttaatataagattagtagcgatttaatataagattgttagacttagcatatatgattattacaattttaatataagattagtagagatttaatataagattgttagacttagcatatatgattattacaattttaatataagattagtagagatttaatataaaattgttcgacttagcatacatgattattacaattttaatataagtttagtaaagatttaatataagatcgttagacttagcatatatgattattacaattttaatataagattactagcgatttaatataagattagtggagttttaatattacgcttagcaaatatgacaaatgacttaccaaatatttcttgtatgaacaga

SEQ ID NO: 40401 - DNA, 284 bp, Oryza sativa
tttataccatatatcggggtatgtaacgatctaacgtgaaacattgtcaatggcatggttttagatctcattgagctctataattttgatataaagtttgttttcatgttactttgtataaacatattatttttttattaaactattatttgagtatcgctactggttcaacactcaatagatacgctagtccggaccatagtttgtgttaccgattcatggagaaactgtactgtaggttcatgtcatgaacctacaatgatacttccccctctcattgcaga

SEQ ID NO: 40402 - DNA, 192 bp, Oryza sativa
tttttattcatgtggaaattgctacggccaccaaagcttgtgtaccaggaagattacagatctacgctacgtgcacacagaaagtacacctaggttttgcgtttttgcttggtttaccctaatttcttactagcaaattcatgattaattcccatggcaagtttgaagtatgatctaccgcttctggaccga

SEQ ID NO: 40403 - DNA, 1501 bp, Oryza sativa
atgagtcaccaggtaattaaattaaatgagccatcaaacttctaggtgtgaccatgtgaactgttttgggcgtgttcggaggagattgttctggctgcacagcgcagcggctgcaacacgctcagtaaatttagtgctgcttgcactgttggtaactaggtacagacagcttcagccccagatgagcatgtttgtcttcaatgccaaagcacatactagatttttccggaagacccacatcctttgtacaattagtagttcgatgcaagcattttcaacaacttttttcccatcctgtactcaccatatgcgtgtcaaactctcaaggtttccccccagccagaactatgaaatatccgattaacttttattgcatgctgcattagaaatgtgaggatacaggaagagatttatagcacactggtgtatccctaacagtagcaatataattaacatgtcacaagtcacaactccatccttatagctccttttcatcagatgctcccacacagattgtccgatccagactgcagccgcgattgcaacttcgcatttaaaatggcagtaggagatttttaagtagctgtccatatccactgctccatcaatctataacaccccaaaaataaaaagaaatgacatatcggttttcagcttcagcttatagaaaaaaaaaagaagttgggggcagaaattaagggaaaaacaatttacatatggactagtacactaagcaatcgtaggccgaggccctactaaggccctgtttgtttcagcttaagattgttgtaatctagattattaaatcagattactataagctggattatgataagctggcataaaataatctacgagttgtttgtttctctggattattagaggcatctaagggtagtgggtctttagccacttaataatctgaaaaaagctcctctagagaagattattggattatagtaatctcgtttatagattataataatctagcataataatctacttgtttgtttcagcttactcctaataatacagattataataatcctaagctgaatcaaatagggtcttagttgcatctccacctacaactttagaggtcaaccaaatcgtgcctcctcccctagatctcctacaccacagcgttactcaagagagaaggcggtagaaaggaaacaaggaggaagaggattgttgctcttgttataccagttgtttgagagcattttgatggtttaattcgtggttaaggatgcatacatataataagcggtttggtcgttctgattcggattgagttctgcgcacaagcagacttatatagttcctctgttattttttttatgattaggtggtcaaaacgattttcattttcaaaaaaaaaacatataactagaaaccttgttgatatcatcgaggccgagccattagtaaagtcatagttgttttagtttttttttcttaatatacagatagaccctagcgtttgtaaaaacctagc

SEQ ID NO: 40404 - DNA, 519 bp, Oryza sativa
aactacgacaagtagcgtatcatattcctcaacaattttctctcgttcccatgatcaaccctgggaactttacgattatgcttcaatccaaaatggcccatttataatactccctccgtttctaaatgtttgacaccattgagtttttagcacatgtttaaccattcgtcttattcaaaaacttttgtgaaatatgtaaaactatatgtatacatataagtatatttaccaatgaatcaaatgatagaaaaataattaataattaattaatttttttgaataagataaacggtcaaacatatttaaaaaattcaacggcgtcaaatatttaaaaacatagggagtatatgtaggatcgtaaagggcctttcccaccccaaaagctagccattgaggtgacaggcttccccagttatatcttagctcatttgccctttcacaaccaaaagctattcaacaatctcccccttcacacattggtgtccctcggcccttcaccaccccttcaccgtgtataga

SEQ ID NO: 40405 - DNA, 768 bp, Oryza sativa
aactttaaaatttgatttttgatgaaacttctttataagatctgttttgaaaaatcagaaagtttagcggtttgacaagcacgcccacaaaaaataccaaaataaaactctaaatctcaaacaatagggcctaaagctagtaaactatactactccatctaaaaagaccaatcctgacaacaaatctggacacgcgtgtattcagattcgtacttagaattggttttttatgggacggaggggcacaaccaatctattgtgaatcaaatttctgatttgtacgagaaagaactcaaaataaagaataaaaatatactaggtatgatagctatagttggctgtaaatatatatatgaaaaatggttccatgttcttttttttcattttttatttggttgcactttcaataaagcaaccagttagataaatatatatgaccaaaggcaggcagtagtgcttccctagctaaccagctacgtgatgactcactagagcacgtactggatggatgcggatagatacttgttacatatgggctatatatggccggctggaactgggggtggagccccaacgatgaatccgccgctggttcgtggctttaggctatctaccttgggtataattagaggagttgaaaccttccaatatcaattttgtaagagttgagtttagagaaaagttaaggtttcaggtgtttatgttgttgtgttttgtaaacatgaataaaagtaataaagagagatcctggatttttattttcctagg

SEQ ID NO: 40406 - DNA, 925 bp, Oryza sativa
aaaatttgcactcaaaacttttgttgtgcttgaaatataactctcaatgacagtaaaattcctcatctacatatacataatatttatggacacaagaatataaactaaggtgggtggaatcatgtacatagaactctaccaccataccactgttccttccctcttaatgcttaaaatttaaatactgaaacctagttttaggattatttttgcatcataatttattttgtagcattgatacttaaacatatactacctccttttcaatatatgatgtcattgactctaccaccataccactgttccttccctcttaatgtttaaaatttaaatactgaaacctagttttaggatttttttttgcatcataatttattttgtagcattgatacttaaacatatactacctccttttcaatatatgatgccattgactttttaaaatatgtttgattatacgtgttattcaaaatttttctgcaaacataaaagattataagtcatgctcaaagatccttaaatgaattttttttgttgttgtaaaataaagtgtgattgattattactttgtgattaacgattggcatttgacatatttgggttttgatatttggagacaattagtgaagtgggttgttgactatatatgtgaccggtcaaaccggataggctaggctcgtcagactccattagaccaaccgacccaacagtttgttcgggcggctctatgttggtttctgtttaagttgtttatttggatactcgtaattaattcatgtctatgacttctagatgatttttatacgtatgtaatattgttgtgataatgctgagtcaagttggagacaatttatgctcgaatatggtttcttgtatcattcatgtgtaggtgtgtcttgatgtttcgggggaccgttgcttgtga

SEQ ID NO: 40407 - DNA, 650 bp, Oryza sativa
gtttaggttgatgaggttggcgtgtatcgaaaattgtccattttatgtaaaaaatgccttccaaaactgtgcagcccagcccatccgatggacagacccatttacacatatcactacacttatacttttgtcctcgcttcgtatgaaagtattagctcttataaattggttacaaccttgccaatataaattagaaatgtggtattaaccatacacacaaaactctcatgggccacataggccaaaacctaaatggcccaggaaatgggcctataatgcggatgtctactagtttttcaaaatgaaattatacacattttcaagcttggacaatagacaaaacatgcatgagcattttcctgagagagcgcggtggattgtcaaatttaaatggaggccaactagctaatagcagttgcatgtcaactagtttcatagaacaagtaacgatatattcattccttcctattgtttgaaacaagggctaatgttcccatctgagctactagagatattattcatccggaaatcaccatgcatacaatccaactgttcgactcatgtacggaaatttgatcaacggttataaacgactatagttcatatgaatattcttttctttaattgatctatgattgcatatctctagt

SEQ ID NO: 40408 - DNA, 340 bp, Oryza sativa
aaagttaacggctactccatccatctcctgaccaagttggagtcggagtgcactcggccaccgtccgatgtggcccatttccaagtcggagaccgccttccagccgtccgatcgaccgaagccctataaatcgagtcatccagcgaggcctcctcttccgccgccatccacgctccctttccgaatcttcccacccaaatcctcttctcccatctgctctcctctgcttctccccatcatgccggctccacccatggcgcccgcggtggcgagccgcaagcgcgttgcggccgacgatccggagccccgctcctgctgcggatcctcccaggcgagcggg

SEQ ID NO: 40409 - DNA, 328 bp, Oryza sativa
aaaaaatgatttacctcagaagttaaggatatgccagtattttcggtctgtttaaacatgtgttagagacacgttcgtaatgacgtgagcgtgatgttaggtgcatgtacaatgctgtttgtgcacacctgccatatttaatcgaaaataacttatgatgacgatgagaggcacacgacctcatgccgctggtgctcctcccaatccccatcgtctccaacgccaccatatcccactcaacacgatcgccccgcctgcaacccaatcacacccacctccgtcttcctcttcccgccatttccaattcgagctcgcttcctcttccagc

SEQ ID NO: 40410 - DNA, 1153 bp, Oryza sativa
cccccccccccccccccccgcgtgcttgagtgatacatagagagagagagagagagtaattctgagttgaatgaaatcaaattaggttgaccatggttctgccacattaatattttttcttgtcgtactgcgcattttcatttttatactataacaaaaacttgtttcttctaggttgtctcgaaacagttctcccaccaacgcataattgatgttaagtagtactttctccaattcatattaataagcatataaccaaaaataaaaaaaatccaaatttatcatcacataaccattgtcccttagtttggcgtgtaccattattgcatctatacatgagaattaagtatgcatgtatgcatgcagacatttagggatacttaggctattcctaacccaataattaggatgatgtccatagcattaaataagctgccacctagaatgaaaaaggatgtggcaagtgaataaatgaggaaagagaagaaaaccatgtcttgcctaacagatgggttctacacaacatccaagacatcatgtgagataagtagcattaaatttatgtcggtgacatgggaccgggagtatcatgactagaggcttgaggcagacacaatcgcctacgtggcctggcaccctcggggggcgtcgggcccgagggtgatgtgttcgccctcctctttatctccccgagggggtcggaccgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtctatccggtctgtgaccagtcacagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgagcatgcagattgttaaactgacacgtggtggacaagaatgaccgatttgagaccggtctgacaa

SEQ ID NO: 40411 - DNA, 1501 bp, Oryza sativa
gttggaacacttaatggacaatttcgatacatgccattttctttcatagagaaccggatatgatcatttgacaatcctagttggaacacttaatggaaaattctgatacacgccattttctttcattttcttccatccccggacgccattttctttcatagagagaaccatatatgatcatatgatgatcctagttagaacacttagtggacgattttgatacgcgccattttctttcattttcttccatccccaaacgttcatcaacgtcatcaaatagagaaccggatatgatcatatgacgatcttgtttgacgatcctggttggaacacttccagcattgtctgatgaggtctaacgggagtttgtgagtccaactcagatgttttttttcttttcatacttgggtccatgttttttcgagtcctaattaattttgcgagctacgaggacatagaaaaggtttgctattggttgaccggccccttcataagggctgtcacaagttctagccaacagagtcgttctttaacataacatatctactttttaccgtaagttttgcactatctcatccatcttcagtagtttgcacttaagttatctgttctcctttggaagtgcaaatctctttgcaggtctgtcctgaaaacttttcgtttcgctcacacgataagtgtctatctccaatttatatatggtagccggtttttatctctttttcatcttgatcaggagttttttaacttcaagatggattatgactccatacacaccacaaggctcgtgaagaggatcctcgtgttggaggtaaaatacgaacactatgtgtcaagtcatgggagtgggtcaaagggcctagatcatatgttgtttgctttgagattattactacacatgccagaaagatgggtgagctaatttggccgaagaaatgacagatgtgtagtgtgtaattctcttccatggtattcctagttaatatttctatcaaccatagctatcaattaatgttaactagtatcctctccatcccaaattgatcatcatatatgtttatgcaccaagacaaaggagaatttaaatcgcatccatcaatacaccatgcaaacattctcccacaatgcgtgcatcaattaaaacactatgccaattataccctagcatacacacattctcccatgatgcattaattgtattatgataaaacccgtatccatgcggttatatgatgatcaatttaagaaattttggattccattatatgatgatcaatttgggaagaaggaagtacatgcatataacttttttcatcaacaccaagaaagatttaactgccacataaattgtatttaatgtaagtttatgatggggaagaatcagaaacaagcccctaaggccattcccaacccaagacactagacatagtttccataaactccacatcatcaagaaactagtactagacactactcttccaatgtaaacaccactattcca

SEQ ID NO: 40412 - DNA, 403 bp, Oryza sativa
aaaaccccaaaagtaccccttccctcacttgggccggcccggcccatctctgtcccccctctctctctcctctcccccgcggcccattcggcctcccaccccgcgcgccgccgccgccgccaaatccgccgaatcccgccatccccgcgtgcaataaagtggggggaaatactccccgtgatcccctctccctttccccccatttttcctctctctctcgtgttcaaacgggtggatttgcccccgcaaatctcgctggcgccattgacggcggccgacctcccacgccggtttccttcctccctggccgctctctcccccttccaaccctatttaaaccctccccgcacctcctccgtccggttccacctctcgccgcccttcctcctcgccggattcgagc

SEQ ID NO: 40413 - DNA, 1501 bp, Oryza sativa
tgccgcgcgcggcgccacgccgccgccgcgccacaccgccgtcctgctgccgccacaccgagaacgtgaacgagcgaacgaacgtgaacgagaacaaggtgaatgaacgttaacgagaacgagcgaacgaacatgaacgagccaacgaacgtgaatgagaacgagcgaacgaacgtgaacgagaacaaggtgaatgaacgtgaacgagaacgagcgaacgaacgtgaacgagccaacgaacgtgaatgagaacgggcaaacgaacatgaacaagaacaaggtgaatgaacgtgaacgagaacgttttcggacgaacgtgaacgagccaacgaacgtgaacatgaaatgcaattataggcaggttaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatcttttcgtatcttgcagaaaagacgttgtcggagtcgtccctcaagccggagtggtagagctagccctcgaaggaattcgcccaggcaagtgacgtaattatatatatatgattgttatatttgtaatgcaattaagattattagatttgtaattagagttaattagcatataagattgtgtagtgttctaatatacgacagttacacttagaatacatgactatttgagttttagtataagattattggagttttaatataagattattatatttgtaattagacttagtatataattattgactagctagggtcctataatatacgtcacctagacttagcatatatcactatttaaggtttagtataagattattagatttgtaattagacttagcatgtaagattgtgtagggttctaatatacgacagttacacttagcatacatggctatttttatcttagcatataagattatttgagttttaatataagattattatatttgtaattagacttagtatataattattgactagctaggttctataatatacgtcacttagtcttagcatatatcatcactatttgagttttagtataagattattatatttgtaattatacttagcatgtaagattgtgtagggttctaatatacgacagttacacttagcatacatggctatttttgttttagcatataagattatttgagttttaatataagattattatatttgtaattagacttagtatataattattgactagctagggtcctataatatacgtcacctagacttagcatatatcactatttgagttttagtataagattattagatttgtaattaaacttagcttctaagattgtgtagggttctaatatacgacagttacacttagcatacatgactgttcgtttagtcttagcatataagattatttgagttttaatataagattgttaaaacataaatgtctcatgacttagcagatgtt

SEQ ID NO: 40414 - DNA, 156 bp, Oryza sativa
tggtaggaccgcgaggcgggtgtctacagtggtgtcgccatcagtaggactgccatgtgagaatctaaacataattataacttaatgcatgtgtgagtcttgccttcccgggtgcgccagaactcctctcactgctaggaattgtgtacgcctaga

SEQ ID NO: 40415 - DNA, 306 bp, Oryza sativa
atgaagcctggcatatatctggccggaaccaacgtgccatctccaggagctaacacgccggctccggctagggacgagtgcttggaggctctcgtcctgacgggatggggcgaggcgtgcgtcagaccgcctgtcgccacctaacccacgatctgaccggtctgtgactggtcacagaccggatagacgagcgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 40416 - DNA, 1354 bp, Oryza sativa
tacgcttccgtttgttaaactctgaattgtatcaacttttggtgtaccttgcctcctgggacaaggaacaatacacgcacgtcaggaacgcctgttgggtgatttccggtcgtgacaagttggtatcagagcctcccttgaccctaggacgagccgtagatcccaagccttagcaatatttttgaaaattaaaaatcttttgttatttgtgaaaacccgctattctctctctgtcttgctgcttcatttatcgccaaaatctgatctctaaaatgctgtttttcttttgtttttgtttgtagatggccggcagcgtcacccgtcgtggtttggacatgactggcttcgtcctggagctgcggggcatgtgcgtggtcttggggtatccacatggagtggattaccaggccaggccgctcccggagcaggagggtgaggatgcagagcctcacgctgggtgggaggtcactgcagtgatcctctctggctctcccgagcggacttcgctggcagtcaccgcgggtggggattcttctcccgccgcttgccagaacgccgctctcctcgccatcggcaccctccaccagcgctacccggacgagttgcagcactcgccctatcgctaccaccctcgtcgcggaggagcccgcgacttcgccaccttccgagatgctagcttggaggatgacgctaccgtcgtgcatctggcacgcatggtggaggcatacgacgcggctcgtatcgacttccatcagatggtgcgtcgcgggatggttgagaacaacctgaagatcctggagctgcgtcaggagaacctgcagctcaagaaggacctcgacgcattggaggcgcagctgcaccagctcaagatcgcccagggagaggacagccgccccaagcgtcgccgcgtctgccgcagccagaagatcaccgcccggaagagcacctccaggcccgagcttgttcgtcagtccctggcgtggacttgcttcgtcgagacccctcgtgccgagcctgcgcccgtggttccccaggagggggaagcctccggcgttggtagcacggaggatgcgctgttgctcaccttccgccctggcccgtcgcagcggtagacgagcagttagtaggcttgcgcgtgtgtttttcctcgtttgtcttcttgggttgtgtggggcatggttatgccagtgtgtggcataactatgtcggagcctgtcttgttttatttgtttaagcaacttgaactctaatgaaccaattcaatatcagtaataaattcaagatttatagtagtcgtgggtggttagttttaatcgttagctctctctgtttgctggtgctgtgtggggttttc

SEQ ID NO: 40417 - DNA, 401 bp, Oryza sativa
ctagtagcttttccttcttttgtaagacttgtactttatgtagaatattcttctttatactactttggtattgtactactttccgagtatatgaatactaattttattatatgtccaagttatatttattatgatgctagcttatctgggagatgcaatgatgtgggcataatgatcgtatttacgatgactatgtcatgatgatattagagttgtatttggtaatttaagtgtggtgtttagattactggatatcattatttggagttatatgctgcggaagcgaggtgggccactgatggtgacagctcagtatgggtattcctccgcgcgtgtatataggcctaagttaatttcctggggagggtactcctccgtatttagccccggttggatggtca

SEQ ID NO: 40418 - DNA, 1501 bp, Oryza sativa
agagaggagggaagggggaaggcgaacggcggtcctcggctcaccccgggacaacgacgacgacgagaacggcggccggagcggaggaaagcggcggagcgggtcgggatgacgatgacgacgacgctccgacggtcggcgggcgaagcggatcggcggacggggtcgacggggatgcggcgatgccgagggaggtggcgccgagccgggaggaagcccggagtggcgacggcggcggaacggaactcggcggcgatggcggagagggcggagcacggcgcgagcacgaatccgacggcgagagcgagcggtgagcggcggaaacggaagagcggagcacggggagggtttaaatagcgccggggaagggaaagagcggccggagagggaggaatcggtcgcggaggatccggccgccattgattgcgccggcgagggtttcgggaaggaaatcggacgaatccgagggagagagagagggaaaagcgggggaaacgggagagggaatcacggggagtgattcccctctctttaatgcgcgcggggacggcgggagcgagcggatttggcggcggcggcggcgctagggcacgggcgcggcggcgggcgcggcgggaggaggaagacgacgggtgggccccacccgtcagcgagggcaggcgggcgggcccgcccgtcagcggcgcgcgcggggaggagccgatgggccgtgggggaagagagagagagagggagggattgggccgagccggcccaagaagagaaaaggggggggggaaaagaacttcttttaagattttctttttataaacctttttaactatgtttatttcttttcaattattatttgtgctctgaaaattccactaaaatttatttacacgttttaggcttttaggaaatatacaaaaatcctccaagcctcatttgacttttatctgtgcacattttaattgttgaaggctttcacattgattttaattattctcagcacaattttgaggatgaaatttagggtcgttttgggacgcgacaatacggaaactatccatatacgcgtgggtataccgtattagtatataacgtacagccaaggatagagggtataccttatccgtaaccttgacagtagcccccgacttctgcttaaatgagctcatgttatcgatcgcaacttctgatgtcggaattgttgtcgctctcatctggtcgatctcggtgtgaaaactgtagagacaaagagccatcgacaacaccgcatgaagttcaacggccatgagtgaatttaaattgaagtctgaaaaactaccccacgcaacggacccagaattttccggcagcaatctctctcctttccttggaatacgcaccatcggaagcacgtttacttaaagggattttggggatccatttgaagtccgtttgcaagaaaactctcctgccttctagcactcttcgtcttctccgctccccacaaaaaaaaaccctagctcacttcctt

SEQ ID NO: 40419 - DNA, 1501 bp, Oryza sativa
ggttgtgccggcgtggccgccttcgggcgcgtcccgcggctgccatgtggggcccggccgtcagccgcccgcgccctcgggtgcggctgacgcgtgggaaccacggcgccggccggcgtacgccgcgtgcacccggtccaccgtggaccgtgaggctgccgcatgggccccactcccgtggacccggtccgcgcgctcctcccctcggctgacgcaataaatccaattttaaattaaaatttaaatgaagaaattcgcaaatattcatttaaagagcatataaacttcaaatggccataacttggccatttgaactcggaattggaccgttcaaatctctaatttttccttaagaagtcaagaacccatttttgtgctttgttcctgcttgtcatttggagtttattagagtaaaagccttttcttttctgttggtcgtgtagacgctgcagcttcggaagatccgctcttcgtggaagttgaagccggcgtttgggaaagcgagcaaggcaagtcacatcatctttgaacatattgaatcctattttgtaaaattatgttgatttaaattattgcattatcactttatttaaattcccgcgttatcactgctttatttagccatgcctatttacctttgttatgaccttaatattgttattgttattatttccttgttcaccctagaataaacaaaaccccaactagtggacaccctactcatggtatcactagtatgattttaggtagatgcttcgctatttaattaggtaacattaggtggttttccaactctagactttgggaatcttcatatcatctggacactttggaattgttggattattgtggaattggattcacaccgctccttctattcaaaatccccaagatggttttaggctgggctcggggtgcatggttttgatagtagcacctcggccatataaggaccggtcttcgggcctctgttgcaaagcactaccgtacttccacatgtctagtgggtaaggcttagtttgtggctcagcctggtaataaacaaaagtacacggatggagatggacgaagtcgggggtcgatggacatctcaaggataaatgaaggctacacgagctgcggcccggtagtcgagatgtcacggcacagggctggtgtcctgctgctaggggctcaatcctgcctacctgtcccggaggttccggccataggtgggattgggtcggtactcttgtctatggctaggatgggttggaaactatgtcacgtcttccgtctgtataccgtggtggtatgtggcacgtggttgcacgtgaggaagatgtgtcttgtgggtaaagttgtacacctctgatcagagtataatctattcgaatagccgcgccctcggttatgggctagccgagcaatgtacccaagttagtgttttaattcttaaaaccttcttaacaactaaaatgtggaatggttggcctgggttggcttgggacgagctgggacc

SEQ ID NO: 40420 - DNA, 1501 bp, Oryza sativa
tcggattcgtccgatttccttcccgaaaccctcgccggcgcaatcaatggcggccggatcctccgcgaccgattcctccctctccggccgctctttcccttccccggcgctatttaaaccctccccgtgctccgctcttccgtttccgccgctcaccgctcgctctcgccgtcggattcgtgctcgcgccgtgctccgccctctccgccatcgccgccgagttccgttccgccgccgtcgccactccgggcttcctcccggctcggcgccacctccctcggcatcgccgcatccccgtcgaccccgtccgccgatccgcttcgcccgccgaccgtcggagcgtcgtcgtcatcgtcatcccgacccgctccgccgctttcctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgccgctcccgtcggccgtgccggcgaggccgccttcgggcgcgccctcgcggctgccaggtgggcccggccgtccgccgcccgcgcccgcgggtgcggctgacgcgcgggacccacggcgccgaccgccgccagccgcgtgcgcccggtccaccgtggaccgtggggctgacgcgtgggccccacttcccgtggacccggcccgcgcgcccgctccctcggctgacgcaataaataggattttttttaattaaaaattaaatgaagaaattcgcaaatatccatttaaagagcatataaacttcaaatggccatatcttggccatttgaactcggaattggaccgttcaagtctctaatttttcctcaagatgtaaagaacccatttttgtgctttgtttctgctgttatatggagttatttagtgtttaagccttttcttttccgttggtcgtgtagacgttgcagcttcggaagatccgctcttcgtggaagtcgaagccgacgtttgggaaggcgagcaaggcaagacacatcatcttgatcatattgaatcccagtttataaaattatgttgatttaaattattgcattatcgctttatttaaattcccgcgttatcactgttttatttagccatgcctacttacctttgttatgaccttattattattgtttttgttattaataccttgttcacctagattaaacaaaactccaactagtggaccctctactcatagtaccactagtataattttaggtagatgcttcgcaatttaattaggtaacattaggtggttttataactttagactttgggaaatattcatatcacctggacactttggaatggttggtttattgtggaattggattcacaccatccccctttattcaaaatccccaaaatggttttaggctgggctcgaggtgcatggttttgatagtagcacctcggccatataaggaccggt

SEQ ID NO: 40421 - DNA, 547 bp, Oryza sativa
  unsure (1)..(547): unsure at all n locations
cgtgggccccccntttgatgaactantcgattcactatagggcgaattctagctcggtaccccatgcgtttattcagaaaaaaaacggaaacatgcagataactaatcaactaactaaccgtggcacacaagattactgctaacaaattataccctaattttaactacatatattggtatatacgatcccaaatcaaattaataataagcccaaattacactccctttgatcgtatatacgtgcatgatgttttaaatgacagattggagaaggctacaatccggtcgcaaagaggggattatatgtgagggatgttcttcaacggtttggactaacacataaaaggaattgtagctcttctgcctattctgcacagtattcaaagatcaggcatgatccgagtttggaacttggattgaggaggtaaatatttactgcctctggcacaacgttttttttttcagttttgaatggttaaaacaaatagtagcattgtggagtcaattcagtgttaatcttgttattacattggaggatgttgcacca

SEQ ID NO: 40422 - DNA, 1501 bp, Oryza sativa
gacacatcatcttgatcatattgaatcccagtttataaaattatgttgatttaaattattgcattatcgctttatttaaattcccgcgttatcactgttttatttagccatgcctacttacctttgttatgaccttattattattgtttttgttattaataccttgttcacctagattaaacaaaactccaactagtggaccctctactcatagtaccactagtataattttaggtagatgcttcgcaatttaattaggtaacattaggtggttttataactttagactttgggaaatattcatatcacctggacactttggaatggttggtttattgtggaattggattcacaccatccccctttattcaaaatccccaaaatggttttaggctgggctcgaggtgcatggttttgatagtagcacctcggccatataaggaccggtcttcgggcctctgttgcaaagcactaccgtacttccacatgtctagtgggtaaggcttagtttgtggctcagtctagtcgtaaacagaagtacacggattggagatggatgaagtcgggggtcgatggacattctccagggcaaatgaaggctacacgagctgcggcccggtagtcgagatgtcgaatggcagagggttggtgccctgctgctaggggctcagtcctgcctgcctgtcccgggggttccggccgtaggcgggattgggtcggtactcttgtctatggctaggatgggttggaaactatgtcacgtctttcgtctgtataccgtggtggtatgtggcacgtggttgcacgtgagacagatgtgtcttgtgggtaaagatgtacacctctgatcagagtataatctattcgaatagccgagccctcggatatgggcaagccgagcaatgtacccaagttagtgttttaattcttaaaacctgcttaacaactaaaatatggaatggttggcctgggttggcttgggacgagctgggacccagggtcgggttgccagttcggtctgaatcataataggccttgggttaaggcaggttcgtgtgggttcacggccttgattaataacattgtatagttctagaatcgtgcttatcaaatagctttgagcaactaaacgtctttaaatgctgtttaccgcaaccctaaccctttatattataattcccttgtactcccttgcatttattttgcatctgcgggtgtgtcttgttgagtacggtggttgtactcagtcttgctcaatttttcccaagcccagatgaggagttcctggaagatgaaggctttggtgtctagctcgtgcctgccatcaagtgcctgtggtcgtcgccctagtcttccgctgtttctcgtttgtctttgtgtgttgggccttcgctgcccgtgtaataattatatttacgcttccgtttgttaaactctgaattgtatcaacttttggtgtaccttgcctcctgggacaaggaacaatacacgcacgtcagga

SEQ ID NO: 40423 - DNA, 1501 bp, Oryza sativa; identical to SEQ ID NO: 21959

SEQ ID NO: 40424 - DNA, 866 bp, Oryza sativa
  unsure (1)..(866): unsure at all n locations
ggtaaagtacccccctttgttagcacaccaanaatgnngagaaagaccggncgcaggncgacnnnagagggaccttctgtaaaagaggnnagacctcttttttttatgaataggctcgctacaaatacgtgagatgttttttagaccgagangcaggatacccatctattaacaattactagtaatacactttacaaggtatttttagttctcttctaatttgactgctctttcaataatggaggtccaaatactttggcatgtacgtggtgttacatttatacaagaattgagcacccataatataaaaaatgcattgtttctcactactggtgacactgtacaaattcagtacttcttggatgcaaacaagacaattaagttggataattcaattccatataaacatagtttgataagcaattgagctttttttttcaatctggctgtgaatttaccgtctacactccttggtgctagtacagaacaggcacatatcatctgatatgaatcatgattgtatttgctaaactagacggctcacatacaacgaatccaccaactatactaccagctgccaaattctaaatcaccaagaccccataccagtacagcagaaatccgagcaatcgcactcatgactcccacatcctttcactcaatgatcccatcgaaatggaaaccaaatgacaatttccccaatcaaggacaactcaaacatgataagaccaaacgattcttgagcgagcagtagcgcagccaaggctcagcaacaattacacagtaataacagtgttctaccaacagcagcaacagcaagaacaggctagatccaaaatgctacgaggatagagagagaaaaaaca

SEQ ID NO: 40425 - DNA, 1216 bp, Oryza sativa
atttaatgaaattttatctggccccattttatattggaatttattaattaaaattagattttcttttcaagacttttaaaataaattctagaaattccatttaaacaacaatttatatttttttcaatttttagggtgtgacacgcgggcggctgacggccgggccccacatggcagccgcggggcgcgcccgaaagcggcctcgccggcacagtcgacgggaggtggcgcgcccgcgcccctatggtcgctggcggcggccataggcacggcggagcggcggccgagagaggggagggaagggggaaacgaaatgggcggtccacggctcaccccgggtcgacggcgacgacgggaacggcgaccggaacggaggaaggcagcggcgcggcacgggttgacggggacggcggcgttccgacggtcggcgggcgaaacggaggggtggacgaggtcggcgaggttgcggcgaacccgaagaaggcaacgtcgaagcgggagaaggtcccggggcgacgacagcggtggaccggagctcggcggcgatggcggagagagagaatgacggtgcgaactcgattccgacggggagagagagcggcgagtggcggaaacggcggagggaggcacggggagtgtttatatagggttgggagggggagagagcggccggatgtgggggaatcggccgcggaagatccggccgccaatgatgcgccggcgaggtttagggggaaagatttcgaacgaatccgagggagagagagagggaaaaacgggggggaaagagggagggaatcacggggaatatttcccccctcttgattgcgcgcgggacggacgggagcggcgggattcgcggcggcggcggcgctagggcacgggcgaggcggcgggggcggcggaaggtaggggatgacgggtgggccccacccgtcagcgagggtggcgggcgggcctgcccgtcagcggcacgcgcgcggggaggaggccgattgggccgcgggggagaggagagagagggagggaggtgggccgagccggcccaagagggggagggggaaaaaggactttttagggtttttctttttataaaaccattttaactttgtttatttcttcttaattattatttgtgctctgaaaattccactaaaatttatttacgcattttaggcttttaggaaatatacaaaaatcctccaagccttattcg

SEQ ID NO: 40426 - DNA, 208 bp, Oryza sativa
aggggttgattagggtgtgaccaccccccaaaagggggaaaattgtggcacgacaaactcccaatttttccatcccagtgttccattttcaatcaaacttccaattgaagcgtaacttaacacaccggtacccaaagcataccacagattaattcctaaagattggacagacacgagcaactcagtcatacgcaaaccacaccaaatg

SEQ ID NO: 40427 - DNA, 1501 bp, Oryza sativa
catttcatgaataatttaaattgaaaaaggtttttaaaagtctctattggctttgggccgaaagtcggcccaaaaacctctctctctctccctcggcccagtcggcccagtccagtccgcagccgccgcgcgcgcgcgtccggtcactgacaggtggggcccacttgtcggagtcgtcgtcttcctcacgtcggccgccgcccgaaaccctagcgccgcgccgccgccgtctccttccaaattcggccgcgcctttccttctccggtgaaatcgattgaggggaaatgtttcccgagatctcctctaccttttctcttttggaatcaccggctaaaatcatttggaaattcgtggattcggggtcgaatcggatcggtctctttcctccaaaccccgttgtttccttcgcgtcgccggtcgccgtgggccttcgccgccgcctccttgccgctataaaaggatccccggtgtctcctctacccgccgccaccctcgccttcgtctctcgccgtcggaagcgccctagcgccgtgtaacctcgagccgccgtcgtcgccgacgctccagccgtgcgccgccgccattccggtcgtcgtcgtcgctcggggaggtcgccatcgtggtcgccaagtcaccgccgtcctcgtccgccccttcgccgtcgctgaagaccgccggagcaccgtcgccgtcgtcaagccgaagagtgccgccgcctttttactcgcgccgccgccgtccgttgatcttccgccgtcgttttggtcatcggtgagttcgccgcgacgttctctatgtgctggtgccctccgttcgcgtcctcgcgccgtcgttcgccggcgagcaagtgctcccgagccgccgcaggagatgacgtcgccgctgacgtcatcgtggccgtctgccatggcccggccgtggatcttgatctcggccgttcgttttggataggatcgatctcggccgtccgttcccgtgaaccgctgctgtgcgcccggtccaccgcaaaccctagttgctgacgcaataaaccctttttccttttcaaaaataattcgttattgcgtcataattcaattaaaatccatataagtgttttaatccgatttaatctttaaaaattcataactaattcatcttagctcgggatttagttggttcaagtctctaaatttttctaaaattgagatctacatgttaaaaatatccacatgtacttttcatgcttgtttatgtgctgttttggtgtttttgctcttttctgtttagattctgacgtttccggagagtccgttttcgcaggagaagaatttgaagagttccaaggccagcaaggcaagtcacacagatcccaaacaaccctttgagcatgttgatcccgtttaaagctattgttttcattcaactattgcatttattttcgaatgtcattgggtggaattaaactattgtttgttatagccctttttgttattggttcctttattccttgataccttg

SEQ ID NO: 40428 - DNA, 1339 bp, Oryza sativa
  unsure (1)..(1339): unsure at all n locations
cccttggcttgctctctctctaacacttttgagccttgctttcttgtttcccctctcacccgtgttcgattcggatttggtgtgtgtgtgagagttgtggattcgagtttgggtgagtgcttgtttgttgacttcgtgaagatttgtgagcacttgcatcatctccgggagttctttgcttcatttgttactcttggaggttgaggactccaaagtggctaggtgtcgcccccgagccaccgatctacttgtggttggccgggaaaagtttgtgaaagtcggatctcacctncgaaagggaagagatacccttagtggaaggaagagtgcttagtgcaacctctagaggaaaagggttagctaagacccggctcttagtgagctcctcaacggagtgtagaatcccctcaaggattcaaactntgggaacatcttcgtgagcttcatctttggtgactttacttcctncctctccactagcttagcttgcttaagccgctataggtatagttgctgtttgtgctagcatattcttgtggtaggcaactagatctatgatttactttgctacttgggctgactccgaaaatttttggatatatccgaaaatttcggaaatatctgaaaaatactgcttccgcttttaattgaatttttgaattagcttattcaccccccctctaggcctaattgacactttcaatgtgtattgaactctagccttagtatccggcatgatctctgaacaccctgnacgttgtcttatctccaagcgnactcccggtccatcacggcaaatactctcccggtatcaattcacctacacatgaaacaaacaaagaaccatattctgagaccaagctatccccaacttgactcattgttagcaaacaacagtattacatacggatagtatccatctagaagtcatattcatgagataaactcagatatccaaacaaacaatccgaaaacgaaaccgacatagtgtcggccggtcagaccgcgggctggccggtctgaccacgcgtataccaccggtctgaccggcaaccactacccggtctgaccggtcacataaaataacaacacctgtaatttacctgcaaatgcaatcatctacaaaaccacttcgagaataatattccaaatatcaaaaccaataatctccaatgccaattgttcatcacaaaataataatcaaaaacacctttgattttacaagttcgtggcgccgctgccacccaccccagcacccgacgtcgctgctctccccaagcgccgacgcagcgtngncaccacccacccccagtggccgacgtcggtggtcttccccagc

SEQ ID NO: 40429 - DNA, 1033 bp, Oryza sativa
caagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcgattttggaaattcatttagttcgcaagcaccgacccaggtgtcgggttttccaagtcttttgtaaaacccaagttttacccaagatgtttttttcagattttaagtttgaaggcggccgtcgatactcgtgcagagtgcacgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttcaaatataggctcaagatattcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttataagattattggatttttggtctaaaggaaaaggatttacttaaatcctttttttgaaaaagaaaagaaaagaaaagaaggagggggaaaattagacttccctcgggaggctagggcgcggcccgagagaaaaggggcggctcggccgagctaaa

SEQ ID NO: 40430 - DNA, 1501 bp, Oryza sativa
gtgcataaggataccaaaggatggcatagtagggtttcatttgcataaacaacatttaataaacatttcagaatttaataaaacagttaagtaataattaaacaatattaatccaacgctatacaacataccctgttatataggcccaaccattctgaacaaccatcccggctgcacagttctatctccaaaccaggaatataccattccaaaccaggagctaatcaaattattaccagttatagcatcttttattgtgatgagaggtgtgagactaatcacgaaagacattgttagacccgcccataaccgcgggcacggctattcgaatagttttactctgaccagaggtgtaccactgtacccacaagacacagccccacatcatgtcaccatgtgcctcaataccaccacggtacctcggaaaggagctgtgacaataccccttgcataacacaatccaccgcagcgcaccattcctggatcataatcacccccttataaacaaggcatggactccccagcgacccccgtgggattatctccgccacttctcagtctggtgctccgcaatgaaccatgctatacaaaaggtaaagccgttgcccacgatggcttgtggttggcacggttaatgtttcacaaccgaaactcgtgaaccggtccttaattgccatgctagctcacaacccaccattatcaagttttagttggcaagtaattaattaaccaatcacgattgaccatcgtgaactagcattaagccatcattaaataatgaatcataagttatcctaatagtgtgctaatgtttctaagcatggctaagcaatcacatctaatatctagtcgaaccaatatatatagcccaactagtcaagttaaaataacccaaggtatcaaggaataaaggaaccaataacaaaaagggctataacaaacaatagtttaattccacccaatgacattcgaaaataaatgcaatagttgaatgaaaacaatagctttaaacgggatcaacatgctcaaagggttgtttgggatctgtgtgacttgccttgctggccttggaactcttcaaattcttctcctgcgaaaacggactctccggaaacgtcagaatctaaacagaaaagagcaaaaacaccaaaacagcacataaacaagcatgaaaagtacatgtggatatttttaacatgtagatctcaattttagaaaaatttagagacttgaaccaactaaatcccgagctaagatgaattagttatgaatttttaaagattaaatcggattaaaacacttatatggattttaattgaattatgacgcaataacgaattatttttgaaaaggaaaaagggtttattgcgtcagcaactagggtttgcggtggaccgggcgcacagcagcggttcacgggaacggacggccgagatcgatcctatccaaaacgaacggccgagatcaagatccacggccgggccatggcagacggccacga

SEQ ID NO: 40431 - DNA, 678 bp, Oryza sativa
  unsure (1)..(678): unsure at all n locations
agttcaaagaatctcaaatttttaaaaaggcaggagtatcttcctccaggtaaaaataactctttttaattttttatttaagccaaactttccagagtttgacgatcaacaaatcttttaaatccctttagtttgaaaacataaaaaatatagactnccaggtattttcgtaatctcataagataattagattttatgagtttattccaaaaaagtcatgattaaatttgcacctagaaatagtaaaagaaaactaacgtcatttaattatttttgacgcagagaatatactttatatggagagcaataggttgtgttgagctaaataattaatgatacagctacgtttttaacagaaaatgatcgagctaagttgattagaagggtaattttatcatcctttaaaaagtgcagggaaataccatattttaaagtataaaatttcatacctttacgtgctaggtatctcgaggtaccaaatcttttagtgtaaaatttaggtatctcatgtattttcttaagtactgtaaaatttctaattagaaagtcgtgattgtgtgattcaaatgggacctctgcaaaaactctggagtattttcttaaggagcgatatcaaaacgaaaggttccaatatgtgacacagaagatgaaaaatgtggccccaaactagaaaagcca

SEQ ID NO: 40432 - DNA, 319 bp, Oryza sativa
ttgcacctgttgtggttcttcacactgatgacatgttctttttactggtgtcaaaatacatgtttttgtggtcatttacttacgtagtctcatcttgagcccaactagttggatatttgccaaatttggaatgcttaccatttttagatagaataaactgttgtactatcattttttatcgttatttggttactatggttgggttgtaattaaaatgttccaatgatatatattgataggatttgtttcagaacagtatagcgttttcagtgtatgctctccacatagattctggtgtatgtgcatgctgaagctcatt

SEQ ID NO: 40433 - DNA, 1173 bp, Oryza sativa
gaagcagcaagacagagagagactagacagttttcacaaataacaaaggatttttatttttgagaatagtgctaaggcttgggatctatggctcgtcctagggtcaaaggtggctctgataccaacttgtcacgaccggaaataacccaacgggcgttcctgacgtgcgtgcattaatccttgtcccaggaggcaaggtacaccaaaagttgatacaatttagagtttaacaagtggaagcgtaaatagttaacttattacatgggcagcgaaggcccagcacacacaaagacaaacgggaaacagcggaagactagggtgacgaccacaggcgcttgacggcaggcacgagctagacaccaaagccttcatcttccaggggctcctcttctggggttgggaaaaattgagcaagactgagtacaaccaccgtactcaacaagacacacccacaagtgcggaataaatgcaagggagtaaaaaggggtcatactataaagggttagggttgcagtaaacagcatttcaagagatttagtgtctcaaagctattttgtaaacacgattctagaactatacaatattattcatcaaggccgtgaacccacacgaacctgccttaacccaaggcctaagatgattcagaccgaactggcaacccgaccctgggtcccagctcgtcccaagccaacccaggccaacccttccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagaca

SEQ ID NO: 40434 - DNA, 851 bp, Oryza sativa
agtcaatagatcgcgggtaaaatacattcactcaggacatacctccagctggggaccaagatgtcaatcccgtaaatataagatgtgctccacatgactcgcatgcaattttgtccatttcaatgttcacccagcctcttcgagcacaagccagtgaactagcagcctgtaaaaattaagctattagtttcttctaaaacaaactggatttgtcattttcagtagcatttttttcctctttgcaatacgagacatcaaaatggccgaaaataactttatctaggtaccataaggtacatgctaagctggacatttcagaaagtgatgtactggttcaaaaattatcaaacatatgcctgatctggatttcagctgggcatttgggcaaacatgtcatttgccctatacattgtaattcttcatttagacatggatatgtaagcagctaggtataaagaacacatctaagttacaagatgtctcctgagcattaccaatatgcaaaaaaggactaaagagaaaatatatgagacaaaacttagtgttgtatgtggcatatggataaaaattatactccctccatttttatttacatgacattggttatttctattttgaactaagcgtcaaataaaaaaaacagaggtagtatatctttagcttcagacttccattaccaaccttatcatgtttctcagcattcacttatatacatcctctgagcgaaaaatgttattcttaattctaaactggtataaatgcaaaagggtaagattgagcggcttgccaattacaaattacaatcacagaaaataacaaaaaaggaccaactagagaagagaaatgacctt

SEQ ID NO: 40435 - DNA, 246 bp, Oryza sativa
  unsure (1)..(246): unsure at all n locations
gatgggcccccnnggatgagcatctctcatctaagcgcgaattcgagctcggtaccccttaaaagatttgtaattttacacgtaatctgtgtaattattgttatttctatatttaatactttatgcatgtgtcggaactagggatggcaatttaacttgtttgcccgtttactcatggataaaaaccctaattgtcagggttatagataccctgtacctaatagtagttgactaaatctcggcagg

SEQ ID NO: 40436 - DNA, 518 bp, Oryza sativa
aggcgcagctgtgtcagcttaaggtcgcccagggtgaggtcggtggtcccaagcgccgcggggtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcccgtcgcagcgatagacgagcagttagtaggcttgcgcgtgtgttctttctcgtttgtcttcttgttggagttgtgtggggcatggttatgccggtgtatggcataactgtgtcggagcctgtctttattttatttgtctaagcaatttgaactttaatgaaccaatttaatagcagtaataaatttaagaattaaggtagtcgtgggtggttagctttaattgtcagctctctctctgtttgctggttctgtgtggggttttcaga

SEQ ID NO: 40437 - DNA, 1501 bp, Oryza sativa
tggggccagataaaatttcattaaatactttgcttaattttataattcctagatttttccggggtttaattgagctaagaaagtatttttaataaatggaattgcatttaagaaataatttaaattgaaaaaggttttaaaaagtcttcttttggctttgggctgaaagtcggcccaaaaccttctctctctctccccggcccaagtcggcccagtccgcagccgcccgcgcgcgcgcgcgtttggacgctgacaggtgggtcccacctgtcaggcccatcgtcttcctcgggccgaaaccctagcgcgccgccaccgagccgccgccgctgtttccttccaatccggccgcccctttccgtttccggccaaatcaatagaggggaaacactctccgggatctcctctaccttttctcctttggaatcatcagctaattcgttttggaagttcgtggaatcgagttcaattcggatcggcctctttccttcaagcccgagctttccttcctcgtcgccggcagccgtgggccttcgccttcgcctccgagcccctttaaaagcctccccggtgtctcctctacccgccgccaccctcgccttcgcctctcgtcgtcggagtcgctctagcgccgtgcaaccttgcgccgccgccgccgccgccgctccagccgtgtgccgccgtcgattcagccgtcgccgtcgctcgggaaggacgtcatcgtggtcgccaagtcgtcgccgtcctcgtccgccgcttcgccatcgtcggagaccgccggagcatcgtcgccgtcgtcaagccgaagaactccgccgtttcctcttcgtcgccggcgccgtccgttgcttctccgccgtcgttttggtcgtcggtgagttcgccgtgccgtccgctacccgttggtgcccttcgtttgtgtcctagcgccgccgttcgccggcgagcgtgcgccgcccgagccgtccgctccgccaagccgccgccgccgtcggtgacgtcattgctgacgtcatcaaggtcgtccgccgtgaaccgccgtggacccgatcgatctcggccgtccgtttggattggatcgaatctcggccgtccgttcgcgtgaaccgccgcccgtgcgcccggtccaccgaaaccctagcccgctgacgcaataaatcccctttttcttttcaaaaataattcattattgcgtcataattcaatttaaaccgatttaagtgttttaatctgatttaatctttaaaaattcataactaattcatcttagctccaatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgccggagaagagtttgaagagttccaaggccagcaaggcaagtcacacagatcccaaacaaccctttgagcatatt

SEQ ID NO: 40438 - DNA, 1501 bp, Oryza sativa
atatgcaagtgcacaggataacaaaggatggcataatagggtttcatttgcagaagcagcatttagcaaacatttcagaatttaataaaacagttaagtattagacaatgttaatccaacgctatacaacatacccggttgcataggcccaaccattctgaacaaccatcccggctgcacagttctatctccaaaccaggaatataccattccaaaccaggagctaatcagattattaccaattatagcatcatttactatggtgagaagtgtgagactaatcacgaaggacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaaggtaaagccgttgcccatgctggcttgtggctggcacggttaatgtttcacaaccgaaactcatgaaccggtccttaattgtcatgagcacgaccatcaaaaccatgtgctcacaacccaccattatcaggttttagttggcacattaattaattaaccaatcacgattgaccatcgtgaactattattaagccatcattaagtaatagtgattcataagttatcccaaaagtgagctaatgtttctaagcagggctaagcaattatatctaatatctagttgaaccaatataaataaagctcaactagtcaaattataataacccaaggtatcaaggaataaagtaatcaagaacaaaagggctataacaaacaataggttaattccacccaatgacattcgaaaataaatgcaatagttgaaaagaaacagtagctttaaacgggatcaacatgctcaaagggttgtttgggatctgtttggcttgccttgctggccttggaactcttcaaattcttcttctgcaaaaacggactctccgtaaacgacggaatctaaacagaaagaagcaaaatcaccaaaacagcacataaacaaacatgaacagtacatgtggatatttttagcatgtagatctcaattttagaaaaatttagagacttgaaccaactaaatcggagctaagatgaattacttatgaatttttgaagattttaattgaattatgacgcaataatgaattatttttgaaaaggaaaagaaggattattgcgtcagcgggctagggtttcggtggaccgggcgcacggcggcggttcacgcgaacggacggccgagatcgacttgatctaaaacggacggccgagatcgaacggtccacgaccggctcacagcgaacggccccga

SEQ ID NO: 40439 - DNA, 441 bp, Oryza sativa
tcatctttgaacatattgaatcccagtttgtaaaattatgttgatttaaattattgcattaccgctttatttaaattcccgcgttatcactgttttatctagccatgcctatttacctttgttatgaccttattattattgttgttgttattattaccttgttcaccctagaataaacaaaaccccaactagtggacactctactcatagtaccactagtataattttaggtagatgcttcgcaatttaattaggtaacattaggcggttttacaactctagactttgggaatattcatatcacctggacactttggaatggtttggttattgtggaattggcttcacaccgctccttctattcaaaatcccaaaatggttttaggctgggctcggggtgcatggttttgatagtagcacctcggccatacaaggaccggt

SEQ ID NO: 40440 - DNA, 237 bp, Oryza sativa
agttttgatgtgatggaaaagtttgaagtttgaagaaaaacttgggaactaaaccaagccttagttttcaaatttttcttcaaactttcatcttctccatcacatcaaaactttcctacatacacaaactttcaacttttctgtcacatcgttctaatttcaatcaaatttccaattttgatgtgaactaaacacaccgtaaaccaggcctaactctcctccttttttaatcacaga

SEQ ID NO: 40441 - DNA, 237 bp, Oryza sativa
  unsure (1)..(237): unsure at all n locations
acctcatctagaagtcctatcaccctagnaaccttctcgacaagaaacaaatttacaaaacaaattccaccaaatttgaactccttccaaatgcgactcggcatcccatacgcacacaatacctccatcntaagccatatgaaacaaggatgacacgcacaatcgagaaatggtccaaatttttttgagaattctgcccaggtccctggagcttatactttttatcgcagttatgcc

SEQ ID NO: 40442 - DNA, 1501 bp, Oryza sativa
gtggatagaaatcaatccattctaattcaactaaatttcagtccgcagtgttaaaaataaaatgtagtccattttatttaactaaaaattggtcagttattacccacgtgtcgctccgtacttattcttagttaaagttttagctagaagccgagttatcatattcttgttttgtttcttagaatattccaattcctaaccatgtacattacctttttgggaaaatcaattttgttgttctctccaaatccaaacgactcaatcgagccaaaggtgacggtggtggtcggtatgatggacgagcaagtcctctctcaccacctccctctacaatccaaagccatgatgttagctgggaaccgttaacgtcaaaatttggtaaaattctttagtggattcggttaagaaaatagcacaatcgtccgatataaacttatccagaagagaccgagttcaagaaaaaatcgtgaatactatggcatggtggcataattatatctattaattaggcaggatttagtagtttgctttaatctttaggatagtatgtttagtgtctataaggactttatgttttccttttatcttcaggaaagtttctttcttgttcaacaaggactgatatctaaccatgggtacaaatatgttctatcaagaggtatgacttgatctcagcggtttgcgttggcggattagggcgtcgctttagatgttctaatctatcttctacaccgatcgatggttatcatatatcttagttaatctagcttaacatcttaatttgatcatatcgaccgagatttgttttagggtttatacaggtatcgactaaattatcttgctagattagattaactaaggtatacaccacccttaaaatcaatcatcaaaggcttgattgtctagacaccatgttttcttttatactttccgctgcattagccctagtcgtgtttagaactataatctctaccctactgtttgattttcaataaaggtttcatcggggtatcagccgatgagttatctgatgttgcatcggtttataaggattgcatacaggttgtttttagccaattgcaacaaagattttactgtttatctaatcatttggatttaatgatatcggacctctagtcgatgtatgctttaaccatcggatcacttattctatcatgacattgttagcagattggtttctattagattatattattgttttattatcatcaggcgattgtccttatatcactatctgcattggatatatagttgattgctcaaaacctatcgacatcggctggaatcgctctatcggcttgtcagccgatcgactctttggtgatcaacatatttgtctatcttgtcagtcgcaggatcaaactgactggcgcgccggcaccttatcaatattctggacttgcattggagttaagcagatctcccatgccgttgtgttcgtcgacttagttcgcgccaacacagttccagcaccatcggc

SEQ ID NO: 40443 - DNA, 1501 bp, Oryza sativa
ggtctaggcctacccacttctagattgagtgtctagattctctgtcagcctacgcttgaccagaaggtggagtgttgttttccacgctgcgcagtacaacagacatatctgttggtttgatcagcctattctcttaagtatgtctactaaccagactgttttgtttgataggacatgaagatttacattccagtggcgcccgaagcttctaggttgtttgtttgctagttgagctgattatactcgcaaagtacggtctatatgtcaagttcaccatatactccctgttggccgtgagcttccaggtcatgatgtcataaactatgaacctagtggcgcctatagctgttttaaccacattcaaatatcaacgaaatgccatatatgattagcttttgtgatttgacgaatatttgaatccaggtgtcttcctctaggctgtcccacactaaacattctttcgttttgaggccataaagattgcagaggccaagagcctcggtgttttgttgtctaggcaatgtgagtcctagaacctcaccgtgtttccgttctcaagagtgatgatggtcgcaaacgcaaaatgatctgtgtatccagctggttaccagatccggcatgcctacccaaggtatctccaatgccttccaatattcaaaccaaagccatcgcaaacttaaaaaacgctcttgtgaagcgacgcgacgcatatttaggactcatcaaccacaaagttctttcggtttgcacacttttttttccaattcaactgcaagttttattctcgcatatttttaaacttagttataaaaagacatggtacgaaatataggtcaagattcattggcatacagtcactagcaagaattttagttctctctctagtctctactggtaaaaataagtatatagctcgctggccgctgcttgagctaaaaaagaatagttggcaactgctgctaatgttcaccatttctgaaatcttttgacctccaacatttgagatgccacctgtaaaaatgcgagttaaattttgatcttcggaacatgcagtggactatcccaattaaggacccagcaagtgttatcctctccgtttgaataatcggcggtgaaaaaaaaaattgaagcttcgtggcagcctcgactctgaacagaaacggccaacatggacaacgtgcggtgccactgcgatccctcgtgcaggcgtgcacggtgcagcaagctagctagcgatcccgtgggtctcgtacttacctcttcacgacgaacggtaatccagaacaaccgcggcccgggatagcattcgagacttgcgcctcgcggaatttaccagctgcttccacgtgacagagcctcacaaaatccacctgcctcgtcagactggtttgttgtcacgcgtacgtacgtaaatttgttctcacgcgcacgtaaaagacaacaggaatccaccgtgacttgcttcaccaccaccctgcatgcatattccattttccagagg

SEQ ID NO: 40444 - DNA, 1501 bp, Oryza sativa
gcgggagaggtagaaggggagcatggcgtcgagcacccgcgggtcgacgggggtggtcgcctgcatgtccatgtacagcggccgccccgagatgcgcacgcccttgatggtcatcgcctcctcctccgccgccgccgccgccgcggcgggagcatcggccgtcacggcggccgtggagagcgcgcgggcgggggagagggagggggtggacccgcggcggaggaggagcgggaggaggcggcgggagagcgccatgggtggagggggggagaggtagggttcggggattggcggtggcggcggagatcgagctcccgtttcggcggaggggtgatttggggagaaaaaaaaaaggagagatagggaggagatgggttgaggagaggataggcaccgccgtggcggtgaggttggcaactgggccacgcaaggcgacgcgtctgactctgagcccgtcgcggtcgcggtcgaggcgacacaccggttcggcccgttgtttgttgttgggccgtggactactggtgagtcataaggtcatatcatattaacatagccaatccaaaatttatttctcttctttaaattttgcttttttaagaaaaggcaacctgccaatttttattaaatagagaaggagtaaacggagagagctacaaatcggacgtccgacgttgtaataaaaattggacagtcaaatatttcggttgactgttggtgcaacattaagttatacatagtgaaacaaaacaaaaaagtcagcctatgaaacatatagaactttttgtgaaacataataagaacacatggtgaaacatatttctatcacatatgaaatttttattgtctgaaatatatgtttttctttcatcaaaatataatcatgcaatatcttgttgtaaagatttaattataacgaatttaacggtgcgatcaaatcgttcaacgaataagtagtttaaaagaaaaaataatttttaagatcactaaatacttgcatcatgcgtggtgtgtgggagaaagctaatagaatagcatgagagagactaggggcaatagcgtctcatattttttcggtcattggtgaaacattgagttgcacatagtgaaacaaaaaaattagttattgaaacatttaattttttttatgaaacataacaaaaacacacgttgaaacatattgctactgtgtctgaaacattaaatttaacggattgaaacatatatttttctttcatcggaatgcaatgatgtgatatcttgttgtaaagatttaattgtaacaaatataatgatgtgatcatatcataaattggataaatagtttaaaagataaaacattttgaagaccatcatatgaatgtgtggagacatggggtactattagtagtttgttcatccgatcttttttttcgttggacatctgatctcctcaagcatttcgggagtgaactgtacaaagacgaaaacgagctcaagacctttgatccgagctaactaaaag

SEQ ID NO: 40445 - DNA, 1501 bp, Oryza sativa
tcgaatagttttactctgatcagagctgtaccactgtacccacaagacacaaccccacatcatgtcaccatgtgcctcaataccaccacggtacctcggaaaggagttatgacaatacccctcatacaacacaatccactgcagcgcaccttcctggatcataatcacccccttataaacaaggcatggactccccagcgacccccgtgggcttatctccgccacttctcagtctagtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcatgaaataatagtgaatcataagttatcccaatagtgagctaatgtttctaagcagggctaagcaattatatctaatatctagttgaaccaataaataaagctcaactagtcaagttataataacccaaggtatcaaggaataaagtaatcaagaacaaaagggctataacaaacaataggttaaatccacccaatgacattcgaaaataaatgcaatatttgaatagaaacaatagctttaaataggatcaatatgctcaaagggttgtttgggatctgtgtgacttgccttgctggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcagattaaaacacttaaatcggtttaaattgaattatgacgcaataatgaattatttttgaaaagaaaaaggggatttattgcgtcagcgggctagggtttcggtggaccgggcgcacgggcggcggttcacgcgaacggacggccgagattcgatccaatccaaacggacggccgagatcgatcgggtccacggcggttcacggcggacgaccttgatgacgtcagcaatgacgtcaccgacggcggcggcggcttggcggagcggacggctcgggcggcgcacgctcgccggcgaacggcggcgctaggacacaaacgaagggcaccaacgggtagcggacggcacggcgaactcaccgacgaccaaaacgacggcggagaagcaacggacggcgccggcgacgaagaggaaacggcggagttcttcggcttgacgacggcgacgatgctccggcggtctccgacgatggcgaagcggcggacgaggacggcgacgacttggcgaccacgatgacgt

SEQ ID NO: 40446 - DNA, 1501 bp, Oryza sativa
gagctacatttttcattctccttccgtcccaccaggccgaattccagaagcttgtcttcgcaccgtttccaattgctatggaggtggcagccaaaaaaggagtttgtcggtgtcttctttaaaatttgatgaataaccaaacgaaaatgcaacgaactgacaacttaggctgtctggctgtggctgtgttcgtttattcccaatcacaacttttactctcttcgaactactgtacttaaaacgggatgttcgtagaagtgcataggcggtacttaaaattgtagaggtgtgttatctgggtccctaaactctcaaaatacagatacaagttatataacttgtaaaagtgtgtcatcaagatcctaagtcaccacaacccctctaaaatcctacgtggcgctaatgtggcatgccatacggatgtgacctggcattatcttaactgacaaatatgatccacttaaaaattttatttttccttttttcttcttctccttctcttttttttttcttttcttctcctttctttgtgacctgagcaccccgtgtggcggtggcctgtagctgcagtgagaggaaagagaagaaagcaaaaaaaaagagaagagggagaagaaaaagaaaaagggaaggaaagaagaaaaaaaggaaaaggaaattttttaagtggatcctattcgtcagtcaagattataccacgccatgtccgtgtggcatgtcactttagcgctatgtaggatcctagaggggctgtagcgatttaatacctagatgacatattttgataagttataggaccttaattaacattttgagagtttagtgacatatgtgacgctacctatactctttacaaaaatattcaactttgaaatttatattaatgaactattccattttacatgcgcggaagggaaatttcccaaacttctctcccgaacacacccttatatgttctccctccataccaaaatactccctctgtcaacgtatatgaagtattttcttggttatttgatatagattaccattgaaggaaaaaactttaatatatgtcattaaataaaagatggttggaggtaagatagggagggaaatttaaatagaatgttatatttatgtgcaaattttaaaccccccaaatactccaaatatttatatttatatttatattatatagaactactattaggagcattccaagcaccaaacatgcatcggcccaggtccaccccaccccacgtcccgtcatcccactcctaccgttgttggagtaaacgatttactcctatcgcgcacctcaaccacccacctttattcgagtaaatgatttacttcgataataaaaacaactcccccgcttccgatcccaccccacgtcctgcatcgtgcacccaccattatcggagtaaatggtttacttcgatgaaaacaacttctctgctggcggtatatattctatttttcccgtacccaaccaaccactctcgcccccactccg

SEQ ID NO: 40447 - DNA, 1501 bp, Oryza sativa
cgacaatgtgtcacagcgtacgttgtcgggttgggttgatgtgcttcatgaggattgccgcgtatggatagagtcctgagaaggcaattgtatctattacttaggatattttatgtaattttcttagagatatgttcgggcaaaagtttgctgtaaagacttgtggtattttagagtttgttagagataagagtcatgtcctaaatggacatattttgtaatctcgggtataaaatagaccccgagccccatgtaataaaactaacacacgctcaatacaatctcggcgcatcgccacccttttactttcgttttgttttcgacgaattcttgcttttgggttgagttgcatcggtttcgatcttcaacaagaggtaaaacttattatggcggcttgcgttctcaggattagtgcttacatctttatgatactctaatcctatttatgtaattcgtcgagttatcatatatcttacataatctccggcaatatcgctatctattcatcaatcggctaacgtctgccactagagggcagccgattaagttaaataccgatgttgacctagattatataagatatctaccaccctatgaaacatccagcgacttgattgtctagatattatcattcttttcatacttatagctgcatcagttgagtttgatcttatgagtcgtgattagaatctcaatctctagcctacctttggttggcgattagagtagcatcggggtttcagccgatcttacctgatttaactatatttatcttatatgcttgattgacatgttaaatctgccctttatgctaagatcttgtcgcatttaagttattaggattttgtttggtatattttacttgctttgatatcttaatatagagtggtatcggagtattagccgatacatgctagatctatctgatcggctatgctatgaacatatataatctcattgttagtatatatttcgatctaggtgatttatactgtctcggcatggcgaccgatctatcccaatcacttgatttaagcatatatcaacataaggattatatattgttaatatctacagccgatcgagtagatttagtcctttcttacttattcatgattaccgatcgattcacatatgacatcggcttgaagataaatgatatgtcatcggcaactagccgatcggctatcgtttatggatttaaccgcggtttcttcgtctttgtttcttgttgattgcaggatcaaatcaactgacacgctcatacatctaaaggcaagcttttggacctgcactggagttaagcagatctcctagacctcgtgttttcacgtcaacacatctatacgaatgtggataatactaaaaagtcggacgtttttcgcctctgacggaaaggggccgggggataatgcgttgttggtttcactgtgcgttagttaatcttcttgaattaaaactgttactccctccgtttcataatatatgtctaggttcatta

SEQ ID NO: 40448 - DNA, 1501 bp, Oryza sativa
aagacaaagaaaccgaaattaaatccataaatgatagccgatcggctaaatgccgatgacgtatcatttatctttgagccgatgtcatatgtaaatcgatcggcaagtgttaagtaaacaaatcagaactaaatctactcgatcggctgtagacatcaataatatataatccttatatcgatatatacttgaatcaagtgattgggatagatcggtcaccttgccgagacagtataaatcacttaaatcgaaatatatattattaatgagattatatatatatatattcatagcatagccgatgaaatagatctagcatgtatcggctaataccccgataccacttcgtattaagatattaaagcaagtagaatataccaaacagaagcctaatatacttaaatgcaacaagatcttaacataaagggcagatctaacatgtcaaacgatcatataggataaaagcagttagatcaggtaagatcggctgaaactccgatactaccctaatcggcaaccagtaggcaggctagatattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcaagaacacaaaccgccataacaagttttacctcttgttgaagatcgaaaccgatgcagctcaacccgaaagcaagaactcgttgaaataaaactaaagcaaaaagggtggcgatgcgccgaaattgtattgaacgtgtgtgttatccattacatagggctcggggcctatttatacccgagaattataagatatgtccatattggacacgactcttatccctaacaaactctaagataccataagtttttgcggcagacttttgcccacatttatctctaaggaatttacataaaatatcctaattaatagatacaattgccttcccaggactctatccatgcgtggcaatcatcttgaagcacatcaattcgaacccgatgtcgtacacaagtcatattatcggaatcggctgtatcacttaacacagtctgactcagacttagccgatctcaatcgtagccgatccggactccagctgattcttactctgtttccgcaacaacccttatcttcgattccgcttcgatccattttcatctcccatgctgatattaccaaatttggtcgttaacacatgccccccaagtccgggatatttgataatgttccggatttgccgtgtatcgactccgagcaagtttcgcactctaccgttttcccaaccgttactct

SEQ ID NO: 40449 - DNA, 1501 bp, Oryza sativa
aaaaaattaaataagatggacgattaaaattggacacagaaactcgtggctgcacttatttgggatagagggagtagaacgtaagttgttttgattttttgaactcattttttttaagtttgatcaagtttataaaaaaataacatctaccaaattaattttattaaatcctatattaaatatattttatacattatattaatggcaaattttgctacaggacacttgttatgtgtggttttagccctaggacattggccaaactcacttttggggaaaacactccataaacgtgataatttgccagtggacaccgcgccaattaaaataatattttccggttagggaggagagagaaatcgcgtgaaatgtcaaaaatgcccttgggcccacatgtcagctctatctcctgtctctctcctcatctctctcttttctctctctctcttttctctcttagatggcgaggacagcggccggcagagttgagcgtggcggtggccgcggtggacgagcgtgtggccgccggagccacccctcatcgccggcgccatggccgtgcccgctccgccaggcgtggggcagcctcgacgtgctcgtcggccgcctccgcaccgccttcgacgagcacggaggccaccccgaggccaacccgttcggcgcccgcgttgtccgcctctacctccgcgaggtctgtgacagccaggccaaggtgcgcggcatcgcctacgagaagaagcgtcggaagcgcccgcccacctcgtcttctcactctcaggacggcacagccgccacttgcccggcgagcccagccgctagcccgacgccgctaccgccgccgccggagagatcagctgacatgggagcttgcgtcgccatcgtcgtcgccgtggggtgcacgccactctcgctagccgcccgccgcggctgctcctattgcgcgctcgctcgccgccgctagctgccgcctgccgcgcgctcgtccaccgccgctgctaccccgctccactccgccggcccaccatttccccaaacatttccacacattcctacaattttcctttatttattttcaaatttcatcacatttaaactgaaatttattttttcgtaaaactattttattttctcaaaactcatgggggatgcttgtctcggtgcttttaatgaaactccatcagagtttgacataaaccggtccaaattcgtgttcagttagcttaaaaaactaggtagcattcaaatttcaatttcagaaaaatcatggtagtttcaattaaaaaacggagatgtttcttcaatttgatggttatcaatgaatatttttgatgtagaaagaaaccagttataacaaatagaaaattatttgcttaatgtacaaacgaaaagaaaatctctcccaaaatttacaatttctagtggcgcgcgcgggaatgcaatttccccatctttatcttactagggcgcctctccaaccttatcctcctcccagagtaacacc

SEQ ID NO: 40450 - DNA, 241 bp, Oryza sativa
tctgcacatggtgacaaggtgtctgcacagatatgtgatgaaagtaggtgattacctttgaaataaaatggcacgcttttcaaactgctaacaagtgtgttccgtgcgaaaactttctatatgaaagttgttctaaaatatcatattaatccatttttcaagtttgtaataattaaaacttaattaatcacacgttattaactccacgttttacgtgaaatgcttaatgttcatcttcagg

SEQ ID NO: 40451 - DNA, 1501 bp, Oryza sativa
actcctcgcaaagatcgacaaagtgaggttaaatatagtttttatgtggccaagtgtgataaaatttttgattatcttttacaagaaaaacaaattagattacctaaaggccatgtcataccatctcaagaagagttcaaacgtcgagcatattgtaaatggcatgattctcattctcattctactaatgattgcaatgtgtttcgacgacaggttcaatcggccatagatgaaggacgattgaagttcaccgatggctccaagatgaagcttgatcatgatccttttccggtgaatacaattaatttcaataataaaaaagtgttgattcggtcggagcaagccgaatctactaagggaaaaggagtggtcattggcaaaccaaggcctaagatgatagtgccaaagaagccggaggttggcatttggaaggagaataagagtggagcttcaacttctaaagcccctaggaagaccaaagtgacttttgacatgcttttgaaaaaagtatgagaaggaaggtggtttgagagctcgcaataaaggaaaaagaccaagattacctcctagggagcgatttggtcattcaccaagacagtcgcattcacctccatatcatcatccacaagatatgtcatggggttcttatccaatgccgccgccgggttatccttatccttattacatgccatggggggcaacgccgccaatgttcaatcatatgcctccaatgcaattcaaccaagggtgggaaggactaaggaggccaattcatgagcgtttgtcttcaccaaacaacggccggttttatggtaaaaatcgggctgatgaagaaagaaggaaaggaaagcacatcaaggtggaggcaaggacttcggaagtaattaccatcaaagtggggtctcatgatgtgccaataccttctggagatggagttggagtgtcctcaaatagaaaatctgaagccgataccagctcatcgcagtcggctagtctgaccgggccctctggccggtctgaccgcagccatgtggctggtccaaccgccggcccgacagcggtccgaccgacgcctcaggctggtctgaccgtgcgccaagtgtcggtctgaccggcgcatctggccggtctgatcgatggtctacggccggtctgaccgggctccagtgccggtttgacaggagaattgcaaagggcgatgtgagggcttcatcgtcttcaaacaaaattaatagggggcattatttacctcctggaacagagccgaatcctagatggatgcctaaggatttgatggctactcgaaagagaaggttgcaacgtcttggagctcatgaaataagagagaaaaaggccgaagaacaaagagataaaagattcaatgagtttcgaccaccaccggtatggaggcgtaaatccatagagaaggaaaagccggttgatgtagaagagaaggaggagcaattggttgataaaggtgaatcatctccaaaagaagaca

SEQ ID NO: 40452 - DNA, 618 bp, Oryza sativa
tttatgattaatatttctattgttattagattataaaacattactagtacattatgcgtgacttatgtttttttagtttttttaaaaaaaaaattaaataagatggacgattaaaattggacacagaaactcgtggctgcacttatttgggatagagggagtagaacgtaagttgttttgattttttgaactcattttttttaagtttgatcaagtttataaaaaaataacatctaccaaattaattttattaaatcctatattaaatatattttatacattatattaatggcaaattttgctacaggacacttgttatgtgtggttttagccctaggacattggccaaactcacttttggggaaaacactccataaacgtgataatttgccagtggacaccgcgccaattaaaataatattttccggttagggaggagagagaaatcgcgtgaaatgtcaaaaatgcccttgggcccacatgtcagctctatctcctgtctctctcctcatctctctcttttctctctctctcttttctctcttagatggcgaggacagcggccggcagagttgagcgtggcggtggccgcggtggacgagcgtgtggccgccggag

SEQ ID NO: 40453 - DNA, 279 bp, Oryza sativa
ctaaaaaataactaattacataaattgcgactaatttacgagacgaatcttttaagcctaattgtttcatgatttgataatatggtgctacagtaaacatttgctaataacgaattaattaggcttaatatattcatctcacaatttacagacagattatgtaatttgttttattattagactacgtttaatactttaaatatgtgcccgtatatctgatgtgatactccaaaactttccacccctaatctaaacacccctctattactccagtcacca

SEQ ID NO: 40454 - DNA, 1501 bp, Oryza sativa
ggctaccccagtcgctgttgcgccctccaccttcactgcaccgttctcggaagccctaatgggcgattagtcacgccccccgcacggcccgcagtcagttgactcctctagtctctcctatctactacatatatatacgtatataaagtatatatgtatgtatacatattgtatatatttattatttttttaatatgtatatatttttatatacaaagtttgtatagttatatataaactttgtatatgtatatatacaaaatataccaattttgtatacgtatatatacaaagtttgtaaatgcaatataaactttgtatactcatttgtatacgtgtgtattaaaaaaccgaaaaaactgaaaaagatatggaaagaaaaaacagaaaaaagaaacgtgcgccaaaaaagaaaaggaaaccggactaaaaatatacgaaaagaaaaaaaaaacagaaaagaagaaaaccgttcgttaaaaaaaaaaaagggagaaaccgcgtgctggccgcgtccccctctccgcgcgggggaggacgcgcgcggctgagcgctcgttagtcttttcagcgggtttgccccaggatatggtactggtggcgctggacaaagcagacagcgattcgcgacggcaagcagtacatgtggttggtcgttgcatgcgtggctactgttagaataaatgggctggcccgatttttctattaaattgcaaaggcccataataaatattaaggataataatactaccctgggaattaaacgaggagtatctcaatttaaatagggagttattggaggctccctgttgaccggttgaggtgtggatcggaaagccacacgcgcgcgcgcctagcctgtgctgcttctgtctgcttccccggttttgatcgcttgcacgcacgagagatcggaacgagcagggcattcagaaccacaccattgcctgagatctgcaccgggtaggcgggtgatcaagtttttggggagtgcttccgcacgactgctctcgtcttctgttcgtcgacgttcgtcatcgaccgtacgtctgcatcaccatgtctgcctcacttgcacctagaaatggcgcatcgagagctggtgcacagaacaacaacaccaacggaggcagttatgcctcacaatccagcggagggactttcacagggtataatcctctactgctatttcagtttttgatatttctgttagtcgcaatgcaattgcgttctatgtatgaagatgatgtttactctaccttaagcatgctcctgtttatatttgattttatcactagatcacctcatattgttcatgtcatgattattgtcttaatattttggattaaaatatgctgatatatgactatatttccaacaatccaaaaacctgataggtcattttcggtagttgggtttgctgctgcactgaaaccacatgcttttgatggttctaattataagaggtggaaagcacgtacactactgtggttgacagcga

SEQ ID NO: 40455 - DNA, 879 bp, Oryza sativa
gtttgcactggttttgacaatagttgaactagccaactaggcctttatgcgcaagcatttacagtatatgcctatgggctttcagtttcagcgaagagtaagcattaacggggttcggttggtgggcatatatcaggactgcatgtctgtatatacagccatacatgtcaattgaatacctggattcctatctctcccaaaaaaaaattgtattggttaaaattttggtacgccaaccgtgtttgaattggttataagttgttcgtatctaattcgacgtgaatgtaaaacaacaattatacacccctcccaacctaacccaatcgactcacgccatcccgatgccccgtctcgcacacccctccctcgaccggcgtatttttttctttccctttttttcattttctttttcccctaatcatccttatcttctcccgatccttccaatctcctctcttctctcttttttttcttccaaatttctttccgcaaattataattatttaaggtgtgtatgcgatatgtttgctactttccaaatgctttccatctatagtaaaagaaaatttcactaattgataaaatttcaatctttgatagatgaggtgtagctaaatacacatgcatcaacttatggaatagccacctatcactactggagagggagagactcccgagtgtcaaaaacactcggcaatgcatgaaaaacactctgtaacagtgttacctagcgcaacactccgtaatcttcgcctgggagtgatttctccttcccgtgcatagttggcgtgtgtcctaggtggatacaccccgtaacagtgtgataattgccgtgtgctctaggcactcggtaacattttcaccccaccgtccaacaga

SEQ ID NO: 40456 - DNA, 185 bp, Oryza sativa
ctgtaaaattaatagtggcatgaatctaaataacccattataaaatgagatatactatattcatataccatataccaaaagatatgataaaatcgtcgatcgatggcttgtactgcctccatttcaggttataagactttctagcattgcccatatttctatagatattaatgaatctagggaca

SEQ ID NO: 40457 - DNA, 1501 bp, Oryza sativa
gccgggttaagagagccgctagcaaaaattatagatattttcgctggcggatcacttaaataaccgccagcaattttcgctagcgaatgcttaggagcactgcctaagaatttattttcgagatataaatcctacccacctctcttcgcctctcccacccaaccaactttctctgcctctcccacctccagcctccctcctctctctccgtctttctcgatattcctccggcctccctcctctctccaccgctgtcggctactgtcgctttcgtcgtcgccgctgcatctgtcctcgggaaggcgagagtgaggaggacggatccgcagccgtcggagggcggggagcgtggatcagctgccgccgggccgcggggcctcgtcgtcagtagcgtcgcagatctcgtcgtcacaaccgtcaccgctgggccacggggagcgcggagccgccgccgccgggccgcggggagcgcagagctgatgcagccaggccacggacagtggtgctcggctggtggtcggtcgacgacggcgacaatgagcggtagcggcttaaaatttctatggatttgtgtttggattttctgtcgatttgtgcaactatccaatccggttaatgtgtttaaagatgggaatggaaattgctgtgattttgaatggaaagtttttactgtaaattgttgatgtaaatttctgtggatctgtggattaaggagtggatttgggaataatttgaacgccacgttgatggagcggtgtcgctccgtcatttttttttagccttgtccagtattaagactggcggctgatatagtgtaccgcccgtgaaaattcagctaccgccaatcactggcctttagtcgctgacggcgctgttggacgccagcaaaaattcattttggccgccggcaaaaaacgatttttctagtagcgctaccaaatctttctacaaaattgatgaatttttagaactagctgggtagcacgcgcaattgcgcggctagcacccaaacaaaatcattttttttatgattttacttcaaatttattgaatagttatctcgttgtctttaaaactttgaaagattaaacattttcatccccgtgtttctaattatatagtttttaaaagtcacaccagttgctaccccttacttctgtcatctccttttttatttgcttgctcgatctaccattatttctattcattctccttggaacctttaaaaattggagcttatagtttttatagtttattgtcaaacgatgctactatgctcctctacggctcgtccgccgcctactcttcattgtcattgggattctaaaaatcaaacataactatcattggaattcattttttattttctagaagtctcgccaaccgtcggcggctctacaactttacacctatacaccccgctcgttgcttctcctttttattatcattgagattttaaaaaacgaatatatcaatggggtttatttctttactttctaga

SEQ ID NO: 40458 - DNA, 1501 bp, Oryza sativa
gggccccacccgtcagcgagggtggcgggcgggccctcccgtcagcggcgcgcgcgcgggggaaggccgatgggccgcgggggagaggagagagagggagggagctgggccgagccggcccaagaagggaaggggggaaaagaagactttttagggtttttctttttataaaaccattttaactttgtttatttcttctcaattattatttgtgctctgaaaattccagtaaaatttatttacgcattttaggcttttaggaaatatacaaaaatcctccaagccttatttgacttttaaatttgcacattttaattgttggaggctttcacatggattttaattattctcggcataatttcgaggatgtattttagagtcgttttgggacgcgacaactgacccgcaaatggatgcatacgtctgcgaggtgcgatgcatggaacgccgcttcgacggactcgagctctgtcacatgccccggcgcgacaatgcagtcgctgacgagttgtcacgcatcgcgtcggcatgagccccactccccccggggaccttcgaggaaaggctcgcgcagccatcggcacgggtggaccccccgagggaccccgacgccacggcctccgccccgacccctaacgacccgcggccctcggggcccgagggggtcgaccccaacccccctcgtcaggtcgtttggttgactgacatttgggcgtatctcgataataatactcttcctgaggatcacgcagaagctgagaagctcacgcgtgtctctaagcgatacgtgctcatagaagggaccctctaccggcgtgccgccaacgggatactcttgaagtgtatttctcgggagcaatggggtcgagctcatctctaacgctcatcagggtgagtgtggggcccattcggccttacgtatattggtcagtaaagccttccaacaaggtttttactggccgactgcgttgcaagatgcccaagaatgggtccggcgatgcaaggcgtgccagttccatgccaagcaaacccatcagccggccgaagacttgcaggcatcccgctctcttgcctttcgcggtctgggggctacacatcctaggacccttcaaagcggcccgaggcgtatatcagcacctgtacgtcgccatcgacaagttcaccaagtggcgcaaatcttactgtaacaccctgaaaatttgaccaataaaaacaaaactctaaaaatacgggccttcgaaaacttttaaattaattgcatcatgccgatcttattcgcctattttatttggatttgatttcgaagttcattaatcgtgagtaaagtatagttaattaggaataaaccctagaagtaaattggtaaaataaatataacttaaaataaagactaggtgtggatagaaataaataaaatattatcgcgatcatatttgtatcaattaaatttaaatgcgatggaataagaattaaccctaattaaaaattcaaataaattata

SEQ ID NO: 40459 - DNA, 838 bp, Oryza sativa
  unsure (1)..(838): unsure at all n locations
aaaaaccctcgaacgctcactctttctncntttnnnnnnnnncnnnatttaaattccgggggcccttgcaacgtctgacatctctacacctggacctaaggatgatttataccacctgggattaaagatcacatatgaccgttgtagcaccaatcaggactaaagatccggttttaaatggatccgggattattgtggatttcggccgaccgaccaaagatggtttctccaccagtgcttgctccgtctccacccaccctttcctctttcgctctccgcctactccgcttagggcagtagcaatgcaaagccatccttctgtgtcttctgttattccctactatcgccgtgtttagatgctgtaaaaatttggctaattttcttttatgtacacagacacatattttaagtattaaacgtagactaataacaaaacaaattactgatttcgactgtaaactgtgagatgaatcttttgagcgtaattgatccgtcattagcacatgtatgttactgtagcacttatggttaatcacgatgtaattagacttaaaagattcgtctcacgatttatagttggactgtgcaattaatttttctttttgttcacatttgatgctccatacatgtgtccaaacatttgatgtgatgaaaaagttggaatctaaacacagcttatacacagtgggcgttatctgttttggcacaatgcaagttaccaagagttagcattgatatcccaggccaaggaatatgttccccaactacccctttgttctcctcgacgcatcgcctccccacccacttcatctcccaatcccccgctttttcccccagt

SEQ ID NO: 40460 - DNA, 544 bp, Oryza sativa
cgagggcgcccctggcaaccagactggggccctttgattcgcaggatagaaaaaacacagggaataaaaaaaacacagaattaaagtagtaggtttctcaaatcctataggaattagcgaacacaagaaaaacaataggagtctttgatagtgctataggaaaaataaagaaaagttcacaaagaggcacatctcttgctatttttcctatgaaatggaaagcataggattggagtttcctttcttttctataaatcaaagggacatgtagaaaaaagatccatagaaatttgaatcctatgaaaatccttttccaattctatgaatcaaagggagtttgatcatcaagtaatttgacgaacgaactagactttcatctgatctcatcttatctagtcatctctgattctctaatcaagtgtgtatactgtatgtatgtatgtatgtatgtatgtatgtatacgacatatgtctttttctttattttgtttataaaacaggaactcaggaaggcttttatttcctcaattgctttaattcctca

SEQ ID NO: 40461 - DNA, 318 bp, Oryza sativa
  unsure (1)..(318): unsure at all n locations
aaaacngtttcactcttcatctccagcaaccgatcttcgttcccccaccaaattggtgaccgacctgttggttgattttatcggctaaataccaattagctaaggaaagaataaattccacttgtccgattcctaaagagatagagttagtttttgtgattggtaaaaactaatttctaacaaaatttcgagataacccccgagcccccaccaatgcgcctatataaagagatgaagggcagaggagggacgccgagctctctacctaaaccctaaatcgcctgatcagcttagcgttggaaggggttcgtgaggtga

SEQ ID NO: 40462 - DNA, 237 bp, Oryza sativa
ggtctcgattaaccacttgcctcacctatgcaaagaacccagaagatgtgcatggccttcaacccaacacttctagcaccacaagggatcatgtcttttgtgatgaaaaacttcatcactaaaaggctgtttctcatcacaattacccccttgtgacgaattttggggtcgtcactatgttgtcaccactactggcgtcacaagtagcatagtgatgattttttttttcatcacaga

SEQ ID NO: 40463 - DNA, 1501 bp, Oryza sativa
gaggagcccctggatgatgaaggctttggtgtttagctcgtgcctgccgtcaagcgcctgtggtcatcgccctagtcttccgctgtttcccgtttgtctttgtgtgtgttgggctttcgccgcccatgtaataaattaattatttacgcttccgcttattaaactctgaattgtatcaacttttggtgtaccttgcctcctgggacaaggaataatgcacgcacgtaaggaacgcccgttgggttatttctggtcgtgacaagttggtatcagagcccccttgaccctaggacgagctttagatcccaagccttagcaatattttcgaaataaaattcctttcttatttgtgaaaatcctctagtctctctctgtcccgctgcttcatttatcgtcaaaatctgatctttaaaatgttgctattctcttttgtttttgtttgtagatggccggcagcatcaaccatcgtggtttggacctgactggcttcgttttggagctacggggcatgtgcgttgtcctggggtatccgcctggagtggactaccaggccaggccgcttccggagcaggagggtgacgatgcagagccccacgctgcgtgggaggttactgcagtgatcctcactggctctcccgagcggacttcgctggcagtcaccgcgggtggagattccttccccgccgcttgccagaacgccgctctcctcgccatcggcactcttcaccagcgctacccggacgagttgcagcactcgccctaccgctaccaccctcgctgcggaggagcccgcgacttcgccaccttccgggatgctagctcggaggatgacgctaccatcgtgcacctggcgcgcatggtggaggcgtacgacgcggctcgtatcgacttccatcagatggtgcgccgtgggatggtcgagaacaacatgaagatcctggagctacgtcaggagaatctgcagctgaagaaggacctagacgcaggggaggcgcagctgtgtcagctcaagatcgcctagggagaggtctgtcgccccaagcgctgccgcgtctgccgcagcctgaagatcaccgcccgcaagagtacctccaggcccgagcttgttcgtcagtccttggcatggacctgcttcgtcgagacccctcgtgacgagcccgcgcccttggtttctcaggatgagggagcctctggcgttggtagcacggaggatgcactgctgctcaccttccgcgctggcccgtcgcagaagtagacgagcagttagtaggcttgcgcgggtgttcttctcgtttgtttttctgctagagtcgtgtggggcatggttataccggtgtgtggtataactgtgtcggggcctgtctttattttatttgcttaagcaacttgaaccttaataaaccaatttaatagcagaaataaattcaagaattatggtagtcgtgggtggttagttttaatagtcagctctctctgtttgccggttctgtgtgggagtttc

SEQ ID NO: 40464 - DNA, 1501 bp, Oryza sativa
aactgtacaagacctattgcacaacaaaaacagtgtcctagtcatgttgcgccagaggactggcagtggttgattgataacttatggagtgatgagcaattccaggtacttgtttaattttctttacaattaatacaatatgattcataattcattattcttatgagattattatgtttttttagaaacggagcaaacataattccattaacagatcaaagcaagagatgaaatcacatgttggaacaaagtctatagtgcaaatagcacatgaactggtaaggaatattgtcattcacttatatctttaaactatatgtttgacatgtcttgtatatataaattataaggcttcttttgtatgtgatataattgcagagaaacctagtgacaggtgaatggcctagtgctatagatgtttggaaggcaacttatttgaagaatggaacatggtccgttcctaatggcgaagaaattctggtaaacaaaaatgtctgttacctacattttactgcatgagtttttttaatatggacttacatattttctttgatttgtttagaacaatctgcagacagtagctgaaacaaaccaggaaaggattgcagctgctcaaatcccaatggttgaacactttgcattagtccttggcagaaagccaaaccactcgcatggagttggtattagtgcaatcaatgagggagctcaagagaggtacagagttaatgcacaagcagaagctgcacaacagcaagccaatgaagcacatcaacaagctgctgctttgctagaagaagttcaaaaattgacagtagaaaacttgcaattaaagggcgagttgcagtctcagcgtgaagagttgaattctcagaaaagaaccgtagaggaacaaagtggtcacatggagtgtttgttggcccagaaacttgaggaaagaatgaaagcaatgtgggcacgcatgggtggcactggtggtgcttcatcttcaagtgtcccaaacaattaagtaagatttcttacgtcatacatgattactaattcaatctagtggtcattcgattaatgttatttttaaattatatgtaggaagttccaagttgacaaagactggcgtcgtggagttgctacaaagttctgtccatctaggcgagcatcctagagtccgtgtcccaagtttcatttgttgcttaggtgttcagttatcaatttagttatggtcttagttaaaatgctctttgtatgagcactttgttatcattcattaataaaggatagtttcctctagtgtgaggaacccttctgtcacaccccaatccggcaccgccgtacaatggcacctgacaggagcgtgtcgtaggaaaaacggcgtgaaccgcttcctacgaaaccgcgatctcagtaccagtcccaggacatagtgctggtacccacggtgacaaatatgaatcattgcaatccttaaaataaatagaggacttaattaccttaacttagttgcagc

SEQ ID NO: 40465 - DNA, 967 bp, Oryza sativa
gacacacacatatatatatatatatacacatatatatatatatatacacatatatatataaaattttccagctcgttattgttttttacctttttgtacttcctagcttcagtgtcttgctcctgtttatctccttttcttttccttattcttttatcccctgtaaaataaacatttactaatatcattgcagatgatcaatgtacaatgatgaaaaatactaaaaagaatagacaatgtttttttttctggtaaatatccatactacacgaaatgttattcacagctgattggttgtgctatagcttttctaaatagaaagtaaaatttgctgtaacttgctgcaaattatttagaggaaaagattagactttgtgactaattgatttacgggattgaagttagtataattacatgtaagtacctaggtttgtcaattaagggtttgtttggatcagaagtggaggctacagctacattgtatagtaccactatataaatcaatgtattttgaataacttttaaaaagtttaattgaaaacagttagtttggaatggtggtcatcgtaatatactatgagttaatttattaggagtacacgaaagcttgacttgttagcaaagatcaaacagaaatcaaaaggaacacatccatatgtcctctctactaagttgtcattggagatttaggtgacagaataagacgtggctggacgtaagatttctttccgattgcttccgttcccagtgacttatattataacaaatagtctaatactcctatatagtgtcagagaagtaacagatatagtatatcttgttgtccatcgtgcacatcatcaggatcagggcaagttgcagtaggctggtgttgatgttctttgattcggtataaatcaatcgatcaaaatgcaaaatactactggatctgggctaatttgggggctttcgtgatcgtgcaaggtaa

SEQ ID NO: 40466 - DNA, 644 bp, Oryza sativa
aggtgcggggagggtttaaatagggttggaagggggagagagcagccggcgagatttgcgggggcaaatccacccgtttgaacgcaagagagagagggaaaaatggggggaaagggagaggggatcacggggagtatttccccccactttattgcacgcggggacggcgggatgcggcggatttggcggcggcggcgtcgcttggcgcgggcggagcggcgggagtgggggaggacggggatgatgggtgggccccacccgtcagcgagggtggcgggtgggcccgcccgtcagcggcgcgcgcgcggggagggaggccgaatgggccgcgggggagaggagagagagaggggggagagagatgggccgggccggcccaaggaagggaagggggacttttagggtttttctttttataaaactttttcaactttgtttatttcttaataattattatttgtgctctgaaaattccactaaaatttatttacgcattttaggcttttaggaaatatacaaaaatcctctaagccttgtttgacttttactttgcacattttattttttggaggctttcacacggattttaattattctaggcgtaatttaaaggatatattttagggtcgttttgggcgtgacac

SEQ ID NO: 40467 - DNA, 349 bp, Oryza sativa
ttgtcaattactgccaatattggcataggtgggtgcgatgtttttcaccggaatgaaaaagttcaacaagcaccaaaacatgatttttggacatattggagtgtgttgggtgcattcgtggcaaaaagtcacttcgtgattcgcgcggggaacttttgtcaattaatgccaatattgccatatattggcacacgtgttggcgatgcttttcaccggaatgaaaaagttcaaaaagcaccaaaacatgatttttggacatattggagtgtggttggtgcattcgtggaaaaaaatcacttcgtgattcgcgcggcgaacttttgtcaatcactgccaatattgccatagg

SEQ ID NO: 40468 - DNA, 1501 bp, Oryza sativa
ctttgctatcttgcaaaaggatttctagatcctgatattaaatctacatggcagtccaattcatgatttgcatattccaattcatgccatgaatatggttcttgtatcaatcttgtagtgcggtgtatttgcaactttcaagaagtcttatcctccttaaacatgtcctgggtactttttgacagcctaaactctatttgctgggttattctagataagtatttgttttttttggtactttctaggttccatagttccacccatgcaacaaattgaatgctatagctgtcattgtggggctgtgggcacctaaacttaatttctgatttactgtcatcccatgacccctctatcaacctccagaatatgttactgtggcctttgctacttaagtgcattttataatttctaaattgaatgtctcaggaaaatgtctggaacatgccaggtgttatggttttcattgtgcaacacataattggtttaatagtttctaaatatgattgtgcacttaaccatctgttgattcaacttgccagcataaatagttccaactgaaacgcagtttatgctcaaaacgaatgaccaaacatggggtgaattcttttgtcgaactatcctatcttggtctacaggtaccaaatccttaccattgctcatgtgatatgcccccatcagcatacatttaaaccagcatgatgtttaattaattaatcactattgttattgttgatgaatctattgatgatgtgcaggctgtttataactcaaaccggtgcgctaaacttgtgaagtaaaactgcttggactactaacagctaaagtttcaaaggcatcctgcaaaaggacctattggtctgaactttgaagggtatttttcaaacatttttgttcgtttgttcacaacttcacatgaatatacccaagttctttttgcatgtagtatttggatgttacaagcatgtccacattttcggtgctgcaaacaaccagacagggtccctgtggttgctggtgttgtacagaattgctgaacacatcatttactttgctggctgtcaatctgtcatgtatttggatatacacccgtatatctagataaagttagaaattacttggaagaaagcactaacttagtactcgtatatgccatttgtgacagccttttttttctttcacgggaaacggggactttgtatttttattattatactcctgttctgtaccgtgtacagtgcattgtataagaggacttttaaatacagccgattcggctgtgctgtgctccttaaataattcattaattaattcattgttgtattcgctggtactactagctgccatcttttgaattggcatcttgtacactgctagtactccactactattgcctgttgcttgtaaccattgcctaccacacatacatcttctttacatctgtgtcttcttcaacaaccagacctccattactccacaaagctgctttctccccctccttccc

SEQ ID NO: 40469 - DNA, 1501 bp, Oryza sativa
actgaacctcggcaaccacttcgaaataaactggatcaccggaactgacggaatctaaacgacaaacaaagcacacaggtgatacaagcaataagtctactgaaatagcaaaataaacaaattttaatggattctatactttttaacggattcactgcaatttgaatggattaaaacggagctcggattattaagttctgaattttaaaagatgagctgcgttattactaataaccgaaaaaaccttagtcaattattacacattattgcccatagataaatagatcaatggaattatacctccggtaagaaagcctcaagaattagtgactcaacgagtcaacttatcgtgccatggggccatcccaacggtcaaccgaaccggcgaacggaatcggcggcttggaatgacaacaaaaaactagacacagtttacggtagagactcggtacggcaaacgataggccggtatgagtttagggctgcacctaaggctttgctattcggctaccgagctacgacacaacggcaaactacgacggcgacgcgggagagtggcggcggcgcctagaacaacggcggcggcggctcggctcggcttgggatcggctagcggcagcgacggcggcggctaaggcggcggcgtggcaacaggaggtggcgcggcagcggcggcaaggcgacgacagcgccagggcacggacggcagcggcggctcgggctaaacaactacggtttccacaatgacgctaaaaagaaacaacacctaaaacagagaattacggataggttcctcaccaaactgaggcgatcggcgagaaggaaacgacgacgatggtccaacggcaacacgcgaaggcgacaacgacgttggatcaaaacctacgacgaaaacaaataagaaatggataggtaatggcgatagccatgacacggagatggtgaaacggattaccagtgatgcaagggcgacgacggcgacaatggggaggcggcggctacaggaggtggctggcggctagagctaggactccaacaaaatgaagaacagggaaaaacgaaggggtatggtggcttatataggggtggagataaaataggtggggccggaggggagaggaggggagtcggcaggggagagggagaggagaccgactcggtatggcagaggggaggcacgcgcggccgaggtggaggggcggcggccgagtgggagagggggaggggaggaaaaaaattggagaaggagaataggattaggactttcccaaaaaggaaaacaaatgcggtgtcgttttaggaaaagaacgaaaacggtcccgcgaacgataacggacatggcgaaccatgcaaaacgaaaccgtggacagagaggggagtgaatcgggcacgattcacgaccaaaggcggggaaaaactattattacttcaaaacttgacaaatttttaattaaccacattaactccgatgctctttaacttcctctttaagtcctgttag

SEQ ID NO: 40470 - DNA, 1501 bp, Oryza sativa
tgcatttccaagaagatcttcgattccactaatcttgataagaagctgctttaccccttccctagttggtttaactcaaggtatgatgttatgatgttgttttgtgtttttttgttgttttgaatttggttagcattgattaacaggggagctgatgattgtttttgttttttctagggagactaggaagaagaattatctagatcttacatcttgggttagtttgcttgagacgtatgctaatgagaggagtgctagccctgaagctgatggtgaggcatatgatgtgggtcttcttgatgacaagactggagacgccagtgctgatcttgactatgaaaagagtgcctgctctggagagacaagtgatgctgcctttgatgaagagagtgctagccctggagacgctaccaaagaggctgatattgatgaaccgattgctatcctggggacgccaatggtggcaagatctgtagagtggaggcctatggcttgagttcttcagtgaaggaaaagtacttggataaatgcttcctaacgttgtcatatattcctgatattgtcatgtgtcatctaggtatcatctaggaaagtacttggataaatgcttcctaacgttgtcatatattcctgatattgtcatgtctcatctaggagaagttcagaagcccctgaggcaatctaacatcggctacttatgccgtgataaaagactttgcatggaagtattatctatttcagaatcttgtatgcaatcaaacaactactacttattatggtcttatggataccttgcttgcttatcttatctacagctacggtcattgtttcgttatccaaaaatgtttacagctgaagccgcttgaatggccatgctgctactgcgctgtgaacgtggcgtggcacatgttttgtaaaacatgaccatatggagtgggctatccaggtttgcaaaaccaccggtaaccgtgctcttaccgcggggtactgtggtaaccttcttaaattcaaataaatttaaaaagtaatttgaaattttgataaattttacatagttttgtacgttttgccgcagctaccgtgtagtaaccgtgggaaaccctggtgctgcccccgctgcaccgtacattcccgttcgtcctcaccgtcgcaatttcttcttcgcagcctcagccacctcggtttggtgagcgcggccgtctgttaatagccccccgcaggaaggacatcgtgttagtgcactcttcattcaggattggggaaataaggtagaaagatgaatgtgcaattctggcactttggggatctgtcacaggactaaaattgaatccaaattaagtagggtgttaatcgtattggacttggcgtccggaagatgtttggctgtgttctttggacaattttcgtaacatcactttctcgattttctatgcacgtttttgcaaactgttaaacgttgtgttttttttaaaaaatatttctatagaaaagttgctttaaa

SEQ ID NO: 40471 - DNA, 1501 bp, Oryza sativa; identical to SEQ ID NO: 27057

SEQ ID NO: 40472 - DNA, 495 bp, Oryza sativa
  unsure (1)..(495): unsure at all n locations
tgatccatgagngctgactatcgcagtaccncatcaggagtgtgttgggtgcgttcgtggcaaaatatcacttcgtgattcgcgcggcgaacttttgtctattactgccattattggtataggtgggtgcgatgtttttcaccggaatgaaaaagttcaaaaagcaccaaaacatgatttttgaacatattggagtgtgttgggtgcattcgtggtaaaaaatcactccgtgattcgcgcggcgaacttttgtcaattaatgccaatactgccatatattggcacacgtgggtgcgatgtttttcaccggaatgaaaaagtttgaaaagcaccaaaacatgatttttggacatattggagtgtggttggtgcattcgtggtaaaaaatcacttcgtgattcgcgcggcgaactttttgtaattattgccaatattgccaataggtgggtgcgatgttttagactggaatgaaaaagttcaaaaaacaccaaaaca

SEQ ID NO: 40473 - DNA, 422 bp, Oryza sativa
ggaccaaggttgcaaggggtaagattaatgttttattttattactcctagttaacagttctgctaaatagtgccaccattttattttttcctttcgagtaaattacgtctacggtacataaaggaggtgggtgcgatctagcgcaaaaacttgagaaagagcatataagtgcaataacttggctagtgcgtgcattttggacttttggttaaaaggtctatattctacaccatactttttacgccatataaaaaaagccgccactcaaaccatctcgaaaaggatctacaagtattatatgttgctttcaattggtaagttataataataaaataatctgtcaatttaaaaccgaaagatatatgattatcaaaagtaaatgcatgactaatcaacatattcattatcgcgggttatgaaca

SEQ ID NO: 40474 - DNA, 273 bp, Oryza sativa
aaaaaatccatttcgtgattcgcgcggcggaactttggtcaattaatgtcaatattgccatatattggcacacgtggggcgatgtttttcaccgaataaaaagttcaaaaagccccaaacatatttttgacatattgaagtgtgttgggtgcgttcgtggcaaaaatcacttcgtgattcgcgcgacgaacttttgtaaattaatgccaatattgccataggtgggtgcgatgttttagactggaatgaaaaagttcaaaaaacaccaaaaca

SEQ ID NO: 40475 - DNA, 1501 bp, Oryza sativa
ttacatacggaatctgtaatttgttttgttattagtctatgtttaatacttcaaatgtgtgtccgtatatttaaaaaaatattttggcacatgaactaaacacggcctaaattctattatatttgtaaacggagggagtatttattacaatggaatagaaaaaaaaaccacatacacataacaacgtgaagcctcaagttaattctctacattctagctcgttcaaccaaacagaattttagttttgttacttcatatagaacgtgttccacgaacctgaaacgtggttcctaattaattccagtttcgaattgcttgatgaactatacgacccttccgaggaaagcttgtgatccaagcaggtagtgctctgcccatatgcatggtcttctacaacgttctaatgagtggcgatttgacttacttggtgaaggtcattttccttggtaagcagtgcatatatcctgatttaacaatgctgtcactcaagttaaactggccaccgaatacaagcaagcgcactagtttcctcaattcgagactccataagctgcacttagttaaacatgtactacctccgtcccaaaataattgcagccgtggaaatacgtgtccaacgtttgaccgtccgtcttatttgaaaaatttataattttttttaaaaaaattagccacacataaagtactattcatattttatcatctaataataataaaaataataattataaaaaaatttcaaataagacgaacagtcaaacgttggagatgaatagtgcaaaactgcacttattttgggacggagggagtattatatttatcataaaattttaaactccggtttgagcaaccccggttagattttctatggcaccgaaaacgagaaagatcattagtggtgactaatgaactattaaatattttaaacataaaaaatagatctattttattttcttaatatataagagttttcataaaacacatccgttaacagtttgaaaaatgtgctaacgaaactttgaattgctcaaaacaactcagccttacacacagtaccaacaacggtattattgcttcctaacaacttgggtatgtcctgtgaattgcagcaaatgaaatatacgtccacctataccttcagccattggctggtttaacttgagtgacatgttagtgcagtacattggaaatgtcactaatatccattacttgtggtccgcaatccttcaaaaactaaaaaagcacaatgtttcaacttatgtgtttgctgataggctgtttatgcacggccaagcatctttgtgagtgagaccactagtttccactaatggattgatggcgaggctgctgtcaggttggtcagatacagttcgttatcagtccagtttgtgttgttatattcaggagttcgttttgcttccttataccaagtcactatgctgtctatgcacatggagtccacgtcactctttgcaaataaaaatgctcttaagttcaatag

SEQ ID NO: 40476 - DNA, 1501 bp, Oryza sativa
gtctgagggaggtggacatggagcgattccgttgggacatcccaacgggataccggtatatagcagcccttttttttttataatgataatccatcaagtgatgatgtagctttgactacgcgttaattgaaagagcgcgattatttatctgtttagataactagaaaggaagcccgcgcatatgcgcgggcatctaatttaatgtgcttgaaatattactctacacatatgaatataatgtttgtatatgcgtgattgttcctgattctattggcaacctgtttttttgtcaatattttgtttgtgaatattttgaatgctaattatccttgcaacacaatctttaattataggaaagtattatgtcgcaaaaatgaagttggttcctatgaattgtcatctaaactatatgttatttttaatacatatcaaatcttcgttttggagttctaaactttaagaaatttgtgttcttaagaatagttatagaactttaagcaaaaaaaattcaaatgatttcttcaatttatattgggctttggattcaacaaaatttgtttaaatttagcccaaattttgtctgaattccagttatcctttctgtttctttgggaatattggaggtctatgttctatcaattgttcttgaaatgtttttgatctcttaaaatttggatgtaaacataactatgttgagtgtacaacttggtatgggataaatgtgtcctttctaatgcaacgagaatatatatatatacaccctaatctccagttgaatcaagagcagcatcaatattaagatagagatctcgtccagcaaagtatatagggtcgcacataagatcatttactccagataaactgaactgaatagctccagtagcatcaaatataaacagatagatgattcagtttataatgaataaactaacgaaacctgtacataaactccacccatgcagcaagaatgatagccgatcagagcaagaagacttcgtcagaaatcagaacatgcctaggaccaaattaaccaacgcagcaacgatggtggcaaaacgtatggaatcgccatctccttcctgacctaggcggtggcggcggcacaacacagaggaaaactaaaaaccaatctcctaatacaaggaacatggcatatataggtggcacaaaggcctagccagctgaacggactaaagcccaacttggactcctacataccgatccaaataacagaaaaaaaaaccttattaatgtaaaaccctgaatacttggtaatcctgccgctaagcatggaagaaaagcatccacatgcatgcgtacatgcagacgttgtgggagaggatttcgtttttttgtgggtcctcatctcctctcctcgcaccacgtggcagcttgagagcgcttttaggatgttacatgtcagcttgagagcgattttagaaaagttaatggacttttagtatataatagatagatagatagatagatagatagatagata

SEQ ID NO: 40477 - DNA, 315 bp, Oryza sativa
ttagtaatatactgtgatcaggatcctgattttctttatcaggaaaatgatgaaaaagaaagcactgactatggctgcattcaaacaaagggcaaaaagaagcgttctacctgataacttctccaatcaagacagcctacttttgctatctatagtccaagatggacacttttgttatcctctcatctactagccaaattacttttggtgtatctagctctgactaagaacctagactgatctactagccagttactctaatacaaagttgacatggagctttattaaaatctttcattatttaagctctagatc

SEQ ID NO: 40478 - DNA, 1501 bp, Oryza sativa
atcaccaacatgtataaatgattaaatgtactccgaacaaatgaaatctttcacctttgctcaactgcacttccattgggggaggaaatgtaggaagaataattttcaatggttacaggataaaagaaaccaatgtatcaagtcctaatcatcgtctgtccttgcctaatgacgtctttgccaccgatttagcactatcattttgctgtacctgacgcgaacttcgtatatctaatattatatttcatcgacttcaaaatttagagttcccatttgctcctctaccgatcggtgatccgaactatctagaaatgtagaaagtgcagtttgaagacatccagtataacctcactgtatctagcgaagatattctgagttgagaatgcttctacctgaccaactgttgaaaaatgcgagctttcaacaagagggcaataattatcagccaaatcacacagcagactttccctagttactcgtatttgtcatgcatatggaagtattccctccgtttttaaatatttgatgccgttgactttttaaaatatatttgaccatttcctatcatttaattcattgttatatatatatatatatagacacacacatacatatatatatacatatacatatatatatatatatatatacatatatatatatacacatatacatatatatatatatacatatatatatatatacatgtatatacatatatattacatattccacaaaagttcttgaataagacgaacgatcaaatatgtgctaaaaagtcaatggtgtcaaatatttagaaacggagggagttgaactagtttcaacagtcagacgaaaaacaaattgtgaaccattttcctgcacaagctaccttttccttgaattgagaggaagagttttacgcaacttgtcaacagtggcttttcacggtggaacctataaaattcaaaattttctaggcatgacgttatattttgtaaaaggaacaaaagcaccgggcagactttttgagtgtacactggcaagaaaaaagaacttcacttcgtttcgtcagaatcataagaaacaaaggcagcaccgcagcacatcaaacatttcctgccattcaaatgcacaacatatgatccatattattactgctagctaacatccagagtcttagtattctcatagccacacattagtcctactcctacttaaatttcataatagcaacaaaacatttggacaaagcaaagtgcggttgggcagaggctagtatcaatcatagaacaagctagcgtctaattaaaatgtttttggtgatcatccgcaccgcccgttctattctaaaccacaattgaagctgacgaattaagttgccagcacgacgccatgtgtataaaaggggcctaagctgaacgagcttcgccacatcagtaatcgccaagctctctttcaagcgtagagacctctccacacttatcagagtaataaggaaaaaaatatagattaaaaa

SEQ ID NO: 40479 - DNA, 1501 bp, Oryza sativa
gtcttaccgtgcaagtatatacgtaaagttattaaaaataataagtatattcgcaattctttttcctaggctgctagctacccttcatccttcattcctgcaactgcctttccgcttgtcgtcgtgccaagttcctggattaaccggtttaaccctatatatgattaatggcaaataaagaagggttaattggatccatgccattacaattgtgtcaaattagagaaattccattacaaatcacctatttcgaagcgtgccatccgtattgatgtgaatcttgatccatgccataatttggtcgtctcccgtgtttggacgcgtagtatcggatacgtatatccgtatggacagaaatgcccctttcagacacgctctaaatctggcctgtttcagctcgacccgttggcttgctcactctattcccagtcgaaaccctagccccatccattccccactccattcctccctattcgcgctccagatctggctggcggcggcatttgtggcggcggtgaaggcgaggattcaagcgggagagatgcgccgctagtaggccttggcagaggaagtgtgatggcgacaaccacccccccgcggacccctgggcgagatggcgaggagatggatgtaggcaaatccaatccaacaatctgttcgaggccgtgagtatccctaaccctaaatcaattgaaagctgtaatgttgggaggcaaagcatcttttttctgcatcatgcatctttggcttgcattattcttcatgtgtggtgatttgtttggtaggaactggttttcggtagacgttagggttcaaggctatgtgacaatagatgctgctggtaggaaaatttacacaaaagggtcaactcatcaatgggttgtggaatcagatagctttaacattgagtttgtgttgagtagcctaagtgttgagttaacttgttgcccaaattagtctcctgccatatggtattttcataagttaattggtgaggatgtgagactgttggaggatggccagattccagagttgtttgaaatgtatgtagaagagagccactttgagcttattgtatccatcctggatgctgcaaagggtgtgccatttgctataaatgctttaaatcctatatgtgtggtgcctcctgaaatccctgctgaaatccatcctgaaatccctcctcaattccctgctgacatccctcatgaaatccctgctgacatccctactgttggaggttctgaccatcctacaacagaggaagcagaagttagagaggcagatatctttgacaatgaagaggagtatattggtgttgatgatgagcacatatatgttcctgcatctaaacagcaaggtcaacctggatctgaacctcagggggctgcagctactgctcagagtggagagaatggtgctagtgctagtgctatggcagctcctgaggcacagattacagatcatgatcctcagatttataacatcattcatgaccctg

SEQ ID NO: 40480 - DNA, 1501 bp, Oryza sativa
tggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagctatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactataattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaaaatttgataactattgatatttatacaaaaatatagagcacagtataaaatcgccctcccccagggcggcaagggggccgcctgcaaaattccatgccccctcgccgcccatttgcaggcggcccccccacagtacaaaatcgccctagcggagagcggcaagggggccgcctgcaaaattccatgcccccctcgccgcccatttgcaggcggccccccgcacagtataaactcgccctagcggagggcggcaagagggccgcctgcaaatttcgttgacggccgtcgcccgagagggcgatttttcccagagggcggtaggcgactacttccgtcaattttcaaaatgaaaaattatttttgtaaaacttttaataaaaaaaattataaataaaaaaaattctcccgtctcctaccttggttctccggcggcgcctcccccaccaccgccgtcgctcatccgtgactgactcgaggtactttccttctcctactcttgccctgatacgattgattgttggtggttgattcttttgtcggttggtaagaggtctattcatggcaatgggacttcgattcggtgccgttgttctctcgccgattccgatggcgaaccgggtcgatcgatctgcttatag

SEQ ID NO: 40481 - DNA, 1501 bp, Oryza sativa
caccataccccttcgtttttccctgttcttcattttgttggagtcctagctctagccgccagccacctcctgtagccgccgcctccccattgtcgccgtcgtcgcccttgcatcactggtaatccgtttcaccatctccgtgtcatggctatcgccattacctatccatttcttatttgttttcgtcgtaggttttgatccaacgtcgttgtcgccttcgcgtgttgccgttggaccatcgtcgtcgtttccttctcgccgatcgcctcagtttggtgaggaacctatccgtaattctctgttttaggtgttgtttctttttagcgtcattgtggaaaccgtagttgtttagcccgagccgccgctgccgtccgtgccctggcgctgtcgtcgccttgccgccgctgccgcgccacctcctgttgccacgccgccgccttagccgccgccgtcgctgccgctagccgatcccaagccgagccgagccgccgccgccgttgttctaggcgccgccgccactctcccgcgtcgccgtcgtagtttgccgttgtgtcgtagctcggtagccgaatagcaaagccttaggtgcagccctaaactcataccggcctatcgtttgccgtaccgagtctctaccgtaaactgtgtctagttttttgttgtcattccaagccgccgattccgttcgccggttcggttgaccgttgggatggccccatggcacgataagttgactcgttgagtcactaattcttgaggctttcttaccggaggtataattccattgatctatttatctatgggcaataatgtgtaataattgactaaggttttttcggttattagtaataacgcagctcatcttttaaaattcagaacttaataatccgagctccgttttaatccattcaaattgcagtgaatccgttaaaaagtatagaatccattaaaatttgtttattttgctatttcagtagacttattgcttgtatcacctgtgtgctttgtttgtcgtttagattccgtcagttccggtgatccagtttatttcgaagtggttgccgaggttcagtcagctcaagagcaaggcaagtcatacatacatcattgattatattgagcctattttacaaaatcccctgctttctattaaaattgcattgttttagaatgtcatgtggtatggatgccttttattctcagcctgatgaatatcttgtgcctttgataacttgggttatatttgatttattataatttagtccttaattactttatgtacaccaccatggttatggtttaattaaattaaaatttgctttaatggtgggtcgtgggtacatgcatgattttctggaagtcgtgcccatgacaattaaggaccggtttctcgggaatccctagaagatatactcgtactcaccacaggccagatgagctccaggctaaatctagagtataacttaaactagataacataccatggcaagggtagaggcga

SEQ ID NO: 40482 - DNA, 1501 bp, Oryza sativa
agagagaagagcagcgggctacagatctgtagccagctgcagcacagactccaagatacactgtgtgtatgacatgtgggaccatatattaatagtatagcaagcaactattatatgaattgactatttgattagctatagatgaattggagctagtagtgggctgtcctattagacttgctctcatgggatcatcaaagcgttcttttagatgatcaacataccggatttaggtacagaagtttttttctttttggtagaggaggataaggccattcagcgagaaacgtatgttgggccacttacatcctgccaccgtcacttgcctggactggagtaactgggctaaccggctccctttatggccatttttagggctcggattaaggaataagttcacctagcgtccctcaaattgtacgccaagtctgtttgagatgccctaaccgtaatatcataaatgtatactactaaactatgtaagactgtccaaaaaaggtcccaagacgtataatatgcctggtttcgttgacatggcattctagttagcaataaataaataaataaataaatatgtgaggtccacatgtacgtgagaaggaaaaaaatgatgtccacatgccagcatcatcttattcctttctcttttctttcttcctttttctcttttttcctctctttcgttcttcccacatagcggcagcagcagtgggcggccagagcagacaaagcggagtattaattgtacacttgatacacttgatattctaaaatgatttaaaatgtgtatatagtgtacaggatgggatggaatcaattttgagagtgttgcaggcctagttgcagatgcatggttactaataaatgaatagtaatgactttttttaaacgtgcaaatttataatgggatggatccaattgacccatatatctatcggttggaactgacaattggaggcttggtgatgtgccgaatcttgccggccaaatcacatttggctgtcacaggatcagcaaatccgattttgagggctgaaggtgtgtgataacccggtttttacaagtcgaagggcgagatccagatttccggtattacggttcagcgaattaaatcgacggaaaaataaaggatgtgaagtggacttattccttgcgtggccttctccaccacctttcttctttgggcccagcctgccgcgaaagaccacatctctaggtcaggcccaaattttgaggataaatacacacgggagaggcttcccgtctccgaattttttttattaaaagttttacaaaaataattttccattttgaaaattaacggaagtagtcgcctaccgccctctgggaggacgatttttaaaaatcgccctctcagagggcggctaaaatgacgtggcagacggccgttcgctctcgggcgacggccgtcaacgaaatttgcaggcggcccccttgccgccctccgctaggacgattttatactgtgcagggggccgcc

SEQ ID NO: 40483 - DNA, 1501 bp, Oryza sativa
cattgtcatctgctccggcagcataaagcactgtcgagtagacttgaaggaattcttctgggtcggtgctcccatcatacttttcaatagctccgggtcggaatctctcaggccatcggacatcacgtagggaacgacttaaagccctacacccagcactgggagcggtgggttgtcggtggtcgcgtgaccttctggatgtctgtctgacgatgaagaggacgcggatgatgatgatgatgacgatgggtcgcttggttccggcgtacgattacgaggatgacgacctggatctcgggaatcctgtcgtcgtctctcgctgttgtcttgtcacatcttgatttttgtttcaggatttataaattatttaataaattaataatataatttatattaaatgttctttaatttacaagtgaagttaaatgtgggaaataaaatttcttaaatctaaagcatggatggatttaatttttattaaattctccatgattaagtcaactctctgaaatattctcggatttttcggagctcaattcctaaatgatacaaagaacagttcagtaattatttgatcattaatgatctaatgatatttgttaagagcttttcttgtttaaaatccttaaattataaattgttgtttaaaaggaataattagaaaagatcttaaaagcctaaaagagaagatctaattttaatttgctaaatctcaacataaaattgggctagataaaatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagtcggcccaaaaccgctccctcttctcctcggcccagtccggcccagtccgatgagccgccgctcttctctctcggtgtcgctgacaggcgggacccacctgtcagggtcgtcgtcctcctcgcgccgccggcgccgcccgaaaccctagcgcaagccgccgccgtctccttccaaattcggccgatcctttccttctccggccgaatcttttgaggggaaatgatctcctcgatctcctcttccttttctcttatagaaactccggtcaatttcgtttggaaatcgacggacttgagttcgattcggatcgatctctctcctccgaacccttgctttcctccgccgtcgctgaagaccgccggagcaccgtcgccgccgtcgacccgatcttctccggcgctttttcctcgtcgccggcgccgtccgttgcttctccgccgcttctttggtcaccggtgagttcgccgcgtcgcgctctacgtcctggtgctcttcgtttgcgccgccgcgccgtcgttcaccggcgagcatgcgttgccgagccaccgccggtgctgacgtcatcgctgacgtcgttgctgacgtcatcgtcgccgtctgccgtgagc

SEQ ID NO: 40484 - DNA, 1501 bp, Oryza sativa
atagaaaaaattgaagtaatagtttcagggtatatgatccttttccattgttcataaaaataattatgattttattcagtatcctattatacgtctttgtatcattaaatgattatgttggatgatacactactggagaaacccacaatagtcttggtttgcaaccccctttagtcccgggttacaaatcgagactaaagatgtcgatctttagtccctgttgttcctgttgaaataaccgggactaaagatttatctttagttccggttggttttttccattgtttgcatattgatttcgaaccaaactcaacaataaaatcattcacattcacataaacatcacaaaatcatcaacaaattcacaaatcgaatgaacatactcaaattgacatcacaaattcacaattcgcatcacaaatttacaaatccaaagacatcacaaatcaacaaattcagagataaatcaacaaataaataaataaatcatccactcgtcgacgccagagctaatgccgcgcgggctgctgccgcccccgcgcaggccgccttcgctcgctcctcgctactcccgcaaggataagagagaggaaagagaaagagaggagagagaggaggaaattaaagatgaggaaaagggaggaggagtggaggagaggataagtgtggaggagaggatatacagggggacccataggttcccggtatgcactggcatacccataagtttgaaaattttgctaggatcagctctgcaccaggaagtcaggaactatgcaggtgtatgcagtatgcagtaggctgcttgctcaatgctcctactgtactactagtagacttcctttctctctctcaatgcacgagctccaaagcaagcaagctagctagtactgtagtacgtacttcagctgtcagctactcagctgtcaagctactcagctgccaagctactcctgccaatgctttgatttggtttgaccttttatatatatctattgttaggttaatctactgtttgtattattctcctaaccatctattgcatcaagtctcgtagtactactttactaacagatttgaatcatctccaattcaccaattgtagcttaattttgaatatattaattgactttgagaaatcgacatcctaattgttttaaagaagattttgcatgatttgaatttagagtttagatagaatcaatatattgacattgttatcaattgaaaagatcgttttgatgaagaaaccaattaaattagttggttgtaatttctattttcattcaatacatatgagatgatggtttaatttctatagtaactttgcatgtataatttgatattgggattgcctttatttgtatcatgtaacttagatttccaattctacttatattattgtatgagagatatgtatatatgtattagtgcatacccagtgtagcttttctgggtccgccactgattatatataaagcaacaaaagatagtaggggcc

SEQ ID NO: 40485 - DNA, 1501 bp, Oryza sativa
aatgaagatgaacggtagagatgaggctatatcaaattaccgtggtgcatttacggctgtgatcgctttgctgtactatttaccgtttctgtttgtcgtcgcctgcgcgtgacgctgcttttactctgcttcctctgtctcactcgctgctctgtaaaaaaaaaactgagatgcctgggagtatataacccggtgtgatgaatggaaaagctatcgaagatcattaaccctagtacttagcttagaaccctagtttttcttgtcttgcggcggctacaaatctgagagagagtgtgttcgtcaattccatttcgggggtgttttggtgtggttctgacaagggtatcagagcacagctgattcttggctctcgatttgtaaggtgaaggttgggaggatctgcggattcctctcgtaaaatcccaaaagcctatacaattcgaaccggaggcgagtagaagtgagacagatcgacaagcgagggttggggaatcactttgatgtgtattccctgtaaaatctccagagctttcgacctgactcaggcggcggtagacctgcgacgacgagatcaaaaaggggagagggtgaatcttggagataaccctcaagccgaatttcgttgtcagtgaacatgccggctcgcaccaggtccgttaacagtttggatagtgtggatggatttgacgctagagctgagatcctgcagcttaggcgggagatgacagatctgagtaatctgagaggtgagatgggagaaatcaaggaccttttgaagagtatttgcacagctctacctggatttcactctgctggtgcgagtactagtgggacggctggtgcaggtggatctgcagggacccaggctatggctggtgcaagtgtatctgcaggagcacaggctgctactgggacaggggctttgattgcaccattagttccccctggattttcatcagtggcaccaattttatctacgggaggaatgcagtcaggagtggctctacctcaaactgctgatgagactcaggtaaactcaactaatgcaattccttccagtcagatacatgctggtatgggaagtgtttttccatcaacaagtcttccaccaatttttccaatacacatgtctggtgctgttccttctgttggacatgtgaatttttctattgagccaaacactgttaacccaaattttgcaccaatattcacctcagcaccaatattcacttcagctactagaactcaggctggtcatttacctggggggttaaatatacatggagtggagtctcaggaggatgtgggaatgaatcattatggaatagaaacaaaccagccatggaggtatccgcagatgcagccaacagccagacctcatctgaatgctacagggatacatatggcaaatggaggaggacctgtttggccagaaggacccagacatctgtttggtgggatgcctaatccatatgctgacatgacactaagaagccagagg

SEQ ID NO: 40486 - DNA, 945 bp, Oryza sativa
  unsure (1)..(945): unsure at all n locations
atttatgcaaatataaaaaaacgaagagttgtaattaaagtaatttggataataaagtaagtcacaaataaaacaaataataattctaatttttttaataagacgatggtcaaacagtgcaagaaaaatgttaaaatcacttatattaggggggagaagtntacttttgtccacagctactagtataataacacattttttttagataatggaatataacatcccagccagtataataacacatgaatagtactttataagtggcttatgttttttaatttttctaaaaaaattaaataagacggataattaaagttgaacacggaaactccagattacatttaaatagtacttctgtccacagctactagtataataacacatgaatagtactttataagtgacccatgtttttcaatttttttaaaaaattaaataagacaaatgattaaagttgaatacggagactcaagattacatttaaaatggtacggagggaataactttgccgttaaaaatctaaaaagtttgaccatgttatctgcatgtggagaggagtgacacggggtcacgggccagccgcaactgtcgggttcaaaagatgcgttcgcaagaaagcaaacagattagagtggtggccccgcatgcagtggtaacaactgatcgaaaccacggcatcccgttcaagtagctggtttagctccacggacgcatgcctattctagtgctccactgccactatctttagtagcgccgtgtcgggctcccatatataacgtccctcgccgtctccatttggatttcagcgatcgatctcgaccgcaccggccccgcatgcctgcccactgcccaaataaagcgtcgtcgatcgaccgcgcgcgatcatggcgatggtcgtcgcggggagccatcggccgccgccgccgccgcagtcgctgcggctgg

SEQ ID NO: 40487 - DNA, 1501 bp, Oryza sativa
caagtaaaagcattttgtaatagcaaaatctaaattaagaggctctcgttttagtgctaacgagaaaccataactagacacgttaactatagttctagtccatcaagcaagtagaaaatatattcctatcacctatgttgcaaataattttttttcttaaactactcatatgatctacgatccgattacatggttgtgttcgtaagaattaaatctttataacaagttctcacatgattatattttgatgaaaaattacaaattacttttataatatggttgtgtttagttcgtgtgccaattttttttacgtatacagacacacataataagtattaaacgtagattaataacaaaacaaataatagattccgcctgtaaactgcgagatgaatttattaatcataattaatccatcattagtaagtgtttactgtagcatcgcattgtcaaatcatggcgtaattagactcgaaagattcgtctcgcgatttacatgcaaactgtgcaatttgttttttttcgtctacatttaatactccatgcatgtgtccaacaaacatttgatgtgacgaaaaagatggaagtttgaaaaaataaataaatctaaacacggcctatatctaaattatttttagatttcactaaattacttgttatacatataaaagtaaattcaataaagtctaaaaataatttaagaagtaacttaaaacaaaaatgaagtaactttttcatgacattagaagtagattcgttatggaggtaaaaacatgagtctatctagaaattaaatttaatcaacacaaattatggaattggctaaaaatagtaataaaataaacagcgcacaacattatgaatatataagaagtaatttaataaaatcgaaaagtaatttatatatatgataaaagtaacttacatatataataaaagtaatttacaacaaagatatttcttttatcaaaatatagtcatgtaagatcttgttgtaaagatttaattacaacgaacacaatggtgtaatcggattatagatcagataggtaatttaaagaaaaatccataagaagaaaaaaaaaagacatgtatcatttggtgtactagtaggcaaccatgtatgagatgagtttctggttaagacaatatagcgtgcagtctctatgtaatcacgtccgtttttataacttgcttaacaggatctctatatcactacgtactcaaaaacagcaagtgcgcacttgtcgtacaaacttcaaatttatatcatcacgaacgcacgatgcaaagacaaagttgtcacgtcaattgtttcattttaggcaatggcattgccattttggaagtgcatagccgcaatccacgcctatataaaccccacaacacttgcagtatccagcaaacaaaccaagctaaacaatcacccacttctatagttagttaaagtagcaacacttaattatttgcaattaatctaattgcatatatatgatggctt

SEQ ID NO: 40488 - DNA, 1501 bp, Oryza sativa
tgaacgaaattgaagaatggtcaacactgtaactgtaagagtaaataattgatggaagaaaagctctagattttgcataaaacaaaagggtttccatttcccagatggcataagctctagattgagaattactccttctctagagagcatgaccagaaatactgacaatacaagatcagaggaaagaagaaggagaaggaatgatgaaaacatgggcagttttgtttcgaacagtatctctcttttttatagtgaagattccaaatagtatcatgttggattgttggtttagatgtaaagtccagacattatgaatttcaaaggggaaaaaaacaataagcatggctatgactttccagttgaacagagaagttctgtattcatccaggtaactgcacttcaatattttaacctaaatagttttgactcatgatttcacgagtcatgccacttttctataactgttttaccgtctccacgaagtagcgaaatgatctagaactgaattccaatataattcagacctagaactctctcttcttatgggatctctcatggcgtcaagaaaagagaaaagaactgtatggacatagccagaccaagaagatcatcaaatcagcagcaaacttgtcgggctctaagaaagtataccaagattatttctcccagaagaactagctagcacgccatccttgggcagcatcaagtatgcgtgtgcgtactactaccagccagagtcagggtgatggggggagaatcgttagcttggtcgcgtacctggcttgcgggcgcggacgcgggtggagacggcggcccacgcgcggcgcgccgggaagacgaccttcttccgccaccacgccatcaccgcgcgcaccggcgccggtatcctcgcggcggcggccagcctcgacgatcgacgtacgcgcgctcgacgatctatctcacacacctcaccggccgcgcgcgcgcgcgcgggtggctgcggcgcgggctcgctggctgctgctgatggagtagtggtgtgcgtgcgtgtttgtttgtttgcctcttggccgcgcgcgtcgcggttttgcttatatcgtcccgtttggtaaggtggttagttacgtcggctgcgcgtgtgcgactgccgagtggtctgcgttctccggccggaacatgttgcgttctggatttgcgtgctgtcgcctttttatcccgagatacgtttaagctaatttctaatctaactctggtaaaaattgatcttaatcggtgatgaaatatacaagatattctattacccatagtcaatgtgacaataaataatccattgtattataatgaaaataaattcattttacttcccctaatgaaaataaatccattttacttatccgaactaattcaatggatcagttaacccgtgaactatttttttttggctcattttacccctaaactaataaaaatcgttcactttaatgtttaaataacatttatttttttattctttatacaa

SEQ ID NO: 40489 - DNA, 375 bp, Oryza sativa
tggccccctgcctcgagctctagacaagctggtggttaaaagttgatgggcttacgcgtggacggcattatctcctattaattgtgttgtcgcgtgcgacgctggtacaagggaacccttttctaaccgcgaagaagaatctttgggtgcagatcagatgcagccgcaaatcgcaacggctcagttcataccaaaaggtctgaattattggagactgatactgctaacacttgcagggaagctgcaagcagaacagaacaagcagaacgatccacttgacagtactctactcctgctgctttcccgtttgagattagcttgcagagttccagtgtatgtgttcaagcagaatctggttcagatctgagaagaaga

SEQ ID NO: 40490 - DNA, 463 bp, Oryza sativa
ttaggtcctggatttgctttttcatttacagaccttttactgttgcatcaaatccccgtgtatgtttggtcatgtgactgtggtgtgcagtgaatatcagttaggtcacacaccaacactaatatactactcccttcatcccataatataagggattttaagtttttcttacactctttgaccactcattttatttaaaaaaattatgcaaatataaaaaacgaaaagttgtgcttaaagtactttaaataataaattaagtcaaaaaaataataattctaaatttttttaataagatgagtggtcaaactgtgcaaataaaaactcaaaatcccttagagtaccaaacggctgggcttaaatcagctcatctcagcatgcttaatttacagttgacatcagccgtctgcatctatgcatggtttaggctggactattgagtttcctccctccggtgcctaga

SEQ ID NO: 40491 - DNA, 1501 bp, Oryza sativa
ttgcgatcatcatccgatcttctcggcttgacatctctggaagttgttagtgttctgtggcagtttctaaatgagagggattgttttgcttccttgacttctgctgttttttgttccaattttgagatttatcagtgctctcaatcctgtagcaactccaacagtattgtctttccagcagaagacaaatgttatctcagatgaatgttgtattgacctggcattgatcatgtgacatcacacagttctatctaattagatttgtgccatcctgctgttgtgctggtaagaattagagatatcaaaattacttcatgtttgtacgctggcttgccaatttctttttccacatttcatgaagtttttgttccatctggtagaacattttactgcttgtagagttgcagtcctgattggtatggatttctgtaaggtcaatttcatcagagatttgtggaccctttgacaatcatcatccgatcttcgaagtttgacatctctggtagttgctagtgttctgttgcagtttctgcgtgagagggattatttttcttccataacttctgcatttcttttttctggttgcgttttgaggttcggtagagttcttcagtctggtagtatctttaacaggactctcttttgactaagatgaatgctgtattgacctgtgagcatgtgacgtcacacagtttctgctaattaaaattgtgccttcgtgttggtaaaaatcagagatatcaaagctaattcatgtttatatgctgcattaccaatttcctttaccacattttatgaagtttctgttccatctagtagcgcattctgttgcttggagagttgcagttctgattggtagtggacgtctcaaagtccaaagtgaaaagtctgtttttatcagaactcccgtggtctatctattggtcttctactggggaatactggaatgtgaataaactttattgtggaatgtgaatcgaatttatacaaaagtttgatgattaactttgaatgccaacagttatgatcttctttcaatacatttctttgcagatcatacaggagaattatatctgccattcgtccttagaagatgaaataaagaaactaggggtgtgttttcacgccaaaattgaaagtttggttgaaattggaacgatgtgacaaaaaagttgaaagtttgtatgtgtaggaaagttttgatgtgatgaaaaagttaaaagtttgaagaaaaagtttggaaataaactcggcctagaaagcctgctgcgttgactaatgttgtcgctgcaactctagaatttttttttttgaaaaccccggaaatattttcagatcaagatggccacggtgtgcaggatatacctgcgaaatcttttgtactcatagcgtgtatattatggcacacgtgcacgtggtttagcgttattggatcctatatacttcctccgttccaaaatataagcattttcagtatagtgctaaatcaacaatttttaac

SEQ ID NO: 40492 - DNA, 1501 bp, Oryza sativa
tgcaaatgtgatttggccggccagaaccgggacagaaccaagccaccaatttgtcagttccaaccgatcgatgatactcctatgtcgtacctcaaccgtaacctggacctgagaccacatgatcgtatcgcccacaatccaatagaaaatacacaacgctagtactccgtattacctaccgcctggcgcctggagcgcctgaacaatttcctacgcgtttcgccgcgcatgggagcagatcacgcgcgcggtgtgccggtgtgcgtccagttggcatccggccaccgtcttcaatccggtggttggggccggccggtcggccaggcgccccgggttgggttgccgctgcatgtccccgttagaacaagtataatagtaggctataagccggctaaatgctgatgtggaggagagaagagagaggagaaacgggctgtaaacttacagcaggctcggacacaagaaactctatgagagaggtaagtggaccctatattaattgtaaagagttatctattatatgggtagattgagagaagactataaaaaatcttatagccaacatatcggctatattattaaccttgatcttaggccggtggatgccctaacggctcttgccgttgccgcagtggccggaaatggaacgcagatgcgcgtcgcgttactcgctttccgcttgctgcgcgcagcgcgagaaaaaagcacacgaccagaattccacaaaaccgtgtcccactctcagtctccccaccttttgtcgtgtctccccatcttcacttgttttctcgccaaatcctacgtgagtcgctctctcgagcagtcgagcgcgcacagggcgccccgctgtcctccgcgcatcgccagcccacgcccccgcgaacctgacacgaacatgcgcctcgccactgcagcctgcactgtactacacccctcatcctcctcgatcaattcgtacacactctcccaaccacctccgtcaccctcacgcttaactcctaccccacgcccagcaaaaacatcgtctatggctgtgtttagttggggaaaaggaaatttttgggtgtcacatcagacgtttgaccggatgtcagaaggggttttcggacacgaatgaaaaaactaatttcagaactcgcctggaaaccgcgagacgaatcttttgagcctacttaagccgtcattagcacatgtgggttactgtagcacttatggctaatcatggcctaattagtctcaaaagattcgtctcgcgatttatagctaaactgtgcaattggtttttctttttgtccacatttaatgctccatgcatatgtccaaagattcgatgtgataggtgaaggggaaaatttttgagaactaaactggccctatataaaccctgcgaggcacgcaccgatcgatcactacaccttcactttctcttctcatcatctatatcacgatcgatcacaaagaggttaacagtaacacatggggttcggctcgagggagatgg

SEQ ID NO: 40493 - DNA, 213 bp, Oryza sativa
agtactccaacttatggacttctagctattccaaaagtttttgatttctgcattgaagtatagcaaaaccaagccgtcaacaaaaaagaatagtgtgaaatctacaagttcaacagcatattgaaaggaagtaatgcgacttaagtacacaaaaggcacaaaagaaacatcaagatgagccctatgaagctagatacttcatttgtttaaagg

SEQ ID NO: 40494 - DNA, 1501 bp, Oryza sativa
gggaagaagagtttaaaatcaatataggaatgcaatttagaagtaactgaaattcgaaattaaaaattagtctagagtctacatagaaatacaattagaaataataaaaattcagaaataaaaataaataatattggaagaagagcatagaatctatatagaaatacaatttatagaaaatttggaattcaaaaaaaaaagaaatactaaaaaatgagtcaatatatataatttacaaataactaaaatttgatattaaaaataattaataactaacacgtatataaaatacaatatgaatattacacattagtagttttgtaaagttattgcaaaatttaaaattatgttgtcattttaatatatttaaataatataatgagaaaacatactatatgcttttatatgagagaaaatataatgatattagccacgcaatctgcgcgggccaccatgctagttaaatataaatgaagaaaaactaattgcacagttagaggggaaatcgcgagacgaatctttaagcctaattggtccatacttagccatacgtgctacagtaacccacatgtactaatgacatattaattaggcttcaaaaatccgtctcgcggtttacatgtgagttatgaaattagtttttttattcgtgtccaaaaaccctttccgacatctgatgtgacaccaatttttttttcgtactaaacaggccggccctcagtattacgcgcacgtacgcacagagattgaagaagacagaagtctgtacggtgaacagtgtatgcacatgagcaacgctaaatgctatactgagctgcatgaaaaatactggggccgtacttctctaatctctaggattgtaagtgcatccatgtgttcagaacaattgcaggcttggcagaggcttagagctagtgatgctctactgaaacggtgaaatgtgaaaatagtattgcactctgcaatgaaatcaagacaaaatatgcagttgtgttcgtaatatgtcaacagatgtgaactaataattggagaaagcacgacaattctcggttatcgggtattccttttcttctgagagttaggccatcagaaattgggtaaaccaacctatgttaccactccatgcgaaacacagaattctgaaaaatacatggcgcagctctcccactggagtaatggacatgtgacgaacacttaatcaggtcaacttcttgcttgttttcccagctctgctcacctttagctacatactcttccatcattttctatgcctaggtcttcactagccagcccataatccaaacttctttacatcttccaagaaaccaaatatctaatgcatccatcgccgagttcgatgagatcgatctgaaagtcttttgaccctggtgctattgttctgcatatagcctgcacttgaccatggcctcactgcccctcacacacagcagtacatcactcactcactcacttcacagtttacaccaccggccggaagcca

SEQ ID NO: 40495 - DNA, 203 bp, Oryza sativa
ggtttaagagttgttaattgtttcgcattgttcgatgttagtatgtatggttagcacatgttagtatgtggaactagttcagtatttataaatgatgtgcaactggttcattatttctaacaaatgtgcatcttgttaaatactcttaataaatgtgcaactggttaaataattttaattgccttgattatttgtggaacagg

SEQ ID NO: 40496 - DNA, 164 bp, Oryza sativa
ccaattcaccagggagacgagagtacgagacgcagtctgcatgcatacataatttcgacgacctgcagatcgattaaaggcggccaatgcaagcttggcgtttgtccgcgccggcactgtttgcgttagctgctatagctaggctccgcgtgcggccgtgcaga

SEQ ID NO: 40497 - DNA, 1501 bp, Oryza sativa
gtggaagacttgttgatggaaaaacacttcccataccagcatgtatctgactggaaggaattgcattagttgagtttacctgagtctcatcagcagtttgaggtagagccactcctgactgcattcctcccgtagataaaattggtgccactgatgaaaatccagggggaactaatggtgcaatcaaagcccctgtcccagtagcagcctgtgctcctgcagatacacttgcaccagccatagcctgggtccctgcagatccacctgcaccagccgtcccactagtactcgcaccagcagagtgaaatccaggtagagctgtgcaaatactcttcaaaaggtccttgatttctcccatctcacctctcagattactcagatctgtcatctcccgcctaagctgcaggatctcagctctagcgtcaaatccatccacactatccaaactgttaacggacctggtgcgagccggcatgttcactgacaacgaaattcggcttgagggttatctccaagattcaccctctcccctttttgatctcgtcgtcgcaggtctaccgccgcctgagtcaggtcgaaagctctggagattttacagggaatacacatcaaagtgattccccaaccctcgcttgtcgatctgtctcacttctactcgcctccggttcgaattgtataggcttttgggattttacgagaggaatccgcagatcctcccaaccttcaccttacaaatcgagagccaagaatcagctgtgctctgatacccttgtcagaaccacaccaaaacacccccgaaatggaattgacgaacacactctctctcagatttgtagccgccgcaagacaagaaaaactagggttctaagctaagtactagggttaatgatcttcgatagcttttccattcatcacaccgggttatatactcccaggcatctcagttttttttttacagagcagcgagtgagacagaggaagcagagtaaaagcagcgtcacgcgcaggcgacgacaaacagaaacggtaaatagtacagcaaagcgatcacagccgtaaatgcaccacggtaatttgatatagcctcatctctaccgttcatcttcattaaacgacgtcacccaaccggtatcccactctaactctgaacttctgaatttttaactaaaacttctgaaactcttctccatttcttctctgaaatctccatctctgacaacccgctgactcgtcgccctcgttcctccacggcatcggcgcgccatccgcccgtttggccgtaacgcgctccgccaccctcgtctactcagagacggagctgtacacagtcgcggcggcgcacgcgccgccgctgcgccgagaaatccaaggagacagggtcacgtgacctacagctcggccttcgctttttgagacttcctctacccacatctctatgtgcctgcagcactttcatatggggaaagatgggcttaccatgttccatcaatagcacctaacc

SEQ ID NO: 40498 - DNA, 1501 bp, Oryza sativa
aagaacaatatcctgctagtgccacacctaacgtctcatactctgtctttgccatcaactgacaacatcatcagcggctcatgtgatggcaccaatatactactatgaaacaggctccacaaacttcagcatcaaaacatccagctatccatatcattcctggtaccatccgttcccaactagtacacggcacacaatggtacacatgaagtagtgtggcttcgtcgcccactcgctttctagctatctgaaaattgaagtctagcctccttggtgaaatactgcagggagggagaattcttgtgttgcataggaaatgtaagtagcagatgattgaatcatatgcatgtgtgcccttcattctgccctagctggctttatgtgtctttgcagtttgacacattgagataaccctttgtctttaatccgacgactgactgagcacatgggagatagtgaaatattaacacttgcttatgatctgactgacttaacacgtgagaacatcactgaccagctccaccaggtaaagccttacaattaaacaacccaagttaatgcactttgcaaatacaaaccaagaaaggcagggttttacctttccgaaagggtacgaaatccaaggacctggttgtaacaccccaaccatttgtagcttctagtgtggtgtggtttaggcctaaataacctagaattagtgtagtagtggtggttcagtattaccttggaagtttaggtgaggacatgtttattagcttttgtgctccaatcatagtaccctcgagtcgaaactaggatgaaagtgtaacagggtactgatgcagatttaagaggcagggtgttacaccggtggtttgttgatttttgtgggaattgataaattaaaaaaagggcagattttaaaaacccaattgaattcgaatgctcttgctgaatactgaaaaccaattgatctcattgattttctgaatgaaaagacagaactccttcgggagaggtctgtaaattgaatgagatctcaatcggtttaaaccgacatatttgtgcaaacaaccagtaataactttttatttgctgaaaattggaggtagtatcattttttatgttgtgacttattttatcattaaatgtatttttccatcatttatattttgtatatttatactaaatttttaaatatattcaaacattatattttgaagttaacaacatcatatatttatatgtacaatagatggtggtagttctctatggaagacagttttgatgttacgatttgtggaggacatatgtaccaaatgcccacatatcctgcatatccgactacagatataggaggtgggctagacccatacaatatataatagaatagaacacggtcgccatgttctcttgtaacccaatgcaggtagtagagcctcagccatagactaccatgtaacagactaggaatccaatgatttgtctggctaggatttactccttgtaactctgttaccta

SEQ ID NO: 40499 - DNA, 1284 bp, Oryza sativa
cgtcctcgtgacccgtaaaagaaaagcaaatgaagtaaaataaactatgattaagaaaacaaatggaaacttactccaagttgtaacatttaaatttaaattataagtataagtcaaataatgactgagacctcgaatgagtagtttatgttaatgaccatgctacaaaagttgactcttgctctgtttgcgtagctgagcttgtgaactgtctcagttcgatacacgattgataggcctagtctagtattgttgctttccactgcctgtaaatgaaaaggctcaataactgccgcttgtttagttggtgaaaagaaaatatttagttgtcacatcggacgtttgaccggatgtcggaaggggttttcggacacgaatgaaaaatctaatttcataactcacctgtaaaccgtgagacgaatcttttgagcctattaaaccgtcgttagcacaggtgggttactgttacacttatggctaatcatggactaattaggctcaaaagattcgtctcgcgatttccatacaaactgtgcaattaatttgtttttatctatatttaatactttatatatatgtccaaatatttgatatgatgtttttgggaaaaaaaatttgagaactaaactgggcctaatgggctttccccgacgccctgacggaaagggcaaaaacgtcttcggaatacagatgagatattactgcacgtttgcatgtttcagtgattcacctacatctctactgatccttttacagattattcatgttacaagtatgcacatttattccttcagccccaacaccacgcccttgcgatagaacggacgggcagcgagagggattagtaaagaataacacagtcaagaaacaggagtcatcgaataacagccatgcaggttcggaactggattgatcgaccagaaaaggttcggaaacggattaatcgaccaaaaggttcggaaacggaaatggactaatcgaccaggaaaaatgcccccgtccatccggtgattatactgatatactaatttgatatactaattttcagcccaggcagcaattcagcattgcgctgcggtaggcaagttgaaaaaaatatttataacaaatgaaaatctataaaactaaatgagcagatcaaaatctttgaaacgtggattggttggggtgcgccgggcccaagcagtagtgcaacgctagggcgacacgcgagagccccgatagcaagctaccgtggtgggccttcccccacaagaaaataaatttaatatcaaagtgaacaca

SEQ ID NO: 40500 - DNA, 1501 bp, Oryza sativa
tttaacagttcgttgtcgatcgtgaaacgataaatcagtatcgattgattattcaactgttaaagattagaccaatatatagtctcaacccaatagaagtgatccttaacaatatttactctcgtaatataaatctcaactaccaagtaattcacacattaaaaaaaatgcaaatttggaatcgacatattaccaaagtttctcatacaatagcaaatttggagttcaacgatttgccatcaacattgtctctttctataatataccgacgattttatcaattaagtgatccttaacaatatttactctcgtaatataaatctcaactaccaagtaattcacacattaaaaaaaatgcaaatttggaatcaacatattaccaaagtttctcatacaatagcaaatttggagttcaacgatttgccatcaacattgtctctttctataatataccgacgattttatcaattattctacaatatgttattgggctggaccttcttttcaaaaatacttaaaatactcctagagacatataagattaacaattgatttaattatctcaccagaagtttcaaaaaaaatatgaaaatttttatgtggcctccttatacaatatggaagtttgtatacaagtttcaagttttttctgtatacttagcttttagaaaaaatatatattgatgtgatatatgtgagagaatttgcttatacaagagcacaaaaatatcttatgtagtgtatgaaagatgatttatattaaaaatagtaataaaaagtattttatatatcatataacaaataagttatattttttataacaaataaaaatgtaataaacttgaaacttctatataaatttccacgttgtgtaagaaggccacataaaagttttcatattttttgaaacttcaaattagataaatcaattgatatattttggtaatatgatttatttgttttggaaatgcttctatgtcttttataaacttagttaaacttaaaaatgtttagttaattaggaaaagatcaaagtgacttatagtataaaacggagggagtatttgatttctttataatatataatatttactttgtccctaacatgacagataatccatcaacttttatccaccattcatctaaaaatatatttattttttgactttgtgaaattccacaagtttgaggctaatgtgaaaaagttgggatattatttgctttaaacatattatcacaatatcacaaacttatattattttataaacatatttaaatttaaatttgatattcacagttttaaaagtttgatcctaaatgtcaaacatttagatcagcttgtactcgtttgagcactaaaaggtttttgtgctagctgctccgtgtcatggcacgaaacaattgacacatgaccacctatagtgctcctcttgtgacggaaacgtaactttttggacatatgaatcgtactttgaaccagtttttaacttcttattacata

SEQ ID NO: 40501 - DNA, 186 bp, Oryza sativa
caggtgatgattgacccggtcgatctgccttttcagcgacactttcaacatgaacagctcgaagaactcctcgttttgcgaacgtaactccttgtacactacattcatagtttcatacatacatgtgcgcacggtcaggatgaactgaatttagtttatctcaactagctcgatcgattttgcaga

SEQ ID NO: 40502 - DNA, 177 bp, Oryza sativa
atagatggtagagggtggcaacgaagaaaaccagaacatcaagaataggcctgcaacaacgtgtcccgatagagagagaaatgacaatggcaagcactgttgatgaacatgaccggaggagtatacatcaaaacgcgttaccggatgaggggattcctttttccttgaacacgcagg

SEQ ID NO: 40503 - DNA, 1501 bp, Oryza sativa
taattcgtattagacactcgtgtatgtgcacttggtatttcagctatgaattcgtgtgtaccagactacgtgatccagggaaatggtactgtttacacgattgattccagttataaaaacgggggtccacagaatactacatattcagtaatgcacagcaggtcattttgtgatggatcaacattactgtcgatgctaggaatccgcaatatgaaaagggtgtagcgcatgagaactaaagtacgtgagttggatgacaaaagatttatacaagtttacgaccttatcgagaggtaatatcatactcatgatgttaagggatttgtatatatgaggtgctgtatctcttcttcctatatagttggtacccactagagaagttattactataaagtttgcaccacgttgcgccacatcatcatttattttcagccgttggattggactgcatgtttccagatgaacgatgttgatatcttgggccaacttcccatcattttttttccgttgggccagcccaccctgcacacgctccttaaattcttggaaaaaagttaatcatattgccaagaggctaatatgacaaatgatgtttttataaagttttgaacttactcagttaatcataggctaatcctgttttttacacctaacatatcttcacagcaatcaagcaaatcgaccagctcggtacgctagaataccatgtaccttgaattgggtttcctgattgaattgtacttgtttaaacgaacatttaggcgcatctctatctcaacattgtaaatctccttttcttcgtatgctgattcagtgaccaatttacatcaattttatgcacatagaaaattttatagtgtgcccactgcaacgcatggggtatgaactggttgatataatgatcttgggtatgattatgcccttgaggggcctcctacctgccttatgtaggtcgggggcaagattatagataaaacctaactaaacctggtatctatttgacaatattccggagtcagagctataggccgtatcccttaatactcagggaaacgtaatactcaaggcttaatcctttacatattctagagatataaactatctcatataatcagtcgataaactaatcgtatgggtatatgatacccgtaatctccacagtagcccatgagcccttcacactcgaaaatacggtcgcatcggctactttgataatactgtcttaaatcaatttgttaaattctatagacagccgattggtcatgtttagggtttattattctttgatatatccagtccataccgatttggtctaactccatcgactgagaccatcaacgatatgctatcggcctatcgatcgatcggctatcgatcgactgattctgcttttgtcctttcttgctgattgcaggatcaaatcagctggtatgccctagacacactcaaggctaaccttggacctgcactggagttaagcagatctcctaggccgccgtgt

SEQ ID NO: 40504 - DNA, 1501 bp, Oryza sativa
ggctaaccttggacctgcactggagttaagcagatctcctaggccgccgtgttttcacatcaacaagcttttggcacatctagtgggacaaagttttgttattcaaccatgtcgtcactgtctgacattggtaaagaaaatgttatacctgctaaggttgaagatctgtctgaagagcaaaaggcagagatggagcagaagatgcaagaactgaagaaggcatatattaattctttttctatgactcggcaagggaaagttattcaaaagtacaagtgccaaatgccgaagttagaaggagaaggagcatctggtgccaaaggagagcagaaagaagatgataataataaaaaacagttgatgactttataggatcgtcttgatttagctgtgcaccatgctctcatcaaccaatctggaatcttggtcaccacattgtcaaatttgatcaactcagtggttgatgggtcgattgctgagtagaagacaagaggaccagtatatttaccaagtggtgttttttttcccaaatatagagaaatcaagactagtcttgggaaagccgagtgcttcgatcatcttcaccacattctcccaagtgcttttaccaaatcataaggctgtgaaaggctgaaaaaattttatgagataataaagaatatatactcagatacatcgactagatacaccttattaggtgtagccctccgactatatggttagttggacaaactaagtatatagtcaaggaataaataatctaaccaaacaagtggtttttgataattatagtcaaccaagtgacttaatactaatatatagcataggcggtatgaatcctcaaacaacatgatccgagtgatatacctactacttattaaaaagtataatgtgcatagccaaaagccaactgcatctttaaaagtcacatagtaaatgatttaataaaaagcctttatgcagtgagtaaaggaattttctatggttgttcacattgtgcgcatattgccaggacaaatatgtttatgtccctataagacacacaacatcgccacagccaaaaatatatggcatttgtagtgtaaaatccaagtaaaataacactaacgaatggatttaccaactgcctgaaaatgaccaagatatattattagactacaaccataatattggtcttttagaaaaatgcacacataagtggccgaaagcaatgataaactaacatcaatcaattgctttataaaaagcaaacatcgtcttaacaaccatacgtaaagctttacttttgccaccttttaaattgtattgtgccaactactgaaaagttgtgtatcagatatataaaaagatttaaggtatatattagacacttgagcacgcatgtattgccaagagcaaaaatgcttaatccctaaaggtacatgacagaacacaactgaaaatatagtccgtgaactcttgatgggccgtggcccgataattccacggatcgataccctaa

SEQ ID NO: 40505 - DNA, 899 bp, Oryza sativa
taaataacaagattctggagggctatttaatagcctttcggatccaaacaggaccaacgtaggagtatataatatgacgttgcttgcgacatagattgggacagaatatcttatttgcgtagtaataaatattacaaatgtccacgtttttgaaagaaatccacgacgacggccgtcgcagcccaggcgatcacgggaaaattccatgacgccgcgtctccttggttggcacgaagccacactacgcaagcccacgaccaagtgggcccgagtattggtcagccccacctggtcaggctgttcacactaaacattttctagtgactggcacgtgggacccaccctgtaagtgaaagtaatataggacatgttcagattgtagtaaaaataaacctcaatctaaacagccccctagatcccgggccaaacctgctgtatccgaagcggtaggaaaaagaaataaattcgaactttttattttgacaaatttttcgaaaggacacaaattttgtgtaatttgttgatagacgtcgaataaacatatcacggctaaaatacatcctaaaaccctttaattttctagaagataccttcagctcaattgaagagataaaatattaagaaagacgagaataccataagaccacatgcttcaaacatgacattattagaataaaattttagaaattatgcaactcttaatttcatcattaacctacattatatttcatttcactccaccttaccacaataacttttgactctagggtgattctcatttttattagaatttctctcaataattcagtcgaaagtattctttaacaaattatcaattttttaaagtgtattcagcaatgagatgtttttataatgttttccagcaaattagataaatt

SEQ ID NO: 40506 - DNA, 702 bp, Oryza sativa
aaaccacacggtcaatcccctttgctgtccaccaccaatctgcatcatccaccactgatttgcaccgtccgttgtctatctgttcctcttgctaacggcagcaaccttgttggccaccgtcgattcacaccggttgccatcaatctccacatatgttgtccatttcactttcagttcctcttgctagccacagcagacccactagccaccattgattcaaactggctgctgtcagtttccgtcactatacacagtccgttctccatagatatctggattaaaacaaacttgaggtctcatgccttcccctccttgcatcttgaattcctatgttttacttatctatcgtcccagatggtagttttgatgtgattcatttattcacaccattttttgtgagactctttcttcgcactttgcatactttgtagctgatcttatcagaagtagtatatcaataaatctaaatgttgagaccatacttatgtactattcagaataaaataccagtatggcattcatgcatcaataattctgaatattgcgactgagctcattacatatgcttatctattagcataccagttgttgccaatttcttcaagctattttcgttttttttttctgtcgctaccttttccaagttattttcctactttttatctgataataactgtgttatcgtttcgtatttgatacagg

SEQ ID NO: 40507 - DNA, 336 bp, Oryza sativa
attgatcatatgtgtttgctattttactctaagtctcttgtttgccgaaacaaactttggtcgttgatagttttttttatggaaattgtattttaagtgacgatggacgtcttaaaacttaactagcttcgctcatgagggaatctcctctcaattttcactcattataagtgagaatcacctataagcatttgatatccctaaagaaaaggtatgctccctctctttcaatataaatgcaacttagcatagacatgacatatctcagaaatacgaatctagacagtattgggacaaagggaggaggagggagtattgtctataagcatgcggaca

SEQ ID NO: 40508 - DNA, 1407 bp, Oryza sativa
ctgaatgatgatacatccaaaccataaattgcttggtacataccacatactactcatttctatctgataactttcacagtggtcgaaatcagatcaaattagtgctaatcatcgaatatatctttctcataaatcccgcacaccacacctgctggcttaaacgaaaaacaactcgaaacaccatcgcatcgcatcgcatccacagagtattgaagcactctccagattacaatagccgctggacgttgcggccggagtaacgagttctaaccaagcaccaatccaacgaacaagcgcaaaggaaaaaggaagaagaaaaaaaaaagaaaactcaaattggatcggtggactggaggaagggaagcgggcggcgtgtcaaaggttttagggttggggctcgctcgggaaccaaccgtaccttcacccggaggagcttccggccgccggcgagcgtggaggagggagtccgcgtcgacgtcgaagtcggcgccgcccgtacgcgcgttgttctcacgcagcagtccgaatggacttctcactttctcagagcatccgcaggcaggcagcggccaactggttttgaacactgcggaaatggaacaagcagatcggcctcagttctttttttcccctcaaaagctttacatatatataaaaaaaaacttacaaatatttccgcacacccatacacatcattacacacgcaacagcacacttaccacctgacgaatatgttccctagcataagttcaaaacaacacaaccataatctcacaaaaattctattgaaagaccacttatttatggatactaggatttaaaccctgatgagttgtgcatgtgcttttaaaaataacttacaaaaactcactgtcaaacttctttttaacttttagcagccgttagctgcttactactccctccgtctcataatataagagattttgactttttacttgtactgtttgacgatttatcttattaaaaaaattagaattattatttattttatttgtgacttactttattatctaaagtactttgagcacaacttttcgttttttatatttgcacaaattttttgaataaatcgagtggtcaaacagtgcaagcaaaaagtcaaaatcccttatattatgggatggagggagtatgtctttaggacaattttgaatttcacagcttaattttaggaataatttaggtttgtttttcttccattgctcatctttagttcaagagagtttcggctaaaactagtaccgattaaacattcatcaaatgacaaacggatattccatgatagaatacaacggatggagaaatggcttggaagcacatggaactgattgttgctttattgccactcaacaaagttcatcaaaaatacattgcacatctcccaca

SEQ ID NO: 40509 - DNA, 1501 bp, Oryza sativa
aattgattctattagccagcgtcagatagaagaatctgacattttaatacttttttacgatgtcagagaatctaacatttgaatatttcaagatgatattaattttgtttgactaattggtcattgattaacctattgcttcaatggttcgttgattccgatggcatttttagtgccatgccggccgcacaaagaggataaatgggtgatctacaaacggataaagagcagtacaatagcagaccatggcccgttttggatccgagagatattttttagccctatcttaaataggctaaatatgttagaataattgggctaggccctacttatcctattaaatctcaaaggcccataataagtgttaagaataataataccacctcaggatttaagcgaggaatatctcaacctaaatagggagttattggagtctccctgttgactggttgaggtgggggtcggaaagccacacgcgcgagcgcgccggggcgagggcgagggcgaggcgtggctagctgccgtgcgtgcgtcacgtcgctactctttcgcagccactaacccacgttcccacgactgcgccgcaacagcgcgtccacgttcccacgactgcctctctcctgatagataaggaggcgcgccgcaacagcgcgtccacgttcccacaactgcctctctcctgatagataaggaggccgcgagtccgatccgttctaatcgcttgcttctttcccggtgttagttcctcctcctccgcgcctgtgctgctctcgcttcctcgcttctgatctcttgcgcacacgagagatctgatctctttgcgcgcacgagagattggaaggcttcgcctgagacctgcaccgggtaggcgggtgatcaggtttttggggagtgcttcccgcacgactgctcgtcctcgccatgtctgcgcctggagccggagctgccgccggcgccgctgctgctgctggaggagatggcgcacctggagccggaggtggcgcgccaggagccggaggtggtgcggcgaacaacaacaccaacagaggcaattctgcctcacaatccagcggagcgcctttctcggggtatatccttctccttcttctgttcctgctgttagcgctctactgctttgttcctattcctgatgttcatgatgcctctagcatgtttgtgcgctatgttcctgttcctgatattcatgatgcctctagcatgtttgtgcgctatgtttctgttcttgatattcatgatgatgcgcatgatgtctttagtatgctactggttatgttcagatcaccctacactgcttatgccatgattattgtcttaacattttggattaaaatatgctgattcatgaccatatttccaacaatccaaaaacctgataggtcattttcggtagttggctttgctgctgcactgaaaccgcatgcttttgatggttctaactataagagatggaaagcacgtgcactattgtggttgacagcga

SEQ ID NO: 40510 - DNA, 405 bp, Oryza sativa
tttgaccaaagtcaaaacgtcttataacctgaaatggagggagtataagaaacgtattcctggctcttgtttgtgtgttgtctctttatagggagatgtcaatcagacgaagagagatatttctgcaggtttaggccctcttcactccttagaataatgaccctaagttatcaagcaagttgttggttttattgataccgaaagagtatggttacaagggtatatgtggacctagtctaggtctatagatatgctagtcatcggtcctggcgcaatggacacgggtctttggttatattctgcatcataccctccgttccggtatgacttgctgagtacagtgggtagtactcagtcttgctctatctcccaaccccagagttcgagtatgcgtcagatggtggc

SEQ ID NO: 40511 - DNA, 1501 bp, Oryza sativa
ttttttaacggagggagtatgtcctagttgcagttcgaatccctgaacaatcaaccagtaatttgaactggagtagcacaagatagatgctgtacaaagaaaatactggacgtgcattttggtgtaaatcatcagcgcgctgtttctgtgtcctcctttttttcttttcgctgaaacctaatactcccaaacagcataaactccaatgctgcattatccgcccgcacattgcaaagtactactgtagtataagttgtgctataaattttgctctcctgttatgctgggttcctgccgacgaagacacatgcagttctcatcgaaagtagacaaaagtgcagagtcttgaatgttacacacactgattgtactcaattattagtagtttaagacacgaactggttttcaatggaattattaatgcatggagtacacttgtgctcctctacataccggagcttcgcttgtcctcggcattatgaactggaaactgagaaaagtcgtctagtttgtcatgtgggtctgacaaatgaagattatatataccaggagcgacgaccatggatttcgattcagaaagtttttttttctaaaaaaaactctgcctatttctgcacgagtgtgcagattaatattgtacagtacccgccgtcatatggatacagatttttattttaccacttagtttatgtcatttgatctacttaattccactagcattcaatttcttatttgaaacgtgccgctggttgcatggattaaaaataaatctcaaaattcaactagcaaccaattgcctgccccagatttaccggaaagggatacccacatgttagtgctcaactgcacatccagttttaccatgatctctacgtagtagaaattactttaaaccattatctttttttttctgatacaatgaaacgtatatttggtactagcatcttgactttttggttgtagaatatctttttccacaagcactgataatagaactaataaatcaataattgagtttgcttttaatcgtgacaatattagtagagaacaccgtaaaaataagtatgtaaaaaatagataaatttcgataacatacgtgtgtcgtggatatggattttcataccttgatgggatctccacccgttacttgtatgtcacctaaatatttatcaaaaaattgaaaaacattgataacatatgttaatatgaaatatatcagtgcacaaacatacaataccaaatttgacttctacaagttaaagcaaaaaaaaaaaggtttaaccaaaaatagttatcatacattcgcagctatatttgttatttttcttacatcttacagaaattgaattgtaatatatttaatattaatctatcttgtcaatttattttaaatctgtaatgactatttaaatagcatttacggaactagaggatatcacctatcctcttgaagaataaatacactttcccgtgtgttgttggtatatttctgctcgcagaa

SEQ ID NO: 40512 - DNA, 288 bp, Oryza sativa
gttttgcaacctccctgtaagtgtttcacattctttcttccccattttcctttccattaataaacattcatgtgctcacatacactggggccggcgtacgcgggtatttttaatgatcactaaatttgtacactaaaacccaatcataaagttatcatgagggctcctgaacaatgcacttgcattttcatttctatatagctttcaatgcacccctattatcgtatattcgttggtaatcctgcatatacatttttttttactaacgcgctgtttgtacttcacagc

SEQ ID NO: 40513 - DNA, 288 bp, Oryza sativa
tttgggattgagggagagaaggtgataaagaagagtggaaccgctttccccctaggtcatgcaacgtggcctagtagcgtaagctaggcaccgacacaaggggtcaagaatctagagtaagcttgcaccggttgtttcagaggtttcggcaagggggctgcctagacaacgcctccaaggagataaatgacgaaagcaccgccgccgctgtctgtcaaggtctcaaagagaaccgagactggtttttcacccggcagcctcactaaagggcatgggatggcacgacaa

SEQ ID NO: 40514 - DNA, 1501 bp, Oryza sativa
ttttgcaaaaaaattctataggaaagttgctttaaaaaatcatattaatccatttttaaaatttaaaataattaatactcaactaatcatatgctaatggctcacctcgttttgcgtatcttcccaatcttcccaatctcctcaatccccttctcctcaaacacacccttagctttttagtcatgttaataatccggttgttgatgtcgcctgcaatctctgttgaccacaacgtatcaccacacgtgggctggttgaactcaacatgtgcattaacccaaggtgattctcttcttcaaaatctttctcttcatattttccatagggggtaaattagagattgcaaatccatattaacctgtttacagtgaaaattggaatcactttaaaggagaggggttggaggagaactggaaactagaaggtatgttgcttcattagactagatcatatgtgtatttttcaagtacatcttttttgcttgattagttccagtctgcgctcctccgcaatgtgtcatggattcagagacattgaattgctgattttaagtacagagtcaatcgttaatccatgtcgaggatgtccaaaagcaatgataggctccgtgcaagggcatgaagcctcactggtggagaaaccatctttcgtcggtcggccgatttccacaatagtcccggatgcaataaaaaccggggctaaagatgatttttagtcccggttcaaaagggtaacgggcatatttgatctttagtcccggtttgtgttaccaaccgggactaaagatgatctttagtcccggttcgaatgctgtcaggtcatgtcaggcccccccggaatcattaccaaccgggactaaagtcgtaactttataccaaccgggactaaagatcccggtgatctttagccccggttggtgctaataaccgggactaaagtcccacccctatatatatgtcttcttcctcctccagctgcccgagcaagctttaaaatttcttcaaaaaagaggggaggtcatgccaaaatttctattaaatttattttggtgattacagagaaatcggaggtgcctaaaaggtttgcaacttcatcctccaatgtttttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaccaaactaaaatgaaaattaaaagaagtaaaacacattaaatttagtttaacactttacaaatagtttttaataattatttggtgtaatattttatgatttttgtatgaataaagatatcttataattattgtatgactgtcattattgtaagaataattatttgtgtacggttttttttgactcatgtagatggat

SEQ ID NO: 40515 - DNA, 238 bp, Oryza sativa
gtcagaccgcagtgggtctcgcggtcggaccggcgaccggtcggaccggctactgagcggcggtcagaccgggcactggtcagaccggcggtacagcggcggtcggaccggcccccggtcagaacaatggtaccccctcggagaaatttttcggaaaattatcaaactgtttttgcacgtggatatatgcctattggatcttctggtcgtgtgtcttagtactggattcctaaatttt

SEQ ID NO: 40516 - DNA, 153 bp, Oryza sativa
gctatcacctgaacaaatccgttgtcgcccacaattccacgtacgtacgccgtgctagcttttccatgtagtacgatagacctcgccaccctttgatggtcatctccaaaccactcccaaaatacaaataatgaaataatcactcacgcagca

SEQ ID NO: 40517 - DNA, 1501 bp, Oryza sativa
gtagtattgaagtatcaattagtaatatagacaggttggattttcagatgattatgtggcatatcatgcattaacgaaaaaactattactcagcagtcgtattatgcttaaaattttcactattcaagattatcagtttacactcattactgctttcagcatgtttgcagagctgatacttcgaggctatctatcttctgttgtacagtgaagtttagtagtaattaagaaagtgtaagtcataattttttgaagttctctatttccattagctaaagctagcttcctctgtcgaagtatattgtagctgcacatatatgttaaactgattcatactagtcagctaaggatgcatatcttcctgccatgcatgtctgtttcatggcaaaagatatgcaagaagtaaatgagaagaagcagggcacgaccttgtcctcccactagtagacgaatttggctggatttggaatgtggttggatttggctgttaactgggttgtaagttttgtgttgtattggatgtttgtcgggttgtgttggatgctaattgtgctttgacctttgtgctatatgggttgttattgtgtttcattgttggccctctatgggcttagccgatactaatgtaaatgaatacaacatgacgggcagaaaatggtgtggtataatatttgggcctatatgggcttttgcaatggacatggcccatttattatttgatattaaagcaaatggatataatagaattgtgttgacaatatgctacaacatggatggactaggctaaaatctagtcgggtttgccattgggctaaacccataaacaaggtgctaaatacatgaattttaatgggtcatcagctattttatgacgttttttaggctagataatgaaaaatatgagcgtcacaaagctatgacgacggaaggattgtcactagattaatagaaaaaaatctttcgtcatagaacgctattagagatgcatgatatgtcatagcctgaattttcgtttcaggatttataaattatttaataaattattaatagaatttatattaaatgttcattaatttacaagtgaagttaaatgtgggaaataaaatttcctaaatataaagcatggttggatttaatttttgttaaattctccatgattaattatactctctggaattttctcggatttttcagagctcaattcctaattttaataatataaagaatatttcagtaattattcatattaaattaatcatttaatgagctggtttcaattttgttaaatacttagagtgtccaagtatgttcaagatttttcttggaattatttgagtattgaaagtatttttaacaattgaaagatcatctcattggttaatttatttggaaaagcaataaaatcttccttcctagtcttgggccgaattcagcccattctctcccttcctctcagcccggccgaaagtctgtttgtggtccctgccgctacagtactcca

SEQ ID NO: 40518 - DNA, 207 bp, Oryza sativa
ccggctgccctagcaagaaagctggtcaattggaagtaggctaaatgaatgaatgttgctggggacgttgggccagccgcaagtggattggacaatttggacaagataacccttctctctctctctctgccttgtctcctctctactcctcagcatctatataagggccttgcaggcagtggctctcacaccaacgaaacaaggaga

SEQ ID NO: 40519 - DNA, 240 bp, Oryza sativa
ggtgtgattggttatgtaaagtttgtttcgtttactagagggtttcttaggggaattaggacttctagtatgagtatggttaggggctttaggttgcctaccttgggtataaatagagagggagcgtgaggcttcccggtatcgcttttgagagattttagttgatagttctattagggtttcgagtttcctagagatttttataaggagtgttgtttgtgcactttgtaaacacagaga

SEQ ID NO: 40520 - DNA, 228 bp, Oryza sativa
gtttgcaattggttggtttggtttctcctccataattggatgtgagcctggggaagcatcgtgtacttccgtgatctgcacggacagatgccaacggaccttggaacacttgccgtgcagagttcatgaatgaacaatcatgagttcgttaaagggcatacgtttcttgaaaatttggactgttccatggcatgtgctgtagtactatacctcctccgtcccaaaata

SEQ ID NO: 40521 - DNA, 154 bp, Oryza sativa
tcaattccttctgatgacctgggttactgacataccctttcagaactgacatgtacctctcagacgcccacatctgatgtacgtataggggaccaatttcgataatctgagggacgatgtggacaatcagatgctccatcatattgaaataaga

SEQ ID NO: 40522 - DNA, 411 bp, Oryza sativa
tcaacttctatacgcaggttatgcgaatgcttaccgtcacgcgaagcatgactaggtggctagtaataatctaatttgtatccttaactctaataccaggtattttaacccctaaaacttttaacttttaaaaccggcgcaaaataactccctaagtggttttggctgacatggcacgttcatttagtccgcactgctgagtcatcgtggggtcccacatgtcagcgtccctctccctctatctctttcctcttttctcacatcctctcccatcgccgccgcgggcgcggtgctcccttcctccgctccgcgtcttcggcctcggcctccgcggcggacacctcgccggcgccaagggacgtcgttgcaacccttgtccgtgcgctccttctccgatgctattcgacctca

SEQ ID NO: 40523 - DNA, 1501 bp, Oryza sativa
ggcagtcgagatagatcatatcgtgcgcgcggtaattacgctcgccgaccaaagcgacgttaccatatctccaaacgaaacgaatcgccatgtccagattcgtgtgctactcgagtaatgtggcagtcttgaagagaccgctcattattgacagccgagttaccactgccgatgtgcgtgatttgtgaccgttgggtttctgcccaattgtggagaccggtcccacctgtcaccaggccttaggagtggcgtcacgcccgaccgcttcccttaaagagggcgatcgccctggcataacgccgggggctactgtcggtgacatgggatcaggagtatcatgactagaggtttgaggcagacgcaatcgcccacgtggcctggcaccctcgggggacgtcgggcccgagggtgatgtgttcgccctcctcctagtccccccgagggggtcgggctgcacccccctcggccccgagggccgaggcgccccgacccctcgtgggttttttgctccgcgtgtatgggttaggtgagcacagtggggctcacctaccacatttattgcggtttgactgagcgtgtcacgccgcatgcaacgtagtgcagtgcactcgtttatccggtctgtgaccagtcacagaccggtcagatcgcgggttaggtggccacaggcgatctgacacacgcctcgccccatcccgtcaggacgagggcttctaggcgctcgtccccagctggagctagcgtgttacctcccagagatggcacgttagccctgatcagatatatgccaggcttcatcctaaccattacaagcaagatgttgtgtgaagaagggcggacatgtagattgctaagctgacacgtggtggacaagaatgaccgacgtgactggtctgactccggtcatgtcgtcagcaggcggccacgattccacgtcgcatctgctcccggcgaaagtgggggtagttgtgggccgtcccatcagaaggtgactcggatggcaactatacaaatctccgtccatttatgaaaaggtgggggaggtccccacaaaaaagagggaaatggtgcatgtggtatcctcttaagatataaaaggaggaccttgcccaccgagagagggggtttttctttttcttggactgaacctttccagattaggaacccagaacaagggagaggctggctcatactttgtagctctttcacacacgaatccaccaaaacacaggagtagggtattacgcttctaagcggcccgaacctgtatacatcgccggcgtcttctgtgcttcctgtctcgcgaaccttccacatacagattgggagcttagagtctcacccagggtccccggccgaaccggcaaaggggggcctgcgcggtctcccggtgaggagccccacgctccgtcatctggcgcgccaggtaggggactctgcgagtgatcttctgagctctcgcactccttcgtgtgcgccaagctttttctgttcagcccaa

SEQ ID NO: 40524 - DNA, 337 bp, Oryza sativa
tgcccgataatccataatccgttaagaggaaaagaatgcgagtctatgagtttgcctgcttgccattaactcttcaaaacttgattatgaaacactaccatcgatgacatcaaatgagttaaggccgggagatggacaccttggactagtcatcctaatcatactagagaaatgagcattaatttattgcataaagaatccagtatagatgcaatattggaccaatgattccagcaaaccaacgattccaacagtcatggaatctgaagacaagaaaacaaatataaatgatataattacttctgctcttgttttgttctcctggtggatgccaaca

SEQ ID NO: 40525 - DNA, 1501 bp, Oryza sativa
ccaggctcttggaaacctaggtcatcatcgccatcatcgatgtcctcggcgggggccttctgcttggcctcacttcgccgattgccggaaggaaccgccggggactttccctctcggcgctcctgcctcctctcctcctcccacttcctcgtccgctcagccaaacttttgactacacggcagtccgcgaggtcatgaagggaagtgttgtggacggtgcaccacttgccggttgggcgctccctgctgggagcgccggcctctttctttttgtcacccgcaggcctcccctttcgggtggcccgcggagcgccctcgacggcgaggacatgaccctcgtcgtcggtatgggctgacctcttcttcctcctcctatcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtattacggacttgacagaaccgctgaatgtacgagcgaagtgactcatcatcccttcgctgtactgcgtgcaagtccgcttcctcaccggggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggcagcacgtcggtcattacgccggcgctcgatgctggtgcgggcgtccggccccccacgcagatcttcccgggtcgaaggagtcgacgaaggagtggcggccgaatggcgaacagcggctgccgctcttcgtgccctccgtcttgacgacgcggagccggtggtagcagcaccagaggccttggtggcggaggaccgcccaccagcacctaggcgctgccgtgcagtcatgaccaatttggccacatcgtccagccaacgttgggctggagactccgggtcatggacgacgggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatcctt

SEQ ID NO: 40526 - DNA, 1501 bp, Oryza sativa
acattatcattctaaaaagtatctctacatagtttaaaatgtctcaacaaaatgcctttacatattaaacgcattttatagtgccgaaagaatgcctctataagataagatctaacaaactgagctaaaattgtctctagagtaaaagttttctagataatttttgaagtgtctctacactataaaacttatgatcttagaagcaatttgcaaaactcctctacaaaagtgcctctatacgaggtttttgttgtagtgttaataccacttaagctgtgttcgtacatgtgagtttccatgcgcacgtttcccaaactactaaaaggtgtatatttttgaaaaaaaaaatcttgaaaagttgcttaaaatcatagtttttaaaaaatccattttagctgatacttagctaaacatgtgcaaatgagtcgctccgttaaatgtgcgtgggggaaaagttccctaagtgagctccctgaacgcacatatgataatttgctttccacaaacattaatacacattggcatatgtgaaatcaaagtgtgttttgattattatttcatgataaacaattggcacgagagataattgatactgatatttagagatatatggtgaaatggttttggtgccagtcacaccgggtgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaaacaataaagatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaattaatttaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacaatacccctcgcataacacaatccactgcagcgcaccttcctggatcataatcacccccttataaacaaggca

SEQ ID NO: 40527 - DNA, 195 bp, Oryza sativa
tcagttgaaagcacatgttcctgatcatacaccggtctttacttctcttcctcaccctgtggttttggatgccgctgacgtttgacctgaagaaatactcgatcgtcggcttgtgaaaaagggcaatgcagcacatgttcaggtgttgattaagtggtcttctttaccggcgcatcaggctacctgggaggatta

SEQ ID NO: 40528 - DNA, 801 bp, Oryza sativa
aatatatttgtaatataaacgagctccactgaaaatcaattaaatacataagttacgttagaaatcaaggaaaaacggttaacagataataaagttcatactcaactaaatttaactgataataaataagccaccatacataagtagtttgcatggtctttaaaataaggaggctaggcttggattgataataaatgacacagccacagatttctctcccatccaaggaacacttcgaaaaactgatagtgtctagttgcaattactaggatcccaatggcagaccaattattttgtgataatgtcttatgcaattgtcgcatagtattgcagaaaacaatgaaaattggtattcaattgcccatgttgcagtaagtacatatacaaaataaaatgaagcatgatgtcttacaatcaattttgtcatcaattggagcattgggatgaaacacagaaagagcccgtgcaaattcttcgaatccaagaatcccattgtgcttcgtgtcaaacaaatcaaatacctaaattgattaaattgaaaacagcgcacttttgagttgacttcagatgatggcataaaggaatgtgcatctgcatgtttaaaaagtaactaataatttataatagggccaattgcatatttgccactgatttgaatcggtattgtgaatttgccattataaaaaacgtaattgcatgcttgccataaaaaacgattggaacccatgatacttgccattagattcacggctgggaataacaccgttaaaagatgggttctcacaaaaaataggacaagga

SEQ ID NO: 40529 - DNA, 1501 bp, Oryza sativa
cttcagccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacagaaaaagcttggcgcacacgaaggagtgcgagagctcagaagatcactcgcagagtcccctacctggcgcgccagatgacggagcgtggggctcctcaccgggagaccgcgcaggcccccctttgccggttcggccggggaccctgggtgagactctaagctcccaatctgtatgtggaaggttcgcgagacaggaagcacagaagacgccggcgatgtatacaggttcgggccgcttagaagcgtaataccctactcctgtgttttggtggattcgtgtgtgaaagagctacaaagtatgagccagcctctcccttgttctgggttcctaatctggaaaggttcagtccaagaaaaagaaaaaccccctctctcggtgggcaaggtcctccttttatatcttaagaggataccacatgcaccatttccctcttttttgtggggacctcccccaccttttcataaatggacggagatttgtatagttgccatccgagtcaccttctgatgggacggcccacaactacccccactttcgccgggagcagatgcgacgtggaatcgtggccgcctgctgacgacatgaccggagtcagaccagtcacgtcggtcattcttgtccaccacgtgtcagcttagcaatctacatgtccgcccttcttcacacaacatcttgcttgtaatggttaggatgaagcctggcatatatctgatcagggctaacgtgccatctctgggaggtaacacgctagctccagctggggacgagcgcctagaagccctcgtcctgacgggatggggcgaggcgtgtgtcagatcgcctgtggccacctaacccgcgatctgaccggtctgtgactggtcacagaccggataaacgagtgcactgcactacgttgcatgcggcgtgacacgctcagtcaaaccgcaataaatgtggtaggtgagccccactgtgctcacctaacccatacacgcggagcaaaaaacccacgaggggtcggggcgcctcggccctcggggccgaggggggtgcagcccgaccccctcggggggactaggaggagggcgaacacatcaccctcgggcccgacgtcccccgagggtgccaggccacgtgggcgattgcgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcagtggtaactcggctgtcaataa

SEQ ID NO: 40530 - DNA, 1501 bp, Oryza sativa
ctaagataaattagttatgaattttcaaagattaaatcggattaaatcatttatatggattttaattgaattatgacgcaataatgaattatttttgaaaaggaaaaagagattattgcgtcagcggctagggttcacggcggcggctcacggaaacgaacggccgggatcgatctatccaaatcagacggccgagatctaaacggtctacgaccggtctacggcggatggcgtcgatgatgtcagcggtgacgtcatcaccggcgacggctcggacggcgcatgctcgccggcgaacgacggcgcggcggcgcgaacggacggcacctacgggttgcgggcgacacggcgaactcaccggtgaccaaagtagcggcggaagatcaacggacggcgacggcgtcgaggaagaagcggcggcgtccttcggcttgacgacgacggcggtgcttcggcgacctacagagacgacggaggggtggacgaggtcggcgacgacttgacgatcacgatggcggccttcccgagcgacgacgacgaccggagcggcgacggcgcaaggctggacgaactgcggcaacggcggcgctaggctacacggcgctagagctctaccggcggcgagagacgaaggcgagggtgccggcgggtagaggagacaccgggggtccttttataggggctagggggccgcggcgaaggcccacggcggccggcggcggtgatggaaaggttagggttcggagagagagaggaatccgattcgagatcgaatccaccgatttccaaacgatttagccgacgattccaaaagtgaaaagatagaggagatctcggggatcatttcccctctattaatttcaccggaaaaggaaagggatgaacgaatttggaacgagacggcggcgcggctcggttagggttcgggcgtggcagctgcgcgaggaagacgaagactgacaggtgggccccacctgtcagcgagcgggacgcgcgcgcgcgggcggcgctcggctgcgggctgacctgggccggggaggagagagagaggtttgggccgactttcggcccaaagccaaaagagagatttttaaaactttttcatttaaattattcatgaagtgcaattccatttattaaaaatacttccttagctcaaataaatcccagaaaaatctaggaactatagaatcaagcaaagtatttaataaaattttatgaagcccaattttatattggaatttattatttaaaattagatcttctcttctaggcttttaaaattcatttctaataattctaattaaacaacaatttatatatttaagatttttatggtgcgacatgagtaaagtccagtgagaatattgtgttttcgctggcgggtggctcgtcgccagccaaaatcgagtttcgcaagtggatatgctaagacaaccgctagcaaaaataccatttttgcaagcggctagataaaatggaccgccagtgaaaacaattt

SEQ ID NO: 40531 - DNA, 1501 bp, Oryza sativa
cactgaccgggtctcctgttctaaaaggacttgaaaagcatctatgctgtgcaaacccccaaagtttggggctcctgcctccatttccaggaaccgacacggaagccaaaaggcccacgcccccaaaaaagccgaaggatgtgtcaagtgggccacgtgaaaaagtgtgggcccatccgtgtccacttaactgcaattctaaggccgggccacaggcgaccatcgcgcccatggcagcattccttccccttttcggtcgccgatgcgatgcccctggtgcagtgcatggctgggactgagggaccatgaactcccttggcactgaggaagatgtacataaacaatatgctaaaggctgcgttcgaacacgaaggatcccaaccttcaaactaattcaaactactaacggtgtgtttttttaaaaaagtttttatacgaaagttacttaaaaaatcaaattaatctattttttataaaaaaaattagctaacacttaattaatcacgcactaatggactattccgttttccgtgcggaggagataggtccccaacccatcctatcgaacgcagccttaaatgctactactagctagtagctacacgttggaaattggaaggataagggtggtttatcacttctagaactttctttccacttggggacttcctcttgttgctgtgacctaaggctgagtccatttctttccttttcaatgcacctccctcactctccctcactttccatacgcacgcactttttaaactgctaaacggtgtgttttttaaaaaatatatatatacaaaagttgttttcaaaaatcatattaatctattttttaaaaaacagttcatacttaattaatcatgcgataaccatcactttattttgcgtgctgagatgacagttcctaaccctcactcccgaactcagcttaaggacttgtttgggatttaaggtctattttttcccctccttgcatgacttcaggacttttttgggatggtttgaggttaacccaatcgcatcttaatggcaaagattttacatttcaaaaaacttgcgatagtttttttttaccaatacccaaccacgataagaccattgcttgcgtaatgttgctcctaggcagtggctccgtgtggcatgctacagcccgaggggcgaccacaattgctccaatagaagctggagtccaaattcctaaacacttttgaagtctgagctacggcttataagctaagaaaaataaatgaagcaaatcaaaaataactttagggtaaggtttttatacttctgttctttgattgaggtccaaaaggcaagctaaataacgaaaaaaaaaaccaaaatcaactctaaaaggtaaagttatagaattcaaattcggactgcagcttataggccaacaacaagctagcggccaatagagacaggcagacgtatttaggccagtgacagcatttcaaagtcaatcttgttcattaaggaatcgagagtt

SEQ ID NO: 40532 - DNA, 1501 bp, Oryza sativa
taaaaatacaataaaattgcaagtgatatgtcatatttgaaagatatttaaaatactctagataacaattgctagtgggtgatgatatgacacttgcatgtgatttaaaatactctagataataattgctagtggatgctgatgtgaaacacttgcatattgagctttaggagttagtgaacattaactttatagtaagatagaattaaggttgtttatctacgatgaaactatatgtaaatttggcaagttcattttacagttttctagtgcttatcatagagtcgctagctatactgctcccaaaaaaacccaacctacgaggggatgtgaccccccatagtacaatgaatctggacaaacttctatctagattcgttgtactagaagggatcaaatcccctcctaggttagatttttttaagacggagggagcacgtctttcatctcgaaatataacaaatttagtatcaaactacatacctgtaaccaaaacattgtataatataaacagcgggagtggcacttttcaatcactctacccatcgtcttactccctctgtttcaactataagatattttggttgaacgagacgtatgtttatatgtctagtcaaaaattcgtagtactacaatatatctccaaccaaaatccattatcttttgagatgtagaaaaaactctactctcactacaaagggcccggcaccaaccgtgctgctgcacacacacggcccagccgcagccgcagccaccgcagacagatagccgaacaggcccaaactctctggtcatcgagataagacagaatatcgggcccccacgataagttatgggccatgggtccacttcaaagccctccagcgggcagcggcccagcccaactcacaccaaaggccctctccccagaatccgggggaacacaacgacatcctctcctcatcgccttctagaaacatcccacgacgagcctctcctctgatcctctcctcccccactccaccgccaccgccgccgtcgccgctgccgccgccgccgcgcgaggaggacgggcggatctcccaatgaggtgactcctctcccccgccgatctccccgaatccccccgttccccgtagccctctctttctcccccgccggcctcgtcgtcgccgtcgtcgtcgctgggaattctgttcgtggatggggcggccaccaccgcgtagccgtgggagagaggattcgtttcgtgtttgggttggggggtgcagcgggtgggatccgggagtttcggttcctggggcagcggcgtgatcgatgatgggatatgtggatttcggttcacgtcttcgtgattccggcggggaattgccgaattgggggcgatggtggttgctgacttggtgtgggcggtggattcctacggtatattgggtgatctccttgttgttgttgttgttgggcgttgcaggtgtgaggcttgttgattggggagctgctggttgtagtttgcaattgcaaa

SEQ ID NO: 40533 - DNA, 1382 bp, Oryza sativa
taaatcaacactatacaacacacccgtgttgcataggcccaaccattctgaacaaccaatcccggctgcacagttctatctccaaaccaggaatataccattccaaaccaggagctaaacaagttattaccaattacaacattatttattacggtgagaggtgtgaaactaatcacgaaagacattgttagacccgcccataaccgcgggtacggctattcgaatagtttaaactctagccagaggtgtaccactgtacccacaagacacaacctcaacatcatgtcaaccatgcgtcgcgatacttaacaagtacccgaatagagattgtgacaatacctcctgcataacacaattcaaagcagtgcaccgttcccggatcataatcacccccttataaacaaggtatggactccccagcgaccccggtgggcttatctccgccacttcacagtctggtgctctactatgaaccatactatacagaaagtaaagccgttgcccacgctggtttgtggatggcacggtaaatgtttcacaaccgaaaatcgtgaaccggtccttaattgtcatgagcacaaccatcaaaaccatatgctcacaacccaccattatcaggttttagttggcaaattaattacttaaccaatcatgattaaccatcatgagctatcattaagccatcattaaataatagtgaagcataagttatcccactagtgtgcaattatatctaatatctagctgaaccaatgtataaagctcaactagtcaagttataataacccaaggtatcaaagaatagggtaatcaagaacaaaaagggctataacaaaacaataggttatttccacccaatgacattcaaaaataaatgcagtagttgaataaaaacaatagctttaaacatgatcaacatgctcaaagggttgtttgggatctgtgtgacttgccttgctggccttgaaactcttcaaaatcttcccctgtaaaatcggactctccgggaacgtcggaatctaaagagaaaagaacaaaatcaccaaaacaacacttaaacaagcatgaacagtacatgtggatatttttaacatgtagatctcaattttagaaaaatttagagacttgaaccaacaaaatccgagctaagataaattagttatgaattttcaaagattaaatcggattaaatcatttatatggattttaattgaattatgacgcaataatgaattatttttgaaaaggaaaaagagattattgcgtcagcggctagggttcacggcggcggctcacggaaacgaacggccgggatcgatctatccaaatcagacggccgagatctaaacggtctacgaccggtctacggcggatggcgtcga

SEQ ID NO: 40534 - DNA, 769 bp, Oryza sativa
atacttaatatcaatatcaaggaatgacttcctgtagtgctcttcttccttgagagcacacgcaataagctatcaaaagagtatacatcttttccaagaaaacgaaaggtagagatttttttatcaaacatatcaacacatgaccctatttgttgacttgaaaaggaggattggttatactttgggtttcttggtccttaagtgggaactgggatatgcaaactgacagctccttttctgtttgtggtgcagggaatgacagagaattgccactctctaacccaagaaatatcacacaagcctcaatagaaccacaggtatcgtgaagcaaatcactctcaaacattattgtttttttttattctgttctaattttatctggttaggaagtgggaactgtcgggtgctggaatattgctgcttcttttaagctcctttttttttctctgtcacaaaaactatttcgttgaagtaaatggatggttaaatcgaaatgtgcccatcttgacaaaaggagcctagcactaccctcacatggccatggtaggctgagtccagaatagagattagattccccaatccatgacatgcaattcgcaaaggtgacattgatccgcatctgactgcatgctttcagctgctcctttgctgtttccttccgtgctgtcgattatcagtaggctctgcccgcagtccccagcaggagtcccccacacggcatgttagcccaccattggcctagcctgcctctctatctgctgtgaccagg

SEQ ID NO: 40535 - DNA, 742 bp, Oryza sativa
ccccctctccatgcttgcgggtgcatgattcacacacatatattcacactcacatgcacaaatagacatatgcaatcacatgagcagagttttcaaatatcaacttctcggtgctttaaattattccatgtaacattgactactccacattcatacaatgtgtactacatcatacgtgcttcattaatcatgatgtgtaaaactaggaaaaacgataaagtgattcagtagtgcagaaaggctagaacagaccaaataccatgaacaacatcataaaaacttcattaaacagaactcaattagctagccatacccgatcagcaaacatgctgtcttttctgttggtcttaaacagtgccagttggaattcttcctgtcaagacagccaatgccatcagctgagttaactagttcagatgccacggaattctaattttgatccatggccatccaattcacagcaaaggaaactagcagaaatactactaaccttattgatcaagccatcatcaaccacagcactgctaatcttcttgaacagctcatacagcgcctctatttcatttacgttaactgcataaccaagcagaataaactcattgacgaataaacggaaacagaacaagaataccatctattaagaatatatactgaaactgattccgtacacatcgaatcatcaaaaagaaggggagttggaaagaggaatcttacaaactgtttccctcgccaaccgttcagg

SEQ ID NO: 40536 - DNA, 1501 bp, Oryza sativa
cgcggttgcggcggactgggccggctggcccgaggagagagaagagagattttgggccgactttcggcccaaagccaaaagaggactttttaaaacctttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcaggtgtgacaccgggcaaatattgtgaacgctgatctgaacgcagccttagatgcatttttagcctaaacaaagcaaatgataatttgctttccacaaacataaatacacattggcatatgtgaaataaaagtgtgttttgattattatttcatgatgaacaattggcacgagagataattggttatgatatttagaaatatatggtgatgaagtggttttggggctgggcagactgggcaaatattgtgaacagatatctgacgatgaacaagtttttctgctggagtggaccggtcagacaggacccttgctaagcgagcgtagctcaactggttaggtttcttttagtggaaccaatccacccgagttcaaatcctagatttgatacgagtggttgcatttatgctaattattctttgtttctcaaaagaaaaaaaaattacaaaggcaccctgtaaacaaacctcaaaataatagtatgactaacctcaatattccgagtaaacaagagtaaagcaagtacattgcatctcaactattagttgatggagacgttggtcagttcaacatcatcttctctattaccacatgtatatatcaaacactaatttcttggtgcacaaaaaagtacactattttgctccgacataatgaaaataatttcctgttgcagtgtgggtgaactgcaatgggacatcaattgtgcagacatatatacacaatgcatgaaaatgtaaaataagtttcggttactgttgtaatgttactttaatcagaacatgtcatccaactttcaaaagaaaacatgatttctaaatgatttggatttttcccatccccaaggcttagtccgaaatagctgctcagaaaatccataactcatgtttatagatcacattagagactacctatatatgtatttttatatatgtatttgttgacaaattttcactactatgaaaaccgtttttgtaaacgggcaaaacgtatttccacagacgatggcatggaagaaaaggtctgcaaaaaacacaattttcgcatgtggacacttgagccggccgcatgcgaaaaggataaatcacgaaaaaaataaaaattccaaaaattgaaaaatatacccaccgccggtccgccgtcgtcctcctgtcctcatcctccagc

SEQ ID NO: 40537 - DNA, 1019 bp, Oryza sativa
gcatgtcttatacatactcactacacgtatgcatgtcacatccctaatcaacatcagttttgtaaaattaacattgccaagttattttggtccttgttcacacgaactagacaagttcgtgtactgaaacgagtattttataaatttatgtactaaattgcacccacctaataagtttgtgtaccaccaatgcaatttactccaatatttataacaatggtaaaagaattactacgttgtaagccggtagtaattcttttacgaccatctaggaatggtgtcgtatgatgtggggtatttatgcatgtaaatttattacttttgaaggggcattcatgcgagataaatttgttacttttaagaagcagatatgggaggctgggagtaaatgaaaaactccacggagtaaattcgttaattttgaaaaggcgttacttttgaaaagtggggagacactggaaaaacagaaaactcgaaaagaaaaactagatagtaaatattttactaaaacatgaaaacagaaaaactagagagaaggaactaaaaaggaaaatcctggatggttaatatttttaccggatcctttaataaagcacggataagataaaaaagagaaaaaagaaacacgaatggtggggtggtaaaaaaaacgaactgggtggtaaaaaaacgaactaaggagatgtaggatgcgaaataaagatggggtggtaaaaaagggaaaaactgggagggagcgttgtgcggcgctcgaaacaatattctgcgttgtacttttttcctatggtatatatatctaattcatccttacttttttttattttttcttttttttgttatatgtataagggtaaattagacaattcaccatatattttatatatgaatgatgatatggtatattcatatgacgatttcggtaaacgagcgaaactttaaggatacattgactattctcccaaaatgaaaagtcatgcgccacggttttaccaccgtactactggtttctatttttcagt

SEQ ID NO: 40538 - DNA, 1501 bp, Oryza sativa
aggtgcaggagaattttcaaggaagagccaggattgtgattgatggtatcaccggctcttttttgtttggtgtcaatcggaatcgggtaggcaacggaaatgctaatactcgttattcattctgtagattttgaatgatgctccctccgtttttcacttgtattttaaacattcatatcttcattgatctttttaatcacatgggcattattaaaaatgtaactacattttgattaatgtttcctatatatgataaatctactaatatcagtttttttatttgaaatattataatcccatgttaagaatttgagatttgaccgtaaatgttctagcaaatagctagtaatccgttaaaaaacagaggtgataacgaatggttcaacttccaaaataatatgaaaattttcaatgctatcaagagacatacaacacgaaacaatgtaatctactccctccgtttcacaatataagtcattctaacatttcccacatttatgttgatgttaatgaatctagacatatatatctatctagattcattaatatcaatatgaatgtgggaaatgttataatgacttacattgtgaaacggagggagtacatcataaggtttaatatgttcgtatcaatcaactctaagtcatagtatcggttatttttaaaacccgtttggctattagtcttggaaatattctcccaacaactaaacgtattcctcgactccttcccattttatgccaatcacattatccttgtagcctataattccaaaccgaacaagcccagatatattgcacacataaagcattatgggcatgtttggattagtgccaatttgtgccataccaatatttttggtagcttcaaagagtactttgatagcatttgaattgtgaccaattttgtctatctagtaataaatctaccctattaaatttggtagtgccaaaacttactaccaatattttaataggccgcaaactaaatcagccctatactatgaggcaaacaacccaaagtgattataaatttgcacccatctattggcacatctaggctgtgtttagttccacgctaaaattgaatttaaagaaattggaacgatgtaatggaaaagttgaaaatttatatatatagaaaaaattcgatgtgatgaaaaagttaaaaatttaaagaaaaaagttgaaatctaaacagggccgtaactgtctcctgtctgtcgtatatacgtatgaggtggtagtatctccgtatctccgtacccgcactggcagggtgtcgctgaggtggccgcgcggctagtgggctccaactgcaaagaccccgggcccacatgtcatccaccgagaaggaaaacccaccggcaaacagttatccgggcccaccgccgctgtagcacactgctcgttgattcgaccaacgcggcatttcttccttccccctacgaaattaccatcctaccctctcccactccctcctcctgaaccaagcccacgcg

SEQ ID NO: 40539 - DNA, 1391 bp, Oryza sativa
gggacccagggtggggttgcagttcggtttgaatcatcgtaggctttgggttaaggcaggttcgtaagggttaacgaccttgtttaataatactgtgtagctctaggatcgtctttataaaatggctttgggcacctaagtgacttttaaaggctgttactgcaaaactcaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatttggataccttgtgagctgtcacttgggcttattactcttggagatcttctcatagacggttaggtgtttcccgtgagcttccaaagatcttgtggatgtcccgggaaagtttgtgaagattttcctcacctccggaaggaaacgaggtaactgagtaaagattcttgtgctgagttttcagaggttgtcctaggcagagcaacttgcacttgtggtcttttctagaagaaattttgagttggatcttggtggtcactcaattctagaaaatgacctagaagtgttgagttgaaggttgtggatctcttctgggatctttgcataagtgagccaaggggttaatcgagacccggctctttggagcacctcaacggagagtaggattcgtgtgatccgatcttcgggaaaaaatcgtctttgtctctcttgtgcatgatctttgtgtgaatctgctgatattctgcgatctttatcttgttcccctatgtgcctaaacttctcttgctaggacctgtttttcatctcagtttaatttatctctgctgcccggaagttcctggctcaagaactccggaagttctgggctactcatgctgcccggaagttccggtgttcatcaccaggaggttccgggccctgtcaattgacccgatgcaattgttgagaaaatttcaggaaagcctattcaccccccctctaggctacatctctgcacgttcactgggatcgttccctgtgacatgtcttcgattataaaattttttgccgcatcaaagcaaaaatcatcagcctcttcgttacgacccgcgacttccccgtgaaaagtccatatcttgta

SEQ ID NO: 40540 - DNA, 1367 bp, Oryza sativa
cacagagcgggctcgcctttctccccctctccccagcgcactcaccgcgccggccgccgcacggaggaggtggtggcggtgctctggctggtgtgagggcaggggcaaaatcgtactctcaccaatgtttctctctccacattcacaggaaataataaaataaggccccgagtgttctggagctaattacactttattgtgatgtccgacaacagattctcgttcttgcggtgtccacgagctaattacacgttttttcgatgccctgtggtaaattttgccatttctttttgcaaatcaaattaacgtgcaatctccaatattacttgatctgaattgatgggctgcacaggccctacatttgcacatcgtgctccatattgctagccgcagaggatagggtatagtccgctggtgatggaggttgtttgcttttttttttttgctcgtcgtccttatgacatgaacgagaatgtttttttttcatttttttcatgcttgctagatgatggatggttgctactgcgcaacgtcgaacccatctctataccacgtcgctacacccctccatgtttccatcgtcgactaccacttgccacccggttgctctctccactatagggctgtcaaaaaaactcgaggctcgcgagctgctcgattcgagctcggctcgagctccagacgagccgagcctaagcctctccctaagctcgcgagctttgtcgagccgagctcgagcttccaacgagcctaataatatatgattttttttgttgttatttaataaattagaagatcaaatatgttatttgtatgccttttattgacatcatatatttattttattcttttttcctcttctattaatatgatgaactagaaattaattattttttaaagattatctttgaaatatatattgttttacttaaaaatcaagctcggtagtcgagctcgagccaagcctatcggaaggctcgaatattttataggctcggctcgagctcggctcaagcttgtatcgagcttgagcctaggcagacgagctcgctcgagctcggctcgttgacagccctactccactacctgtcacaagatacagaccagcatctccatccttatagcaagatctagcaaagccaccaggatcctagttttatgatggattttggctgaatcaatttttttcttttctagtttgattcacctatgagtaatttttatcacttgtgtgtgattgagcctgtaatttttttttattcgtacgaccattttgtgatacatattaacaatattcttagtatcagttttttactctattgaacacatcagtaaacatattactacatggttgctacgaaatcatg

SEQ ID NO: 40541 - DNA, 285 bp, Oryza sativa
gggacccagggtggggttgcagttcggtttgaatcatcgtaggctttgggttaaggcaggttcgtaagggttaacgaccttgtttaataatactgtgtagctctaggatcgtctttataaaatggctttgggcacctaagtgacttttaaaggctgttactgcaaaactcaacccctatattattatccccttgtactcccttgcattaattatgcatctccggtgtggcttgctgagtactgtggttgtactcattcttgctctatctttctccccccttcagt

SEQ ID NO: 40542 - DNA, 622 bp, Oryza sativa
cacagagcgggctcgcctttctccccctctccccagcgcactcaccgcgccggccgccgcacggaggaggtggtggcggtgctctggctggtgtgagggcaggggcaaaatcgtactctcaccaatgtttctctctccacattcacaggaaataataaaataaggccccgagtgttctggagctaattacactttattgtgatgtccgacaacagattctcgttcttgcggtgtccacgagctaattacacgttttttcgatgccctgtggtaaattttgccatttctttttgcaaatcaaattaacgtgcaatctccaatattacttgatctgaattgatgggctgcacaggccctacatttgcacatcgtgctccatattgctagccgcagaggatagggtatagtccgctggtgatggaggttgtttgcttttttttttttgctcgtcgtccttatgacatgaacgagaatgtttttttttcatttttttcatgcttgctagatgatggatggttgctactgcgcaacgtcgaacccatctctataccacgtcgctacacccctccatgtttccatcgtcgactaccacttgccacccggttgctctctccactatagg

SEQ ID NO: 40543 - DNA, 425 bp, Oryza sativa
aattaaatttcaaatataggctcaagatgttcaaaggtggcttgccttgctcgagatctagagcttgatcctcgaaatcctcgcactgcggttcttcgggctccgaaactatacgcaaaacgggacaactcaacaaacggcgaaaataaagccctattaatgacctctaagcgtgccattagagagatctcgagatttgaggaattttggaagttgaacggagtcaaacggatttacggttgggaagatattgaatttctaagattactggatttttggtctaaaggaaaaggatttaattaaatcctttttgaaaaagaaaagaaaagaaaagaaaagaaaagaaaagagggagggaaattagacttttcctcgggcggctagggcgcggcctgagagaaaaggggcggctcggccgagctaaa

SEQ ID NO: 40544 - DNA, 1501 bp, Oryza sativa
agcatgtacggtgttctgtagactgcaagttccgatttctgaaatattttagctgcacatgaggtgaacgtactggtatattaaagccatatcttctgccttaccagcatgtagctagtatattactggcctgatatagttagatgtttgttaaaaattttgctgaaaaaataattcaatcactactgctaccacgtaatgggctactgctggcttatcactgccggtcgggcgtgagcaacaccgctggttcatttttaataaaaaagcaatcaattaatcgctactctctcgctctctccaaatatagctttgtagtcttaaattttggaatggacggagtactacacaatacacaataggcagagtaggtaacactacacaaatcattttcctaaacgccggccctgtttggttctaggagggccgtaactagcgccgcgtgaaaaaaactcgaggaccggcgccgggccggcgcccgcacgagaagatgcattatcctgtgcaggccatttaatccgactgcacgcgatgatgtcggtctatgtacactctagcccgaccatgccgcttttattccggcgttttctctcgtaaactttgaaaaattaaggggaaggttttcgacctcaaatctttgattttgatccatatataaggtgtaatgcttgatcttctccttcatttgcttctatttttgttagtttttatcggtgcaatgcgaagaaatttacagttttataaatggagagtgtaggcactttttgttttttatttattttttgagctaatatgtattgtttgtatcacatgtttttcaaagtattccgtagtccgattcctttttaggtttgcctccattaatttaatttgtcattggataaaggctaagaaaatttacaattttttggaaatggacagtttttattattgattacaaatgttgcatgcatgtttaaattctccgtagaactttaatttaatttttgtttagttccctctgtttatttcaaattttttcagtggaattcgacaaatatattaggtttgcaaatctagtaattctaagtaatatttaatttattaatttaattttattggaacccctagaccatgaatagcaatataatgtccgtttaagttgtatttttttcatatgttaaatatagtacaattcgactcatgaaatatgttcttttggtagatggaccagcaaaaagaattcatctggcgttcttgaagaaagcatccaattttgttgatcaggcaaatgcacatgctttgagggagaacaagagggacattttctgtccatgctttgattgcaggaacgaaaagatgatgcaagacccaaatgatatttgcacattgtagagcgtggatttatggattattacaagatatggacttttcacggggaagtcgcgggtcgtaacgaagaggctgatgatttttgctttgatgcggcaaaaaattttataatcgaagacatgtcacaggg

SEQ ID NO: 40545 - DNA, 1501 bp, Oryza sativa
tcatacaaacaacgtggccatcttgtgaaggttagaagtggcactacaagaagatgatcgtctggagaaagattaaaggaatggagcatcaaatgatgcctccaagaagttcacaatgcgcgaggacactgccattgcccgtcccagggaaacgggacatggttttcacctaaagattcaccagcgaagaacggaagccacgataatgcctctaggaggttacaatgctcaagaacaggcctcgaagagctgagctttcgctaggaaacttctgttagaataaatgggctaggcccgatttttctattaaaatctcaagggcccataataaatgttgaagataataataccaccatgggaattaaaagttaagaatctcaacttaaatagggagttattggaggctccctgttgaccggttgaggtggggatcggaaagccacacgcgcacacgcgcacgccctgagccgagccgtggccgtggtgtgcgtcgcgtccgacatctctcgagattcttttgcaacggttcagaattcgcgagattgcctctgtaacaggcaggtgattcaatacacattgatcgcgtcgttactgctgcaacgggtggattcctctcctgcgctattaggaaacagagacccccgatcagatcttcacgctttctcccatcgctggttcttcctccacgcgcaaacagagacccccaatcagatcttcacgcatcgctggttcttcctccacgtgcaaatagagaccccaatcagatcttcacgcatcgctggttcttcctccacgcgcaaacagagacccccaatcagatcttcacgcattctcccatcgctggttcttcctccacgcttgcgcctatgctgcttctgcttccccggttctgatcgcttacgcgcacgagtgatcggaacgagcagggcctccgaaaccacaccttcgcctgagatctgcaccgggtaggcgggtgatcaggtttttggagagtgcttccgcacgactgctctctcttcatcatcgtcggtggttctgttcggtctgcgtcgcggcgatgtctactggtggcggcgtcaacggaggtgcgccaggaactggagacgcaccgatcgacaacaccaacggaggcagttctgcctcacaatccagcggagggacctttacagggtataccatcctactgcatttttgtttttgttacatctattagtcgcaatgttattgcgttctctaaatgatgttgatgcttattttatcttaagcatgcttctggttatgtttaattttatcactagatcacctcacattgttcatgtcatgtttattgccttaatattttggattaaaatatgctgatatatgaccatatttccaacaatccaaaaacctgataggtcattttcggtagttgactttgctgcaacactgaaaccgcatgcttttgatggttcaaattataagaggtggaaagcacgtgcactattgtggttgacagcga

SEQ ID NO: 40546 - DNA, 1501 bp, Oryza sativa
agtagaatgtcttatatgatcttatttttacttgtattttgggaggggggagtacttttgtgtcatcatgtgcgcatgtggctaatggcgggatgattgcaagggtgctctaatttctttccatgtttgaggcgcttccttccagctttccagctcctgtatctgtatctgtttctgtgtgtctcttcttcttcttctcaacttgattggattgggcgtctacacggtacacggttagtttgtaaaatcagtggattttttttcctgtgtgtgtgctctaagatggtggaacatattaattcttggctcacgatttggttcggtggtgccgggtgtgtttcggcgtggatagatttagagatatttgagatgtctaatcttgattgttgtgttcttttaatagtatgatgaggttcatctcgtcgctgttggatgtattttatttagacaacgctactatcctagtgttagtaccttcttgctagtgttcgcttgggttgttggatcagaaggaccaaataaaacatagggtgcaaagtctctattgatttagtagtaagtgctgtctctatgcagatcgatgctaaaaagatggatctgttaatgatatatcattccagtttgcaagaagttttcttgactggtctgtaaaaacctcttaaaaattacactcttttttatggagattctctattacgtcctacttcggcctagtttagttccaaatttttcttcaaacttccaatttttccatcacatcaaaactttcctacacacacaaactttcaacttttccgtcacatcgttccaatttcaaccaaacttccaattttgacatgaactaaacacacccttctgtcataggctcatgtctgaatccaacaaaatgccctgcccagtaatttctgatctcctgttgtgaactgtgatcttagtgcaatttctgatctcctgtggactaagctacagggttcgcaccttattttatttatttacaagaaggcggtaaaaacaactttgttaaaacagagacccacactctaaaattgttccatttctgatactttacattcacttatctgagtgtttgccccaactggaacaacgcacagtgcatatgtttctgatgtctgtgctgttttggatcggatggctagtctgctgcatataatcattgtagcgttgtgagaactaaaagctgtgttgtgtgaatgttgattaagttactccatagatttcttttggtttgctgtatatgggtgtggtttcatttaatatacaccatgaccagaacttatttatatttcaatgattaagcacgtctacatgttacactgactatatattcatatttaggtcattctgtatgagttttggttcattaaaagtatttgtatcagtcttattttaacttgttcataccaatcaattcttaaaaaaataaagttgccatacctttattctttcaggcgaagagagctgtaaacactagccaagatgg

SEQ ID NO: 40547 - DNA, 210 bp, Oryza sativa
cctccttgctggttaaggtgatgtccgacgtccggcgacaaggcccgaagaagcgctttgcctcaaccgccaccggccaccgccgttaaccgccacggtgtcatcgtcctcctccatagtgtgtcaccgatctgtgggctgggatggtggatcgattcagatccggggaagttgtttttatcgaagtaaatcatttactccgataatagt

SEQ ID NO: 40548 - DNA, 1501 bp, Oryza sativa
ttagattgtttgagaggctaagttctcaatttaaaagcctgcatatatccagttgaatacagaggttgggtaaaaattactcttctctaaaaatagctaaaaagttaaaagattgactcggctcagctcaatctgtcgtgactatgggttcacaaaccgatctgaactgagctcagtacaagacgatcagagtcatgggctttgacttttttgttcgcccctacctgagcatctgtggtaaaacaaaccatgtagaaagagttactcctaagtgcgacagaagttgagtcctcaacattgttttgatctttgaggctctgttaacagtgcgcatgaaaaacagagtggtcaattagctatgattaattaagtattaggtatttttttttcaaaaatggagtaatatgattgtttaagcaacttttgtataaaactttttaaaaaaaacgcaccgtttagcaatttgggaagcgtgcgcatgaaaaacggagaggaagggagttgagaactagcacttacgaacagagccttaggggaagttagggcctatttagttcacgaaaagaaaatttgtgggtgtcatattagatatttgaccggatatcggaaggggttttcggacacgaatgaagaaactaatttcataactctcctggaaaccgtgagatgaatcttttgagcctaattaatccatcattagcacatgtgggttactgtagcactttatggctaatcatggactaattagacttaaaatattcatctcgcgattttccccctaactgtgcaattagtttctttaatctatatttaatgctccatacatctgtccaaagattcgatatgatgtttttagaaaaaacttttgggaactaaaccaaaccttagtaacgagcactcatctattacatagtagtaccacataaaaggttatatacatgcatttctttttgcaaaatttatagtagcatataggttataaatctacaaagttacatgacactccaaaaataaagcagaactaaaactaatctccatatttcccaacaaaaaaaacgcaaacttagttattggtagtgactgccaaaacatgcttgatgttttaaaacatgcaatcaaacaaaactctgttaatccaatctaatccaatttattgcttgtgttctgcgtactgcgaaactgcgtgatccgcggaataagcaagccgatgggccgccacgtggcacgcaaaaaataaggcccatcaggcttcaccctagcctgtgccctccggcccacgcagaaaattcttatgagaaaaaaaatgaagagggtttttgttaaaaccctgcgcccaactgcacagcccacccgccgccgccaccgcctgcgccgccggcgagagaccccggcccccgccgatccaaaccccacccaccacccgcagcggccatgtcccagctcgtgctcctccgccgcatccccgtccgccgccactgcggccccagcagcagccgcctcc

SEQ ID NO: 40549 - DNA, 161 bp, Oryza sativa
ttggacagtggatgattaatattgattaattattacaactgttttactgctttcaacttctgtttataaatgtccgctttatgcaaatgaaccattatagctaccccttgataattccctgcatcatacccctattccggtatgacttgctgagtacagtg

SEQ ID NO: 40550 - DNA, 248 bp, Oryza sativa
catgcctacattattaaatactactctatatccccatggatgacatagagtaatcgaatattcagaccttaaacccacaccactgcacctctctggtaagctaacccacaattataacaacatagatataaagtagaacctatactcagagaatgtaaactaccgaaagtatatccgctatgttgtattgatctgatgatatggttgtgaatatgcctttggagggctcccttcccatcttctacagg

SEQ ID NO: 40551 - DNA, 626 bp, Oryza sativa
tttttcccctccttgcatgacttcaggacttttttgggatggtttgaggttaacccaatcgcatcttaatggcaaagattttacatttcaaaaaacttgcgatagtttttttttaccaatacccaaccacgataagaccattgcttgcgtaatgttgctcctaggcagtggctccgtgtggcatgctacagcccgaggggcgaccacaattgctccaatagaagctggagtccaaattcctaaacacttttgaagtctgagctacggcttataagctaagaaaaataaatgaagcaaatcaaaaataactttagggtaaggtttttatacttctgttctttgattgaggtccaaaaggcaagctaaataacgaaaaaaaaaaccaaaatcaactctaaaaggtaaagttatagaattcaaattcggactgcagcttataggccaacaagcagctaacggccaatagagacaggcagacgtatttaggccagtgacagcatttcaaagtcaatcttgttcattaaggaatcgagagtttttctataaaaattctgtcaaaacatagcccgacaaacaaccgctgcacgcaccgcatgattccagaactcagaaagaaagaaaagaaa

SEQ ID NO: 40552 - DNA, 176 bp, Oryza sativa
gtaggcaggccggcagggcggggcgaggcggggcgcgtcgaggccgtccggccacacgcccacacccgaagacgcacacgtgcgaggccgggcggagaaggggcggcggggggcaccacagccgcagcgtcagcctctgcctccacattcgccgccgctcccgacgacgcacaagc

SEQ ID NO: 40553 - DNA, 230 bp, Oryza sativa
cctgcagcccgttttgtaatgactttaatattaaatatacagttttgtggtctttaaccttaaatctatagttttgggataaatttagtgctaattctatactatttagcctgaaattttctctaaatcttttccagttgtagtagcacaatagtaaaaagagcttcaatttcaagttgaataaaagaaattcacgaatttcagtttgaaagcacgataatttgggacga

SEQ ID NO: 40554 - DNA, 359 bp, Oryza sativa
atacatgctttcttgttcgttgagaagaatctccctgaaaaatattgaccacactagtactagcaagaaaatacatatgaaatacaacaaacaaagtgtacgactgcctcaaagacataccttagttggtgtaccgaaagtccttgctttgcaggtaatgctggatcaactgagagaaatggtgaaatggttgtgctttcagaaacaccagcattcttttgttgttctatccgcctaagagccagctcacatgtttcctgaacctccacggcaggatcagcagctaaactctcctcaagcaggggaatgctcttctccaggccaatagcaccaagggcttccgcagcctaatcaattga

SEQ ID NO: 40555 - DNA, 258 bp, Oryza sativa
atgggccaaaaataacaaaaacaggtagaatcgtgcgtccctcccggatacccttgtttgggtttattcgatccgtgccattttaaatatgtttatttagataaatatcattataattcgtctattcgtaatatcatcgtcatcacatttttcatctactctcctatctgcacgtgttactcacccgtcagatttattttcttcctttcaccctcccttatcatcttccttccccatgggtgagtcgtcgtgggcagc

SEQ ID NO: 40556 - DNA, 234 bp, Oryza sativa
gctgcaataaaataaatttagcatgttgattttataactttcttttgaaacctgttgttaaaaagtacaaaatttgtaaccttgttttcaactatttcaaattatcttgcaagtttggtttactttattcacttaccttttactttgaatttctaaactttattcaaattaatccaaaaacttgtgctattaatggataaaggtcttaactccctcctttcacttgtctttaga

SEQ ID NO: 40557 - DNA, 771 bp, Oryza sativa
ttttaaaaaattatgtgtcgtactgtagtagaaagagaagaaggggaggaggaagggggagaagagggaggagtatagggggaggccgggcaaaccgatcgctgggcgatcgccctggcgatcgatcgcccattagcccccctccttcatcgtagttcattcgtcaaatccaacgatccagaatcatccaatccaacgtcttcagtcgtcccacctacctcggttttactaattagcgcgtacgagacttctctaagtcgcacgcgtgccacgtggcggaccctcatcgtctgcgggtgggtatggtgggcaccgcaagttttccttttttttcctaggatttttttttggagatgcatatatccaaagtaactaacccggacagttttagataataacgataattaaggtaagaattttctttttttttcaagattttttagtaacagattgaaatggaatctatacatgaagtgaaattttgaaacctttcaacttgaaatttgaatttttttaagtcaaaatttgaaaactttcaacttttcatctcaaattcgaaaaactttcaaaccaaatttgaaaactttcaacgcaaaattgaaaactttcaactcagattcaaaaactttcaagtcaaattgaaaaactttcaactcaaaatttgaaacttttcaactcgattttggaaactttcaactcaaatttaaaaactttcaacacaaaatttgaaaactttcaattctacatttgtaaagaggtgtgcgaaagatt

SEQ ID NO: 40558 - DNA, 1501 bp, Oryza sativa
ctacgggtactggagtaaaagatgaggccaaacacacagtgtcatcttgtgaaaaagttactactatgacatatacacccttcgtccgaacgtataaacatttttgaatttcaatataggcccagtttagcttttaaaataaaatttttcacactatcatatcgaatatttggatacatgaataaaatattaaatgtagaaaaaaaccaattacacagattatgtgtaaattgcgagacgaatctttaagcctaatcgcgccatgttttaacaatgtggtattacaataaacatttgttaacgacagattaattaggcttaatattttaactcgtagttccttggtgggtctataatttgttttgttattagagtacgtttaatacttcaaatgtgtgtccgtatattcgatgtgataaccaaacccaaaaattttcccgaactaaacaaggccgcacagttttcgagatgctattttgacttacagtatctataaaagtaagatattttaaatgaaaagagttacattacatattatgatagtttgttgaatgataaatctaataacatcaattttacatgattgatgtttttcttttttatttgctattaatagccaaagtaaaaaaatgtttgattcgacactattttgaaagtgcttatattttgggaccgatggagtaggatagagctagctacgcatatactccatctgttccgaaatataataatctaaatcggatgggagattttcttatactacgaatctagacatataatttatctagattcgtaattatagaaaatatcatagatttatggatctggacagataacctatacagattcgtagttatagaaaatatcatagatttttatattttaggacgaatgtagtatgatgcaactctttactgtgcatgtatatagctttcaatatgggttttgtgatcagcccttacactttttttctataattttctaattcgtttgtagtcttaattttgtactcttcatttgtacacctaccccacggtcccaccttgacctctccgcctaacccctctcgcttctcccccaggccccagcgtcgtcgatcagcaagcatttgctgttgcgccgttgaggacctctttgcctcctctcctcttatccggccaccgccaccaccactgcctctccaccacattggtcctctcttcagcacggctccgccgtggatttcatcgccatgacacgagacccccgccctccgcccatgcacggcggtggtggctgggagagaaaaaatagaatggacgaagaagagaaggagaattgtcactaacatgtggacctcacctttttttaattttttttaatttgtcacttacatgtgggacacacttatattttcaattcctttgatgactaggctaccctcacaatagaagaaaagagatgcaaaacgaagagtaaagaaaagaagagaatatataacgattatagccgtgcatgtagt

SEQ ID NO: 40559 - DNA, 1501 bp, Oryza sativa
  unsure (1)..(1501): unsure at all n locations
cacatgaaaaacatagaaatgactgtttgattgaacagtaggaaaaaatatgaaacaaaatagagagatatactcaaaggaaaatttctaagagctttgaactcttgctaagttttctccaaaatctctgtagaattgtccatacaataggagtttcaaagaatcggataaaattcaatcttttgattcaaatgcactcataggaatttttctataggattgaaaattttcaaaattcctatgttttttctccaaattaaaggggccctaagttttttaagggtctatttgtataataagttttctaaaaggatgaaaaaggtgaaaatcccaatcaggggtactatgttgcaaaagggtcaggacgtggtaaaagtgatgcaacagtaaaagcgagatgaaaaagtgactggtgcgagtatttactgctgctactcctattcctactcctactcccatggggctagtagtagtagctatagcctacagctagtacaacacccacgcgtctactactcgtgagggcacttacagtgcgtcaccaatttttgaggggcaacactgccacctactaagaactttacaagcgacaacctccacagtgcatgtggtcttctttttccttcacagtgggtcccacccttctctctcctcactttttacctcctctcctctctctccctgccttccccaaccaggccacaaaactgctccgtctagtgcgccgccggcgcctcccacacaccgccgtcgcccctctccccctccggatctggcggcccgccggcggcgacacggcgcgggagccggaggcggacgaccctgaggcgatctcggcgaagggcgctagcggcggacgaccccgaggcgggctcagcggagcgcgccagcggcgacgcggcggagacggcggcgcgggtggcgacggtgccgaggcagccaccctctcctcccccgaagcggcggcggcgccgccgcgctgcttcggcttcgccttgggcttcttcgacgaggaggacgccgcggcgccgcccttcggcctccccatggcacgggcgcgtctctctctctctctccttccgggcagcgcttgctgacgagacggcggcggcaggcggctagatccagcccggccaaaaaaaaaacgtgtnccngagaacaganccccagagaganaaggtatggcgtttgtgggtttggcttcttctctgcttcaacggttggtcgacttcaatgcaagaaagcatcggcagcaattgctcctcccgtttagttagtgtcgtccatggcctccaacgaaggtattcttctcttctttctcaaatattctgtttctcgcatatatgtttgctccttttttttccttcttctgctcgcttctctcttcttctgttcgtcttggtgatgacgaaactgaaggagtatttggtgattgaatctgcagaggccggattcccttctctcctgtgggatgaactcaacgacgacgcggggcaggatg

SEQ ID NO: 40560 - DNA, 1501 bp, Oryza sativa
cttagtcggcaaaaacttgacgctgcccctacctggcgcgccaactgtcgaaacaagatttcgacaataataaaagggggtagctatcaagttaggaaagtggatgggtttggagacaaggaattttatacaggttcaggccttcttattcaagaagtaataccctactcctgtccggggatgattccgccgagtgtgttattgattgtataaactggaaaaaagaaccggcccccaagaggcacacggaccctccttatataggggaaggaatccgctttacaaaatatagtccatatcctaacggaatatgggattatagataaaatacaatcgtaaccgactaggatcccgggtatttccttgacatacaagttaaaaactaacccgagtccccataaagatattctatctatatttggtaccatatatccgactaaagtataactgtcatacagatatggggtatccataatctccacagtagcccccgagaccttcgcagttgacgaaataaccttctcgaaacaaaaaacaatagtccgagtgcttcaattcaacttgctctagcttgccgagtactaaaaatcaaaaactgtgaagggcgaaaataaaacatggtgcatcgagtagatgcacctaattaggtgtagcccccgactatgtgattagttgaaaaactaaacatatagtcaagaaccaagtggttttatagcgaagcacgcatggtacttagtaagatacccagccacctgcttctcaacttgaacacaccaaggacaaaaaatacaagaagggccgagtgataaacactcaaaggtccagaaatagacatgtttgataggaatccgggtaaaaatctcataaaatgacccaccaaacatgatagaaaatcatggtaattaatgagtctaatagcttaggctgtgacccttaccataaccaaaataagcatataacatgctaaaagaatgactattaataaaccagtcatctcaaatcaacccaaacagcttttgcaacctaataaagcttacaaaaaaggatataacacctttctgtcgggcacctttttatgtgcatcataataatttcaaagaattattaaatcgcgttaaaaaggattttaacagcattgggccacaccattgtgaacacaaattgccaaagcaaaaagtgcctaagtccttagggatcacaacaggccacgctgattatagtattgggctgaagtactgtacaggcccaggcccattagtactcccgataccctaataataccaaagtgaaaaacgtctctttgtcttccccgccgagactctcgccattttccccatttcctgctacagtgtaaaactgcgccgggcaaactagggttcatcaatccgctccaatccactctcaaaaactttacaaaatttctccccgcatccatcgctccgattccccatccctttctagccatatctcgaactaaatcagaccatccagttcacattca

SEQ ID NO: 40561 - DNA, 256 bp, Oryza sativa
atagctgtcgtcgaagttgtcgaggtcaccgtggtcgtagtggtagccaaagtcgtcgtagtcgaggatctcggttggtcgagaactgacgccgggggagctgaggtagccatccaactcttccgtcgagactgtcccaagaggttgaagtataacgccaacctccctggatctagatcggatcggggctaaagccggagctcgcctagatcttcgagtgggagatgtcttgactgtgaagacagcggccaaatca

SEQ ID NO: 40562 - DNA, 1501 bp, Oryza sativa
gtgaactggatggtctgatttagttcgagatatggctagaaagggatggggaatcggagcgatggatgcggggagaaattttgtaaagtttttgagagtggattggagcggattgatgaaccctagtttgcccggcgcagttttacactgtagcaggaaatggggaaaatggcgagagtctcggcggggaagacaaagagacgtttttcactttggtattattagggtatcgggagtactaatgggcctgggcctgtacagtacttcagcccaatactataatcagcgtggcctgttgtgatccctaaggacttaggcactttttgctttggcaatttgtgttcacaatggtgtggcccaatgctgttaaaatcctttttaacgcgatttaataattctttgaaattattatgatgcacataaaaaggtgcccgacagaaaggtgttatatccttttttgtaagctttattaggttgcaaaagctgtttgggttgatttgagatgactggtttattaatagtcattcttttagcatgttatatgcttattttggttatggtaagggtcacagcctaagctattagactcattaattaccatgattttctatcatgtttggtgggtcattttatgagatttttacccggattcctatcaaacatgtctatttctggacctttgagtgtttatcactcggcccttcttgtattttttgtccttggtgtgttcaagttgagaagcaggtggctgggtatcttactaagtaccatgcgtgcttcgctataaaaccacttggttcttgactatatgtttagtttttcaactaatcacatagtcgggggctacacctaattaggtgcatctactcgatgcaccatgttttattttcgcccttcacagtttttgatttttagtactcggcaagctagagcaagttgaattgaagcactcggactattgttttttgtttcgagaaggttatttcgtcaactgcgaaggtctcgggggctactgtggagattatggataccccatatctgtatgacagttatactttagtcggatatatggtaccaaatatagatagaatatctttatggggactcgggttagtttttaacttgtatgtcaaggaaatacccgggatcctagtcggttacgattgtattttatctataatcccatattccgttaggatatggactatattttgtaaagcggattccttcccctatataaggagggtccgtgtgcctcttgggggccggttcttttttccagtttatacaatcaataacacactcggcggaatcatccccggacaggagtagggtattacttcttgaataagaaggcctgaacctgtataaaattccttgtctccaaacccatccactttcctaacttgatagctacccccttttattattgtcgaaatcttgtttcgacagttggcgcgccaggtaggggcagcgtcaagtttttgccgactaagtgcga

SEQ ID NO: 40563 - DNA, 1501 bp, Oryza sativa
tttgtctgttcgatagttttctttgttcacctaccgtttttttagcacgtagtttcctacgtatttctcgcgtggaggcattttctaaccggttaaaaaggcgtttggctaataaccgccggcttcgtcgtaactaaggtataaggtatgttcttttatttttcctttaagtttccatatgttgtttatttaactattgatgtgactataattattttgtttttagggcatatttttccagttaactctacaggtatatttacttgttcatctgttgtttttctaaagagcatgctcattttcttaaaggtacttctttttctctcttttttttaggattttctatttattacttagattctttttacactttcttattgtggtctttcttttgcttgtgtatagcttcttattctggccgctcttactatggaggttctgattactgttgttctatatgttgtgttgtcttttggtactatgaaaggacacaccagaacaagccccatcctggagagcctattgtttacaataagtgttgtcgccgatggcgtgtttcgctacctattttcaaggaatggcctcatcctttgggagaacccatgcattttgatggttctagctgttctaatcattttatgagacttatgctttcacttcgtttggtgttgatgttgataaatctattaacactggagatggcctggccttctctttcgtataaattcatccaaaagctgatacacgcgcacctctaagcatgtttttcctatagaccaaaccagaactctaaaaaacaccatcagattttaattcaatgctatatacacaaatcaaatcactgttgtgaagtatacaccaaattagaatcactgttgtttgttcacacttccgtgcggcgtcacgccgcgcgaacccgtctagtaatctccaatcatcacaaactcaggtcgtgtttagattcaaagtttgaaccccaaaaacatcacatcgaacttttctacacataaatttccaacttttccgtcacatcgttccaatttcttcaaaaaataatccctattaattcttttagtttgaaggattcaaaccaacatacatgctaataagatataaagtaattttatatttcttatggctagctttaagcttaagattagccatagtaatattctcttccaaacacacctttctatgtataaagttgtactaagaatattactccctccgtttcatattataagactttttaaaattacccatattcatatatactaatgaatctaaacacatatatatgtctagattcattaattatatgaatgtggctaatattagaaagtcttataatatgaaacggaggaagtattttattgcttatggtcaccattacatgcatattagagatgcccttatagcagctacaataactagcgataagcctgtcacatcagttttagcaattagcagtgagttggaggtgagagagtatatcaccagg

SEQ ID NO: 40564 - DNA, 663 bp, Oryza sativa
acacatatagttttacatatttcatgaatttttttgaataagccgaatggtcaaacacgtgctaaaaagtcaacggtgtcaaacattttgaaacggagggagtaataactatactaattgagaatcacttgtatagatttataggattcataattaataccttgaatgaatctgctaaatatattcaaaatccaaatgacgatagaacaatcagtttagtcgatcaaatgctatttcacatcttgctttcagttactaatcaaacttttgaaatcattttaaattttgagttaaggttttacacaaaacaattaatccatggcttagaattataatcatttttaaacaccctaaaaatagtcatttttgaacttaaaagttttctagtgcaaacaatatggtacacataacatttactatgaatattacaaactttttagaaaattctaatgtaaaaggtcgtgtggctggttacacgcatagattgcgtgcatgttaacttccaactgataattatttctcgctatactttccttgtttcataaatgaattaaatttacaaccatgtgtaaattatataaaatatatgaagtcattttatttttgtttacaaaacatattacaatttatttgtacatattatacaacttaattttccacagc

SEQ ID NO: 40565 - DNA, 1501 bp, Oryza sativa
cactgtcagactgttcatctaagtcattgctcggcaacttgtcactttccacaggacctgaaaaattttggttccaattcagttgtccattgactccattcaacacatacaagccatttgaatcacagtgtaatatcataaaggaaaccagtgtcaaattaatcctaggtatattgtaaggctacatatcaatcctagcctcctaggtgttgcaagggcacatatgcatcaaccatcaatgttgagtaaaatttgcatctggttcagagttcagacaacataccattttcctcaaacatgtttgatggtaagagccaggagtgaagaaattgtgatgggtaacagaagtcagtgcgcatctccaagctcttggacatcaaaactctcttggaacgtatgtcaaaagagaacagcacatcttgttctataaagtatagtacagcacagtctgtcgggtcaatcatagcaatggcaggaactttgcccggcgtcagcccggaggtcttgtagatcttgtcgccccatatgtccgcaagaggtgccttgtactcaagctgccactcggggctctcactctcagaatagagtaaactccataagcaagcctctccttcatctaactgaacgtagcatatcttgtcttggctgatcttgacgcaacgccgcttctcaagattgtgacgcgatctgatgtcggggaccagcataaggcagccttccggaagagccacataagtcagcttgggcttctcaatgaacggatcgcagaaaagaagtcccaagggcaggtcgacgaaccaaatcttgttcatatggcttagcacaccgccttgactgccccaaactgggtgttgcaagcagttggtaaggggcttgacaacccactgggaacctgaggtgtaagtccagcagcgcagctccatgaactgcgggctcgaattggtgcaaacgaggcaagcaaccatagtgtagtctggtcgaatcggatcttggacgacgccgatgcttatgactgggggaatgaggcttggctccatgggggggattggcggaatcatggtggcgactcgtgtgtgcgcgtcgcagaagtagcgcacgccgttgaaggcggaggcgacgaccattccagacccgtgtacggcgacgacgaggggagtggttggtcttgggcgtgacaggttcacggagaagggcttggcgcgaggtacgacgaagttgaagaagccgatggccttgtcgacgtagaggacgctggtgccgggtggcttctccgacttgaacgccaaatcttctccgggtgggagatccttgacgcgggttacggcttgcagtatgacccacgagcagcgccgtgcaggagcctcgtcgtcctcgtcccgagcccgatcccgatcccgctgcgcgtcctcctcctcctccttggtagtcagatgatgagctcccggcggtggtggtgacgcagcgcctccccccttgaccatcggagtcggggtgcctccct

SEQ ID NO: 40566 - DNA, 711 bp, Oryza sativa
aatgtttctacttttcagcaatttggctactgaaacagaaacaaattatcaacaattccttctcagatatagttgtaaagatatttatgcatcatggttcaattgcaccttatgagtattgacatgaaaatggataagaaatatcttgcagagatgcttctactctgagtagcagcagacgtttacctgcatgataagcttccgcatccaaccagtagatgaagaaacacaaccaaattccactgcagaaatcttgcgtttgtagcaaaattccacacacggccttctacatattacttttggtgctcctcatatgcagcaggtgctttatatttcccttaaccagttgtcctggtaaaaagcaaaattaagacgccacaacatctagtcatatgtagataaatatatcattttagccaactaaaggtttggataaaatatcaagcttagcctacttaatcatggaagaagatttcagattcaggaaacagtgtttcttttacagtgagcaattgtgaatttagagagaacatgtaagcagagtctacttgccaagagcacctatcttatcataacagaagcgattatttcagaacatacaaccgtttacacgctagaacacctatcttatcatagtagaaatgttttgtgggcaaacagttctgttcttcagaataatgggatattgtgttgaatttcccttgaaacagt

SEQ ID NO: 40567 - DNA, 289 bp, Oryza sativa
tgtaatagtatctatagagtttaacagattgatttaagacagtattatgaaagtaacagaagtattatgaaagtaaccgatgtgacaatatttagagcaagagaaataacgtactagctaatactctagtacaaacttatatagacagattgatccatataaacatatcaaatagaaattaagcatgaagttaggaatctaaccgatactgactaaagcttgatatgcttatataaaacgatctatctatataagtggcgaatatacattaaacagggggggtgaaaca

SEQ ID NO: 40568 - DNA, 586 bp, Oryza sativa
tggtgatgctgcttgttaatacttaacttgattttgtgtgttctcttgtacccaagggtattcatgtttgaaagctattctagtcaactataccttatcttttggtgaaaattaaatttgttctctttacattgtaaccatttgagaaatatctgctattccagcacttgtttgactgctatgctgtagagatgaggagaaatgatggttctattcgctggtgccttgttatatggacattgtgtttgtatgatagctgcatgcttttacttaactcatttaagccatctatatctgttaatgcttttgccagcttcaaaacagtatgctgttccaaaaatctagtgtaattgaccattaatgcttcttccatagctcctttttaaccattttaggtccagtacacttcctattggtcctgatgtgtcagaattgttgcggtatcagtatcttatattgtgctgacatacatttgttgttcagttaccctatgactatctgaaaataggttctataatatatctgctgtgtcaaattcttttcttattagttgcattagctcatggtatattgttaaaactttgca

SEQ ID NO: 40569 - DNA, 933 bp, Oryza sativa
cgagtcattgctatcatatgtcttagttaatctatttttagcttctcaatttagctctatcggtcgtggctcgctttagggtttatacttgtttcgattaaattgtcttgctagattagattagctaagacatctaccatcctgaaaaatgtctaatttcttgattgtctagactacatgttccttttcatactttgagatgcatcatccctagtcgtgcttggatgcatgcaaattagcctgcaattaggcattataagaatagtattggggtttcagccgatcttacccaatatgcatgtttcaccccccctgtttaatgtatattcgccacttatatagatagatcgttttatataagcatatcaagctttagtcagtatcggttagattcctaacttcatgcttaatttctatttgatatgtttatatggatcaatctgtctatataagtttgtactagagtattagctagtacgttatttctcttgctctaaatattgtcacatcggttactttcataatacttctgttactttcataatactgtcttaaatcaatctgttaaactctatagatactattacatccgattgggcgtgtttagggtttattattctttgatatatccagtccatagccaatttggtctaactccatcggctgtgaccatcaacgatacactatcggcctatcggccgatcagctatcggttgactgattctgcttttattctttcttgctgattgcaggatcaaatcaactgacacgcccttgacacactcgaggctagccttggacctgcactggagttaagcagatctctcatgccaccgtgttttcgcatcaacaacgctgtagtagtaacatctcggaaaaagtatgaattaccccctgaagaattgtgagtacgaattacccccctaaacctga

SEQ ID NO: 40570 - DNA, 1501 bp, Oryza sativa
gcggcagcgattggagcggcggtagcggccaggactagcatacgattgaaattttaatgttatggttaatgagattattccatgtatgccacagactaacgactggtattactctctttggttcatattataattcgatttaattatttttccagttaaattgttttatgtttaattaagtttttaataaatatagtagtattttaaaaaaacgaatatgttgttaaaatatattcaaagcaattataatatggagtaaaaggagtactaatttagaaaaaaacgaaggacagaaaagaaaggaaaggaaaagtaaaagcaaacgacgattcagacagacaggctcccttccatgcctccccattgctcctactctcccttgaggccttgacccacccccaggaaaagcaagggaagcatgcccagcaaaatcgaacccacaaaacctcaggaattaccatcgcctagcaaggaatcaacaatccgtggtcaatccatggcagatcaggatgtggccgagccatggggcttgtcggcatggccccccttgacctccctcctcctccgagccatgaggaagcggcgcacctgggcggccctcttcctcgccgtgtacgcctctctgctctgctcgtcgtggcgcctggtggagtccgtgcgcgcctggtactactccgcggccggcggggctggcgccgtcgcggcgtggccggcggctttctacgcgtccgtgatgtacggtgccgtcttcgggctcctgtcgatgggagccgcgttagccgtggcggcgccggccatgctcatcacatggatcaccgtgttggtgctactcgcgttcgccggaaagccgcggaggtcgctggtcgcagaggggcggcgcgccacggccgatatcgcgcggctcgcgctccgcgtcttgctgcgcgagggcaacgcagtcgctgcgctctgcgccgccgccagcttcgcggccctcctcctcggccgccgcgacgacgacccggcggaggggagcggcagctgatgtgacgcttcctgcaaaattgttcaattccatgtttttttctttcagttaatatccgttttggggtttcagtgtttcaccaaccacccctccctcaccatccttttttttttctgtagaggtaaattatggagaaaaaacagattaattaacagtactacataattgctaaattgcaatcacagtgttgatgccgtcttttctttgctttgctttgtgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggca

SEQ ID NO: 40571 - DNA, 331 bp, Oryza sativa
ttcctgcagcccaaaaaaaaaagaacaaacatgttaaaaatagtaattctagagacaaaagcagttgtaaaatcaatttttttataatataactgagtgcagatacactgtaactatttgtaagtgttctatagtatatataagcgttttgtaaatgagtgtaattgtaagttgggtctacataaatataaatctttgtgcagatcttacagacaaaaaataaagaggctgctatataatggaatcccgttttcgaacggaatgatcccgagtaggtaacaggtgtgatacctatcaagtatcagacgattctacacaacatgatgatccc

SEQ ID NO: 40572 - DNA, 338 bp, Oryza sativa
agtgaaataaaagggtgaaacatacatcgcttgtacccttagtcaaattttcggggataggctgatgttcaacttttcgattgatgattgtagaccctgcgccaagttctactttcaggactctaaagcttgttcctccaagatcaatggcataactgatgccttcctcgctcctggtcatgtcatgtgaactactgtaagacaattatccaatttcatatttcttagagaacttgtccacaggtggtagaatgtgatgcaatgactaatagatagaccaacatatcatatatgtaaaaaatcataatgatttcagttagggaaaaatatgatatgca

SEQ ID NO: 40573 - DNA, 374 bp, Oryza sativa
ctacgataagctgcggtgccttcctgcgggccttcatagacttaccaacctcaagagattaatgattatgaactgtccatccatccagtcactgcccaaggatggcctcccaggttcactgaaatacttcatagtccgcgacaacgagaagctcgtaaagcagtgcaagaagctcaagaaaaccaacccagaaatcgaactaattctctagtgcacgactaataaggtaatagatgcttctatgttcctactagttcctaaatcccacaattacacgtcctttttcctaaccccatccatcacatcgtttgcaggggggtgatgaactagtagtgcagtgctgggcctcgtattggagtgccctttcttttagc

SEQ ID NO: 40574 - DNA, 1501 bp, Oryza sativa
attataaaaaatatgatataacatctgtagcccccgactcactactcaatggaagaccaattggtgtagtgaggcagaggaaaaggaaaaatatcatataaagaataaaataaatgatgacttagctttgtcgtattccctcggtggcagcagaagtagccgatgtgggaacgaaacagtccatcaataacaatgaggacaccagtcggcggcgacgaaggcggtcgacggtgaaagcgaagatgcccaccaacgacgacataataggctagccgtgtcggcagagacaccagtcggcggcggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggcggagtggactcgcggccaattgaccgaatagctgggacgtctcgagtccatgaccagcatagatcacctagcaaagtcgaagattaaatcattcaactcgccgagattgatttcctcgaccggactcactccgagacggagaaaattggtcgttggtgttgcactgtgtcactaggactaatcaagcaatcgacactgagatggtgaggcctccctgcagcagtagaagcagccagaagaatcggccagccagccaaaaaaacccagattgatcaaattagtagcaactacagaaacaactcaataagtatatatgttgatcgatgcatgcatgcaaatatgcaacatgggtttatccatcctcttgcaggtgctgaacgtgcatgcaagtcaaccctgtaaagaaccaatagtctttgaccagggccagggcgagcacacagcggccggctggactcctgacgtgatgcagtgcacccggcggcaactctcgcggcgccatgtagatggaacagttcgccatgcacaaaatcgatgcgatagcgatggtgtgcccacgtgcgctgttgagcatgtcatctcgcaaaacaaatcatcgatcaatctgttgttagaaattaatctaataataaaataaattggagcggcaaacccggatgaagatcaaagatttgacgagccattgaacacgttgaaattgatctcaacgtttcttttgaagttaattccatcgcacttctcgacgggtaatacgacgcaacccctacctggcgcgccaactgtcgaaacatgaattcggcaataataaaagggggttgcgtacgagacctaaagtggatggatgcagacacaaaggatttagacaggttcaggccctctcgatgagaggtaataccctactcctgtt

SEQ ID NO: 40575 - DNA, 218 bp, Oryza sativa
ttatcggaccttccgagccaaaaacaagggatagttttcataaaaatcgctgactcccaataacattcggtcaaattttataaaaataataataataaaatggtctgaattttttaaacttggtcgggaactaagcagttcgcgttctcgagccagtccagtttttatggaaattgacaaggttttgtcaatttatattaaactagaaaaagtgccca

SEQ ID NO: 40576 - DNA, 703 bp, Oryza sativa
ctccttcaagttgaaaattttggggaaaaagcttaagctctggagtaagaatctgtccagaatcatgcttctcttgaataactcaaataaagtgatcgattttcatgatcttctggaagaagacagaagcctctctttatttgagtggaatttcaggaggcagttaagcatcatatcttaaaacttttggaatacaggaaaatatattggaaaaaacattgtactaatagatggatgatgctgggagaagaaaacaccaatttgtttcaatctattgccacagaaaggtacagaatgaacacaatttctcaagttttgaatcaaagtggtcagatagttaacctgcatgatcaaaaggcaaacttgttctatcaaagtttcaagaataggatgggtatctcttgctccccaactatagatttcaatttgaacgagctttttgttcctagaatagatttggagtgcttgattgacatgttctacacacaagaaattgataatctcatctctataatcccagttgacaaggcccctggcccagatggtttcaatggttatttcatggaaaaatgctagcatatcattgcacaagatttctacagacttgcagctcattttcatgctgagtctacagatttacagatcctgaattattcttttatcactcttgtgccaaaaaaaccctctccggaaacagttaatg

SEQ ID NO: 40577 - DNA, 1501 bp, Oryza sativa
tgcatctggccccccacttgcaactgcaagctcaactggctgcggcccaagtacatcctcaaccacttggccaagtgtcgcaagcaatggcagaaggggcttcggctctgcaggcacaattccaagctttccttcaacaaatcaatcaaccccacaacatttcgagtacaacctcctcgactcgtccagaggggaatgcaagtcaaggtgctctcagttggttgccgtcgaaccagccaagtctgggggcttcgccgtggagtcaaggaccgcagttcaacttcatcaatgctgcttaggcgccaaccgttcggccgcaagcaccaataccaagctttggaacaaagcaccaacccaggtcgccatgatgtggtcgcagccagttttcgacccatccatggcggctcagcaagcattaccaatcggagccgggcagccgaacaccatggcccaaactcatgcgcaagccgtaatttcgcccttcgccacgccgtacccgcagcaaggtgccgtgaacagggcgggaggcaaaaaggggctaccgctgagtgggggaatcaagacccgtccaatcccaccgtagttcaagttcccacccgtcctaggctactcaggtgaaactgacccgaaggaattcctatccatctacgagtctgcgatcgaagcgactcatggcgacgaaaatatcaaggcaaaggtaatacatcttgccctagatggcatcgcccattcttggtacttcaatttaccagccaacagcatttactcatgggagcaattgcgcgatgtttttgtccataactttcgaggcacctatgaggagccgaagacacagcaacatcactcggcattcgccagaggccgggagagtcaataagggaatatatgcgtcgcttctcgcaagcccaatgccaagttcaagacataaccgaggcgtcggtcataaacgccgcttcggctggtttgctcgagggcgaactcacaaggaaaatcgccaacaaggaaccacagacacttgagcacctacttcgcatcattgacggtttcgcaaggggcgaggaggattccaagcgacggcaagctatacaagctgagtacgataaagcctctgtcgccgctgctcaagctcaagcacaagttcaagtcgccgaaccacctcccctggctattcgccagcctcagccggtgatccagggacagccgccaaggcaaggccaagcccccatgacctggagaaagtttagaaccgaccgtgcgggcaaggctgtgatggttatcgaagaagtgcaagccctccgcaaggagttcgacgcccagcaagcaagcaacaattagcaaccggtccgcaagaaggtccaaaaagacctctactgcgccttccacggacgctcttcgcacaccacggagcaatgccgaaatattagccaatgtggcaacgcgcaagattcaaggccacagcagggagcaactgtcgaagctcctcgagaagcagttcaggagc

SEQ ID NO: 40578 - DNA, 1501 bp, Oryza sativa
  unsure (1)..(1501): unsure at all n locations
caaaagagaccctgtccggtccaggtgagccctgcgtgcgtgtcacgtgctgccgctaagctaacggcgttaattggtggcttttccgtccgcccggcatcagaagcttcgctaacggcgccgtcatgggacggcgagccccagtgtggggcccacggtggcaggtctggctagtgtgctatgctcacctcactagggtgatgggtaggctttggctccatcacctttgtcattttcttttatttaccttttgttttacaattcatatattggaaaattctaagctgcccttacatcactatctacagtagttggtgttaaaataataaaaaatatttatatatatagtttttttatgtaaggattgatttgaaaaatgtgtctcagcataaaggttaataggtttagttttgcttttaataggttaggttctattctagtattatgtaaagcaacatcatatctacatgtcattgttttgattttatacataacacagttaggacaataaaacacaaccagaagctaattagatgttacttttcgttttacaattcataatttggaaaattctaaccgccattagaacactgtctacagacgttaggtgttaaaatagtatggttgattatgaggatcgttataaaaaaatgtgtctcaacataaagattaataggtttagtttttcttttaagagtaggttggattcttcattttaatatgtatactaatgtcatatatacactgtcatccttttggttttatccaaaatataatttatatagtagaacagaatgacatgacaaaacattgattgagttgtgtgtcttattatccaatcgaagaagcgtgttctgaagcttaagcaaaccctacatttcttgtacggttgcatgtctaattaaaattctcataattcaagatttaaccccctccagaatccttccgcgcattcaatcaaagtcaaactagaaaccacaaccactccaaacaataccctatctaatctaagctagggtcgtaaaataagacaattcagtacgactattaatacaggttcagtgagcaacccattatgtaccgttgatatcgtcaacattactcgttccccgaccgcataaattccgtcattccgattaatcgacatcgactcttttcaccccaagagtagaagaaggtgaaaaagaaaaattacagtgctaggtaaaataccaaaaantntannggnntnnggnnttnaaatgggnntggnntannnccnccaatgttataaaaggggggtgagttcaccatgggaggtgaccagaatcactgcagcacactggcaaccgtataagcccaccgcagtctcctcgcttcacacactcctcgctccactgccatttcccgcgtagccccctcggcttctcttacatttacattcaggtcctccccccctcacggttcttcacgcgcgcgagggcccctttgttttctcgtatttacaaacaggtccctccca

SEQ ID NO: 40579 - DNA, 205 bp, Oryza sativa
ccaaagtgcaaaggcctatcctacatgggccaggaaactcacactgtactttgggccttacaaaaagcacagctacctaagctacccttttcacgaattttttttattaaaagttttacaaaaataattttccattttgaaaattgacggaagtagtcgcctaccgccctctgggagggcgatttttaaaaatcgccctcccaga

SEQ ID NO: 40580 - DNA, 1501 bp, Oryza sativa
tatagttgaatcttgggagcaaatttttgtggcaataatctagaatatactatgcaagtctgtgaaattatgcatatgaagggtttgtgtattaacatatacatacagtgtaaaggaaacgaataatttacaaaaagatttgttactcagcaaacagaactcctgaaaaggtacaagttctaagaagtctctacttctgattcatcattaatagcttccttttccacattgccagcaacgcgcttcaaccgggaggcagctttgtcaattgccaagtttagttggcttatcttgtcgcccagtgtttgacgggttttctggatccaattcatagttttagttgccagaaaaagcatgttacaagtagaatagtccagcgatatttttgatttcttacctctaaaccttcatcataatatcgaccataccgtggctttacaaggccatgttcatcagattcactgtcttgtccattttcatctaataaagaatctagcgtcttgctgatctgctcaagaacgctatgttgttaacaaccaattccaaattaacaatctttgcaaaccagataacaatagcgccgagcatgaccatagaagactaacacaaagcattgcttatgaacaacattattatcggtgaatagtatatcagatgcataacttttagttagcacttagcactccacctagtcaactcgagcatggatatgttaggttgttaaaatcagaaattcataatcttctaaattgctcaacaagacattggctattcgctacagcactagagagtaaggcagtgtattgtaaaataaacatgatgaatcaacatttgatatgaggggtttctttatctacttcacatgtgccgatgccacgcataatttttttaaaaaggtttgacaaaacctgaggagcaaagacatatcccaatgttccgaagattgcgccccctataagaaatccagtcaagaatcctcccccacctttagaatcttcactgtacaagcaaatcacatcaactgtcacaggacattctgacaaatactataatcatgcagctgaaaacatattatagaagaatatttgattacaagattgtccaaatgtaacaagacctatccaaagaagtgcatgaaggagaatatgccatttaatgaagcagctccccagactccactatctaaaagttacaaagtaaccaatcagcctacttgcaatggtagagttgcagcaatcattttctactgaagaatatgatgcatcaaaccaatggccatatccatcttcgataaagatcacagtaattctgttccattgtggcggtgttcgactcaactgtgattagaaataggacatggggatatagaatcacttgagtttatgactccaattcaactatactgcaaatccacttaggtaataatactattattattatgttaagagggcactcctgtcattcattctctagtctctaccatgaaatgctatatctatct

SEQ ID NO: 40581 - DNA, 819 bp, Oryza sativa
ccgtcctgctggtcctactaggtctccggcacaccagccgcttcgcatcgttggcgctggtcctgcctctccccaccggcctcctcacatacacccacctccccgctactgtcgcggcgccagaggacgggtccgcgccagccgtggtgaactgggcagagacggcgaggccggcgacgacaacgatgccgtcgcggcccgcctcgcggagcacgaggcgggcggcggcgcaggaccgcgcgcccaccggccttgcccaacggcctcctcccctcctgtcggctagcctacgccgccctcgccggtggcctccgctccttcccccgctgccctgagattagagagagtgagagaaatgagaagaggggaaaagagagggtaggctgacatggcacgatgacatgtggagcccaggtgggtcccacgctgacttagcggccacgtaggacaaaactgggatcaaaatcgtcgagggacctatcgtgaccggtttttgtatagttaagggacccgcggtatctggttttacggttcgaggacgtttttgtatctcgatgataagttgagggaccttcggtgtactttttcccttctgttggaatgagttcgctttaagttcctcgtcttgaactccgggtttgaatcgtgtccttgaaccgtagcaccatatataatgcgttcttgaacttgccataccgaggtatccaaggtcctagaacagtattgtcgcgatttcgactaacgtagtagtgagtggccctatgtggtgtcccaggacagtattgtcgtgatttcgactaacgtggcactgagtcaaca

SEQ ID NO: 40582 - DNA, 1501 bp, Oryza sativa
ccagtacttgcttgatccacttcgtcgacccattctcggtcatatggtccacgaaaatttttaatctccattgaaatgcacaggcaatctaaagtttgcaacgggacaaacaattgactaaggatagactttcaaatttgccaccaagctaactttcaaaaaaaaaatgttaccatcaagatatatgttgccggcttcgacacatatatagacataacattatgttttcaaaaaataagaaaaaaaaacataacattatcacaaatcaatgaatatggacgtcaaaattcaccatatataagcatcgatcctggctttttttttatggtggaaatctagctacttggcaagtcaatattctggctcgatcgtcctcgatcttactggctacgtacggtaatttccactggtcacaaaaatatgttatactattctggatatgattcaaatcaaacttgttgttttttacgtggtttatatgccgcagcttgagtatatctcacccaatgacccaaacacttgataatgttacgaatttattgtctacttttacaaaagaaaaggaaagaaatttagtgctgaaagttacaattttggcactaaaatatccaaaaatggtatgtttttctgtggtaagagaaaatgacccccttttttttaagaacggtataagggcatgtacaaaggtagagtcggatatgagctctacgttatctagagactagcatcctacaacagttagagacaatatggtctctaatcattaatgtatcaaaatattttttcttacttttctttcctttgtttcaccatcatgcaaaaaaatttgctctaataaatgctaagagtcgactctgagccgttgtcatgtataacaaccatactcctttctctttcttctatgtcaccaaatttacttgcatggcaatagagagagaccactaataaacaccgttgtatatgccctaacacatgaagatgcttctatatatgcatgttttcgttgatgccggtgcgaatctagctgagaatatcatctggatcagcaccattacatacacgatgaaccttgaactgaaaaaaataatgttttaccacaaaacatttggaaatttcaattcatgcggtaggctgaccccagaatctagttagtttcatcctgagcagagctagcattcactagcggatctagaaacattttaagtcccatgcaaaacccactagcatagataatctgcattgtacaatactctactaaacaaaagatttttctggacaagcatcttaataggttgcagtcgagcgataagtgtctgaatctgaccagttgactggccgcaagcgatatacattatcgtgtgtggtcgcttaagagatccgcacataataatgcagccgcatcacatgtggtcctcttaaacgatcgcttaaaagacctgcatgcgatcatggaccatatatccatcccctagaccgagctactaccggttgaacctgacgt

SEQ ID NO: 40583 - DNA, 492 bp, Oryza sativa
ggtggggctgcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaatttcagtgaaaaaaaaagaagaaaggggaggagaagagaagaaggggcgaagccctgccggattcagacgccgatttcaggtaatattcataaatcctatatgtgactattgagttaaatagtgtgtattctttaaaaatttgtttgaataaatgcattatatttttagggttttagttatactaatctagaagtacgtattgtagatatcggtaactacgtagatctgctagtttggaatcaatacattaccgttgcattggcttacataagaagatattacgttgtagatgtttattgcatgaaagagtaatatgatctagttatttcgttgacagata

SEQ ID NO: 40584 - DNA, 1239 bp, Oryza sativa
cacataacctagctttatgatctgtctttctttctatctctcatcagtagtcatgttaggctaagaattcagctactggagatagcctttttgtttttgacattcatgaaagttaattcaatttatcaagtgctatctctctcacaaatataagcttttctatctctctcttgatccctaccgcttcgtttgttcccttattgattcggttgcaacaactgcttaaccaccccctaacccaacaccacaccatatctcattatctgtcgtctttagttttctctctctagatatatatatatctatcgcttgacatttttcaaatgatgcatgatattgtacctgcccagtccaatggtcctccaggttgacacaaactcccatatcttgtaccaacactgttccattctttaagtaagatatatgcatgttgtactagctagtaactaactcactcactcactaacaatatctaatgatggatatatactactaaatagtgtactacatattatagctattagtcttgttctaacacaaatattgacacatatagtgcaactaaactgtaaagagagtagtagtaaacacatggcacatccatgatcaccagtagtcagaaattaattagttaggacaggtgttgcttatgttgtcctaaagcatgttatgacctgacaaattggagcaattagtaagttgtaggggtgtgcttcatttaattggacatgtacgtttcttgagtagttgcatattactccactgcactcactgactattagcacacgggtggtctaaactaagcttcagctaaagcttattagatgctgctttgttagttagctagctagcttcccctttggccacatcgaccttacgtggactatccaacggtcatgctgctgacgttggaccaaaccattacatctccatctctctctctctctctctctctttcaatttctctatctcattttttctctctcaatttctctatgtttcttgggtagtatattccttgtccatctccgaaattagctgacaagtggcgtgcaagtacatgctatttgttgtaggataaacacttgatagctttccaaagtcaaaaaaaaaaattgcatcaagagctatagctagatgcctgaggtgacccatcaggggagagttttcaactattagacctaattttcagggttaggtagtagagtgagattgctagctagtaagagattaatccac

SEQ ID NO: 40585 - DNA, 158 bp, Oryza sativa
ggtggggctgcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaatttcagt

SEQ ID NO: 40586 - DNA, 1501 bp, Oryza sativa
aaggttttctggtggattcagggcagtttcctctccaaagacaattccttcttgcagtatcaatggccttgaacacagtgacaggtaattgtagggagcacatgtagtatgtgggtattgatgataggacagaaattattaaagtcaatctatctccttgaggtaagaacattgaactagctgttagccttctttccaccctatccacctaggggggcaaaatcaatcactcttggccttgtagttcctaggggaagccccagatatgtgaaaggcagttttctaacagaacatcctggaagtcttgcaattagatctgtcttttcttagaaagattgagtggataaagacttgattttgcataactaacttttaggccggtcgactgagcaaacatgtcaagaagttccttgaagcagaagatttccttttgtgaagcttttaacatgatcaaagtgtcatcagcatattggactgaaaaccctgtttactattctttaacatgatcgggaacccacttccatcattttcattaattggctttgaaattaacccaagattgaaagccctgtttactattctttgcaagagttcagcccctagaacaaaacgaagtggagacaaagggtctccctgtctaactcttctcttgcagttaaaagaagtactaggaaccccattcaacagaactgcagagcttgccgaggagaataccatttgcacccaattgagccatttttgtgggaaccccatgctttgcattacagataagatggctgtgtgttcaattgtatcaaaagctttttcaaagtctagcttgaggatgattatttctctttttgactgctaacattgatgaatgtactcaaaagcccatgctaaacaatccttgatggttcttcctttgatgaatccatattggttttcactaaccactttgagaatcacaccttgcaatctgtcagtcatcaattttgtaagaaacttaagacttgatcccattagagaaattggtctgaaatcattaactgtttccggagagggtttttttggcacaagagtgataaaagaataattcaggatctgtaaatctgtagactcagcatgaaaatgagctgcaagtctgtagaaatcttgtgcaatgatatgctagcatttttccatgaaataaccattgaaaccatctgggccaggggccttgtcaactgggattatagagatgagattatcaatttcttgtgtgtagaacatgtcaatcaagcactccaaatctattctaggaacaaaaagctcgttcaaattgaaatctatagttggggagcaagagatacccatcctattcttgaaactttgatagaacaagtttgccttttgatcatgcaggttaactatctgaccactttgattcaaaacttgagaaattgtgttcattctgtacctttctgtggcaatagattgaaacaaattggtgttttcttctcccagcatcatccatctatta

SEQ ID NO: 40587 - DNA, 1339 bp, Oryza sativa
gatcacttggtgtgtcgttgcaacctctctaaattagtaaattataagcaagcttagctataactggtcatagctgattctattaatcatcagtttggagcatccaaatgtatctggccgttgatcttattataatgcaaaactgatgtgtggataggaaggaacatggtgttgctatcagtggagtgccgttatgcaactgctttctagtataactactaatgaagagataatattaggtgcaccaaatgtgttcatacaaaaactagcctgcagtgtctactctcttgtatagattaattacaatttcatatgtatacaatacgattaggacctttctatggatgaattaatcatttgatcaacatcttgtgcatgaactggtcaagttcattgtttgctatgggcatttggtagattataacatagatatacagagagaagtttcctgttggctgctaaattagcagcctcctagctttatgacatgtatatatatgctaaaaaaggtttaatttgacatgtgccttttggggactgtttaatataattgatcaaattatataggtaaaacaacacacattagggtgaggcgatgtttctcgatcgacacaattcgtcgttgttgtgttaacacaggtctttaattcattattcttatagattttgaaaagattgaaaagaagcacatgtatgcagttttcttgttgatgaaagatgaatgattttaaattttgctgcgggtaggtagttagttcttgctgtaaattatttcaagcatgtgcccaaacattgcctaagcaacttacaaggccacattaaaaaaaaaaaggtaatcagagagcacaactaggaacggttcattgcttttgacatgaaggggagaaaatgatggattaatatatgcagtgtttgacagtatatcgaacagagatgtcaaaagcatctccctttggcaaaccacaaaccgtcaatttggaaagggacgatggcatttgcatttgatccgaacatcatagctgacctctggccggctaaaaagtacaaaacatgtgacatacaaagcccaaaaattcaacctatagttttgtcctttcagtgtactgaatttcatcttaattggctatttttctcatcgtagcaggaacatgtcaccttctcggttgaattggttactcgttacatcgttttgaaattttttttttttactattctccgtacaaatcttcagttggttcgaagcaccgaaacacaagagagtcacacaaataaacataatgcatgctacacggagtttgattaattgtgccccttagcaatttctcttgtcccaatcagg

SEQ ID NO: 40588 - DNA, 1501 bp, Oryza sativa
cccagaagaggagcccctggaagatgaaggctttggtgtctagctcgtgcctgccgtcaagcgcctgtggtcgtcgccctagtcttccgttgtttctcgtttgtctttgtgtgtgctgggccttcgctgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagcccccttgaccctaggacgagccgtagatcccaagccttagcaatattttcaaaataaaaatcctgtcttatttgtgaaaatcctctagtctctctctgtcctgctgcttcatttatcgtcaaaatctgacctttaaaatgttgcttttctttttgtttttgtttgtagatggccggcagcatcaaccgtggtggtctggacctgactggcttcgttttggagctgcggggcatgtgcgttgtcctggggtatccgcatggagtggactaccagggcaagcagctctcggagcaggagggtgacgatgcagagccccacgctgcttgggaggttactgcagtgatcctcactggctcacccgagaggacttcgttggcagtcaccgcgggtggagattccttctccgccgcttgccagaacgccgcactcctcaccatcggtactcttcaccagcgctacccggacgagttgcagcactcgccctaccgttaccaccctcgtcgcggaggagcccgcgactacgccaccttccgggatgctagctcggaggatgacgctaccatcatgcatctagcgcgcatggtggaggcgtacgacgcggctcgtatcgacttccatcagatggtgcgtcgcgggttggtcgagaacaacatgaagatcctggagctgcgtcaggagaatctgcagctgaagaaggacctagacgcagtggaggcgcagctgcgtcagctcaagatcgcccagggagaggtctgtcgccccaagcgtcgccgcgtctgccgcagccagaagatcaccgctcacaagagtacctccaggcccgagcttgttcgtcagtccctggcgtggacctgtttcgtcgagacccctcgtgccgagcccgcgcccgtggttcctcaggaggatggagcctccggcgttggcagcactgatgctcaccttccgtcctggcctatcgcagctgtagacaagcagttagtaggcttgcgcgtgtgtttttcttgtttgtttttctgctagagtcgtatggggcatggttatgccggtgtgtggtataaatatgtcggagcctgtctttattttatttgcttaagcaacttgaactttaatgaaccaatttaataacagtaataaattcaagaattatggtagtcgtgggtggttagttttaattgtcagctctctctgtttgctggtctgtgtggggttttcagatgg

SEQ ID NO: 40589 - DNA, 1501 bp, Oryza sativa
cggctgtacagatctaatctccaaaccaggagctaagcaaattattaccaggtataacatccataattattgtgagaagtgtgagactaatcacgaaaaacattgctcaacccgcccataaccgcgggcacggctattcgaatagttttactctggccagaggtgtaccactgtacccacaagacacagccccacaacatgccaccatgtgcctcagtaccaccacggtacctcggaaaggagctgtgacattacccctcgcataacacaacccaccacagtgcacctttcctggatcataatcaccccctcaaaaccagaggcatggactccccagcgacccctgtgggcttatctccgccacttctcagtctggtgctctgcaatgaaccatgctatacgaaaggtaaagccgttgcccacgctggcttgtggttggcacgattaatgtttcacaatagtagctcgcgaactggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagttatcccaatagtgtgctaatgtttctaagcatggctaagcaattatatctgatatctagttgaaccaatatatataaagttcaactagtccaattataatcacccaaggtatcaaggaataaagtaatcaagaacaaaagggccataacaaagaataggttaattccacccaatgacatttgaaaataaatgcacagttgaaataaatagagaatttaaatataggatcaacatgctcaaaggattgtgtttaggatctgtgtgacttgcattgcaataatcggtcttcaattaatcttcttgaatacttccagcgcactcgcgaaccttcgcaacgacggaaacgacaagctaacacgcaaaacaaagaaaaagactaataaaaaccaaataaacaatacataaaaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttacacaatttttgcaacttgaaccacattaaactgagctaagatgaattagttatgaattttgaaagattaaatcggattaaaacacttatatagattttaattgaattatgacgcaataatgatttatttttgaaaaggaaaagaaggattattgcgtcagcggctagggtttgcggtggaccgggtgcacggcagcggttcacgggaacggacgggcgagatcgatcctatccaaaacggacggccgagatcaatcggtccacgaccggctcacgggaacggcgacga

SEQ ID NO: 40590 - DNA, 301 bp, Oryza sativa
acacctgtgacgggtgacttttttctacccgtcaaaggggaccaaacagctgtgactggttttaggtttccaccgtcaccagacgtccaaaatcacccagaaaaaaaagaaatgcctcagcccaaatgtacgaaatgaagaaaaatccaattcatctcaagatgcacatgattcaacaactttgtattttaaatcaaatacatctcaacaaacaactacacatgaagcaatctgacaatatacatcacacaagtatccatgtccattttaacaaactacacatccacacaagcaacaaaca

SEQ ID NO: 40591 - DNA, 356 bp, Oryza sativa
aagccaaggaagaaagaacattagcatctcaaatagagccatcaaccaccgcaacatagcttcctccaaaagaaacatgtattcttccaaattttgtaagcagcacatcctcacatgggtttctagtctaccaaacagtgcccaataccggtttgaccacgccacttcctgcaccagtccacatacatacccttcaaggttttcctttaaatctccttctctccctccatctccactcccatccctctgctcttggcagtgaacaactgtcctcctgcacattttgtcttcctctcaaaacattgccacagaatattgttcattcttgacacgtagaagagccatgaggccatcac

SEQ ID NO: 40592 - DNA, 166 bp, Oryza sativa
ctatatcaagatcttttttttgcaagaaaattgttcaatctagtagtttaaatgaaaatgtcttatcttagaactgaaatgtttacttcatcgatcatcattccatttctcaaatgagtgattatcgaaaataaattcctagcttaatatgtctcctctgttcagg

SEQ ID NO: 40593 - DNA, 435 bp, Oryza sativa
actatagggcgaattcgagctcggtaccccgaatcttttaagcctaattgctccatgatttgacaatgtggtgctacattaaatatttgctaatgacggattaattaagcttaataattcgtctcgcggtaccgacggattctgtaattagtttttctattagtacccaaacaccccatgcgacaccctatataatacccgatgtgacacgtcaaaactttacacccctggctctagacacccccttacttattttcctatgaaattgagccatagaaatataattctatagaaaaattcttaagagtcccattggttgccctaataagccaaagccaaagttaaaatttaaattttgagatttgctctggtccaacaataccagtacctcacggtaccaaatcatttctaatcgttggatctagctgggcagga

SEQ ID NO: 40594 - DNA, 398 bp, Oryza sativa
cagaaagatcgaacaacatgatagcaatgtattgccaaatcaaagaaccctcgtttgcacgctttgtccatcgactatatactgtctttctgcctgatatattaattacgttctgactctccgtgaattggtaattaaattaataaaaaccttaggttaattttcgggcatcagattctcacctatgctttcgtaaatcatataagagaactttaattaaaaaaaattcttggtgtagaagatccagcattttgatttggatggaccatatcctcaagtggatggatgatgccgaatacgtagtacagagataaggccccatccgaatttagtggccaaataaattttaaaatctaaaataaccccccaaaatctcgagcaaaatacgtgtggacagg

SEQ ID NO: 40595 - DNA, 311 bp, Oryza sativa
tgctcaatttttcccaagcccagaagagagctccttgaagatgaaggctttggtgtctagctcgtgcctgcggtcaagcgcctgtggtcgtcgccctagtcttccgctgtttttcgtttgtctctgtgtgtgctgggccttcgctgcccatgtaataagttaactatttacgcttccgcttgttaaactctgatttgtatcaacttttggtgtaccttgcctcctgggacaaggattaatgcacgcacgtcaggaaagcccgttgggttatttccggtcgtgacatgaatcttggacagtctcggttttca

SEQ ID NO: 40596 - DNA, 1501 bp, Oryza sativa
ttttggggacattttttctgcaaacatgtagctgaactggatggcctgtccaaccgattggcagcatgaaatgaatgaaacattttcgtatttgtgcccttttccctgatactccttcagtgtttttgtgatccaagcagatattgtgatttgcgaggtagatctatctctgttaatcgtaaggtacggagaattaactcgaaatcctaggcctaacccctagatagctgctgattaagggcttggttgacagctacagatcctatctccaaatccttcatgatcccaaagactaaacaaaaacgtttggctggataccaagctccaaaactccatgcatgcttaaacaagtatgaaaacacttcatttatgaacatgaaaacacttctggtgatgctcgttacccaattttgctgttcaaatttaaattttatttgagatttgctcccccctttccgataggatgactttgaaatcgtataggtaggagaacgctatttgagaaaaccgtatttttacaagcgttgagaaaataataattttatgaaatacaagaaatttcatctacacaactacacaagaaactccaggatgtttttttttcttttcgctgttgaataattgattgtataggaaacacatataacaatgatataaataacagctgtacaatggaaatgcaagtgtgtgtgtacacaacttggcggatgaaacctacttcaattcttccccattttgaaacatacattaattctcctttatattgccaccaaaaattttacaaaacctatccctaataataaccaagccatcacactaagtagatcaactgttagggctcaagattaaccagaagatgatgatgattttgccagtaattaccactccctccgtcccataaaaaaccaacactcgatgcgacacatcctagtactacgaatctagacatatttctatccagattcgttgtactataatgtgtcacatacagagctagattcactttttggacggagggagtagaccatatccatggcgtcgtcgcgtacagcgtgtacttctcccaagagcgagaggaggaagaagaaggagagatggtcagctaggacaccgaatgcctcgtgttccgcgacggcgtcgacctcgtctcctcgccggggctctccgacgtgtcggagctgctgttctcgccgctgctcgccttgccagaccacagcttgctcagtatcttcttcggcatcagcccgccgccgccgctccccttcgctgacgccgacgacggcggcggcttcttgcaggcggcctgatcgccgccgccgccggagacgccgccgttcttgttgttggcgaggctcatcgaccggaaggaggtgacgtcgacggacgtcgtcgtcggcggcggcgcccactggtcgtcctcggtcgccgtcgacctcgagctgccgtacgagttgccgtcctgctccctggggaggagggagcgcgctgccggcggcatgtc

SEQ ID NO: 40597 - DNA, 1501 bp, Oryza sativa; identical to SEQ ID NO: 40558

SEQ ID NO: 40598 - DNA, 1501 bp, Oryza sativa
aggaattgaagtgtaaaatagagaattgtaaaacacatgaaaaacatagaaatgactgtttgattgaacagtaggaaaaaatatgaaacaaaatagagagatatactcaaaggaaaatttctaagagctttgaactcttgctaagttttctccaaaatctctgtagaattgtccatacaataggagtttcaaagaatcggataaaattcaatcttttgattcaaatgcactcataggaatttttctataggattgaaaattttcaaaattcctatgttttttctccaaattaaaggggccctaagttttttaagggtctatttgtataataagttttctaaaaggatgaaaaaggtgaaaatcccaatcaggggtactatgttgcaaaagggtcaggacgtggtaaaagtgatgcaacagtaaaagcgagatgaaaaagtgactggtgcgagtatttactgctgctactcctattcctactcctactcccatggggctagtagtagtagctatagcctacagctagtacaacacccacgcgtctactactcgtgagggcacttacagtgcgtcaccaatttttgaggggcaacactgccacctactaagaactttacaagcgacaacctccacagtgcatgtggtcttctttttccttcacagtgggtcccacccttctctctcctcactttttacctcctctcctctctctccctgccttccccaaccaggccacaaaactgctccgtctagtgcgccgccggcgcctcccacacaccgccgtcgcccctctccccctccggatctggcggcccgccggcggcgacacggcgcgggagccggaggcggacgaccctgaggcgatctcggcgaagggcgctagcggcggacgaccccgaggcgggctcagcggagcgcgccagcggcgacgcggcggagacggcggcgcgggtggcgacggtgccgaggcagccaccctctcctcccccgaagcggcggcggcgccgccgcgctgcttcggcttcgccttgggcttcttcgacgaggaggacgccgcggcgccgcccttcggcctccccatggcacgggcgcgtctctctctctctctccttccgggcagcgcttgctgacgagacggcggcggcaggcggctagatccagcccgggcagagaggcggcgccgggagttggtttggtttgcttcttctctgcttcaacggttggtcgacttcaatgcaagaaagcatcggcagcaattgctcctcccgtttagttagtgtcgtccatggcctccaacgaaggtattcttctcttctttctcaaatattctgtttctcgcatatatgtttgctccttttttttccttcttctgctcgcttctctcttcttctgttcgtcttggtgatgacgaaactgaaggagtatttggtgattgaatctgcagaggccggattcccttctctcctgtgggatgaactcaacgacgacgcggggcaggatg

SEQ ID NO: 40599 - DNA, 1501 bp, Oryza sativa
attaattccttcctcacagaaaatagagcggtccattagcacgtgattaattaagtattagctttttttaaaaaaaatggatcaatataattttttaaacaactttcgtatagaatttttttttcagaaaacgcaccgtttaacagtttaaaaagcgtgcgcgtgaaaaatgagaggggaagttaggaaccctggaaacgaacgtagccttagttctctgtttaataggcaaaatttatagttggatgtagaggtcgggtttttttaaaaaaaattgtcgccactaggtcaattttcccattttattttcctattcgcctcttctggtcacacaaagaccccaccccaccacacgcaaagaaaaggcaaccattgttccacgttaatgagttattgttgggtctaattttttgggcctctttgcatgcgcgtcctttggatacaaaactggaaatagttcagtttacacaccccttataactatgaattgagtagagttccatccaccactactagaaaaatcacttttgcatgcggccaaaagcaatttttacgggcggagggaaggaccgcctgcagaccaacgacggtgaaaatcatccagcccgcttgtaaaaatccaataaaaaacaaaaaaatcgcctcactaccgccggcgctgccctctggccatctctgggagaccgcctctcccaggccgggcccgcttaaatctggtagctttcataggtcatagactgccctcccacctctcccaggccgggcccgcttaaatctggtagctttcataggtcatagactgccctcacataccaacaaaagtcttttctacacactttgttgtcctcactcgtgcgcaccgaggccgggctcgcttacatctggtagctttcataggtcatagactgccctcacacactttgttgtcctcactcgtgcgcaccgaggccgggctcgcttacatctggtagctttcataggtcatagactgccctcacagaccaacacaagtcttttctgcacactttgtcctcactcgtgcgcatcgaggccgggcccgcttatatctggtagctttcataggtcatagacttttctacacactttgtcctcactcgtgcgcaccctgacattctttccggtcagtcacccatcccaaattgcttcaggccaagcacgcttaaccctggagttctttagagattggtttccggaaaagaagttgtaacttgtggcttaataggattaatagaacgtgaagggcccatggctcgtccgtactgtcgccttctaaagccacgaaagacaaaatcaccaccccaactgctaagggactaaattttgatagtaagggatactctatactcggttggttttgcaatcgagggatgagtacagtggacttttatggcctacattaattaaagagtccatttttctttggaattagtctattttgtccctcttatctcttgtctttggacaatttgtatccctcagc

SEQ ID NO: 40600 - DNA, 1501 bp, Oryza sativa
acatgttaaatgttaagttcttaatgaacaaagtttataggaagtgcagttacagtttttttctgtaataaacaatattttcgtgaaaaaataattaacatgcctagcgtgtaaaatttatcgtaaatatttatattagcatatgttctcaactctatatatattattagcatgtattatattttaattattaattagtccaagtaatttttaacatttattttaaagctttaatttctgaacatttgaagaaccttgttctgtaccgttgaaaccacgcttcaaaaagcattagtttcttttaatattttttcgatcttaactctagattttgtttatgtattcccttttctaatcggaggtacacatcgtgtttttattactccatgttttcttccaatccttccattggaagtgtcatgaatcttctcctgccctctacatttctaactgtcctttccaaatccatttagagtgattttagttttcctttcatcacagattattttccagcactttctttttacaaccattaccaacatagatatattatcataaattatttttgttttcttagttcatttttctatggtttaccagtattagctcaaacgattaataatatatcctgattagtgggtttattttgcaatatacacttgttaactttgaggaaaaaaaaagtgatggatatttctataaaatagatagtttcatgtgtgagtaatagaatagatagttccacatgtgagtaacataatagtagaaaccatatgtcctaaaataactgtatcttagaatgtcgatttctattcgtcattttgcattaaaattgcacggaaaaaactttggactacctttttaatttatgcaaatattcccaacgatcctagcacttttctgtaactaatcatttctataaatctagttttcctgtttatcgttttcatttagttatatgtattgcttacttttttttattatacacatattgtactgtatttatccaaaaaagaatcagtgattgtaatgtaatccttgctacgatttgtttttgcatttaaacatatgatattatcatcatgatgttactttgttcgattttcatctaacatttagccgattcttttcattatgaaaggttcaaactcatatttttttccatcttctctatcttgcctttttaattacttcattttctttctttttctatattaaaatgcatgacaaattctctttggaagtctctagaatctagctataatgtttaaagtttggaagcctatggaatatagatagaatgtttaaagcttgtttttcttggaattttttttatcatatgttctcctaatttatcttaaattttagccatgccaagtggcccaatcatcttgcatcttccatgccagctttagaaggatagacgtggctcaattgaaaagcgaataaacattctacgttcattatatatgtatatatatatatatatatatatatatat

SEQ ID NO: 40601 - DNA, 204 bp, Oryza sativa
attacaactgtttaaatctttcaacttctgtttataaatgctcgctttatgcaaatgaaccactctagctctcctttgataattccctgcatcatacccctattccggtatgacttgctgagtacagtgggtagtactcagtcttgctctttttttttcccaaccccagagttcgggtatgtgtcagatggagatttctctgag

SEQ ID NO: 40602 - DNA, 402 bp, Oryza sativa
tttttatagaaataataaatcagagttgtttttggaaaccgtgtcactgtcgaaaacgacttcctttacgagtacagatggagatataattataggtcattgattaattattgtcgattggtcacggcagtgagaggcagatagcagcttagcttagctgcattatcttgagacaccagtaccgcgcaaattcccaggagacacctttcagaaagggcacccctgcgtgcagcaagtcagcaatgcacagctagctatagcgggagccatgaccgcgagcgagtgagagagagctcgccgtcgacggcctagctaggctctcgccgtccgtcgtctctcgcgtcgccatggccacaggggatcaataattttgtgggcacacggccggagaggcgacggcga

SEQ ID NO: 40603 - DNA, 447 bp, Oryza sativa
agctcggtaccctgcttattttccctgcgcgagtgttttcctttttgtcgtttaagtgctatttcaaaaagaacttttttattgttatatactcagtagctcagtgcttgggaggaaccccaatgacttttgtcaatcatgaaattaagttgtaccaatacattttgtttctttagtgggaccagccagcttattatttaactgtatttgttgtataatttgggtgctttgatagcttgcttctgttcatggccctatcaagtacgataggtcgtgtgattcttgcaagttcctcgcaagacatatgttgtcttttgttaattttatctgaaagcattttattattgtgaacatttgttttttacttgagtggtgtgatttcattgttctaaataggatgaaatattaaaaaaagtgctgtatgaattctatatttctatttgcagt

SEQ ID NO: 40604 - DNA, 344 bp, Oryza sativa
ttatgcgcattgactaatactagagattaacatggagggaaggggggagacgaaggtaggtacctaacctcagacgttgctgcttccatggtgatggagctccatcccctccaaaatttccaaagcggagagcctctctctgttaatttggagtttggagggagcagagcagaggcaaggcaaagcaggtggactgggacggcgggtggagtggggcgacggtggtcggagcggcggcgcgcgaggccagcgggacaaccgctcgccggtggccacctcaacgatctccagccgaccagcccatccacttgctttggctgctccccccattgttttgtataaga

SEQ ID NO: 40605 - DNA, 1501 bp, Oryza sativa
gggtaaggcttagtttgtggctcaggctagtcataaacaaaagtacacggattggagatggatgaagtcgggggtcgatggacattctccagggcaaatgaaggctacacgagctgcggcccggtagtcgagatgtcatacggcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtttagttctaggatcgtgttgacaaaatagctttgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttttcgtttgtctctgtgtgtgctgggccttcgctgcccatgtaataagttaactatttacgcttccgcttgttaaactctgatttgtatcaacttttggtgtaccttgcctcctgggacaaggattaatgcacgcacgtcaggaaagcccgttgggttatttccggtcatgacaagttggtatcagagcatcctttgaccctaggacgagccgtagatcccaagccttagcaatattttcaaaaataaaaatcctttgttatttgtgaaaactgtctagtctctctctgtcttgctgcttcatttatcgccaaaaatctgacctttgaaaatgttgcttttcttttctttgtttttagatggccggcagcgtcacccgtcgtggtttggacatgactggcttcgtcttggagctgcgcggcatgtgcgttgtcttagggtatccacatggagtgggctaccaggccaggccgctcccggagcaggagggtgaggacgcggagccccacgctggttgggaggtcactgcagtgatcctcgctggctcttctgagcggacttcgctgacagtcaccgcgggtggcgactccttccccgccgcttgccagaacgccgctctcctcgccatcggcact

SEQ ID NO: 40606 - DNA, 1501 bp, Oryza sativa
caactaaaattaggcgaaagtacgtgcgtcgatcgtcatttgcgtctggcaatcaagcgctttgcgcgcgattgcttaaaatttgagcggtcatgcatggagctcacctggctggccggctgcaatcctggcgtgattttgtgcgtgcgctcatcacatctcagacgacctggatgctgcctcctgcctgctcgctctgccttaatttcctgtgactttctctagcttcgttcgtcacagctgctgcagatcgagcatgtcatatgtccaggtttctcggctagctatagacttaatttggctagctgcacaaaatcggcacgcaaacaacacgcgaccatcgatccattcaggccacacgggaagctgcctgcctggcctggatcgagatataatcagcagcaagcatgcagcgtatgcatgcacgaacagatcagtaggtattgttagcttactcagcattgatcaggtgctccgagacatatgcatgcacctgctgatcatgattagctgggatcgatctaattaatcggaattcggaactatggtcatgatctgatgatcaagcagtaaacaaattgcaagccggcaaagcatatgcacacacacaaactcgtaggatgcatgcatccagcggccacaacttggccaacttgcattaattcgcgcggcctatccagagatcgagccccttgtgtatgactgcccggtgggacaccgccggcggcggcggctgctaccgccacgtatgactggccggagtacataccagcaacaacacacgtggctagctaaacctacatgtgtgtagtatactatcataaatcttatctttacatggaacgattgaacaattgatgttgaccggccgatgactactccctctggtttatattataactcatttaacttttcttttaatcaaatttcttgatcaaagtttatagaaagatatagtggtattttccacacaaaacaaatatattatgaaaaatattcaatattagatttaataaaactaatttgatactttaaatattattaatattttaaaaaaaattaagtttgactcgaaaaaattataatatgaagcagtagatagaatatataaaatgagacaggaggacaagctggaagagagacgaggagacgacagcatgcgtgcgtgtatgggcgtgggtggatggggcggtcgccggcgccaccggtcgtaatcagccgccactggggccggcctaaccgatgatcgatgaggacacggcgggtcgctgttgctgctgactctgcatgtggtcccccacctgcagcctgcgctcggttcattttaattatactcatttttatttatttatttattttgtttgaggttgttagtttggtaattgatgggccacatttatctctctggaaacctggacgtgtatgggctgagcaatttacatttattatgtgggccttctacatggaggctgccgtcctaccgggagtgagggcccaagct

SEQ ID NO: 40607 - DNA, 1501 bp, Oryza sativa
aacatatcatcaaaatatgttcaatattatatttaatgaaactagtttggtattgcgggtgttggtagtattttctacaaatttgatcaaacgtaaagaagttcgattaggaaaaaaggtcaaagcgacttataaaatgaaacagagggagcacctactagctacagcaaaaatcaatatacccaaattaggtgccacatgtttctactccgtgtataagctctgttactagcgtactatatctatgttattatgtaatagagttcaaacttttaaatttaactccaaaagctaggtttgaagtagagttgtggagattcacctcactatttcattttgtaaaagcactttaatctgctccacgccctttctaggtgaaggttaaacactttggttgagctccatctttaggagaggtgtagttacagatctaccaaataaaccgtatatatgtatataaatattagcaatatcatacattgcaatcacaattagtagaaagatcaaacattagaattactctccatgaaaagtcaattagatatgttttgggacggagggagtaggatactcactactaagaaatttttcaaagcatgttttcctactctataaagttattattccctttgtttccaatttatcatcgcattataagagtgtactaagataaaaaaaagctaatagctatcccgtaatatatttactccgttaactaattcgatgcatgcacattcccatccccattacttcctagcaccaaacagaccaagacttgtaaaaaggttgtgcgcacatatgtgtacatatatgtccatttattttcatacacaaataacgaaaatactaatatgataatcattttggaataactaatttttgggaacggaggttgattaactgtgatatactataaagtagcctttattttaaggagatatgtaatcctctagtttgagtggtttcgcttctgccagcctcgagcaacttccttcaattcgtctgctccgacgtggcaggttcaagcaaatgaacctgattcgtctctgtttcagttttgcaattggcaaaattggttctgtagcaataaaaaaaacaccgattttatatttatagcattgaaagtaatttggtgccagtatactgccctcgtgcacttgtctacgttggactaagctagagtttttaatctgccgcgtcctgaaactgacggcaaagggtaatttaccttcaagcagatggtaaactacggcaacggggatcgctaaaaaaacttggagcattgtcttggtagggaaaatggcaaaggaggtaaaagagaatcatggcttcaggtaaatcaacaatttccatcaccagagccaggttgagaataacgtaaatcttttgagacgaatacaagatttagaaacaaacatcaatgaagaaataaaatcagcaggatcatcacaactgatttctgtcacgacaggcaccaaaagaatctttagtcactcatcag

SEQ ID NO: 40608 - DNA, 1501 bp, Oryza sativa
attcgtccgattttgtgcccgcaaagttcgccggcgcaatcaatggcggccgagatctccgcgccggtttccatctcctccggccgctctctcctcctctcggccctatttaaacgtctcccgtgcctctctcctccgtttccgccgttcgccgctcgctctcaccgtcgcattcgtgctcgcgccatcttcctctctctccgctgtcgccgacaagctccggttcgccgccgccgtcgctccggacttcctccccactcggcgtcacctccatcggcttcgccgcgttcccgtcgacctcgtccgcgcctccgtttcgctcgccgaccgacggagcgccgtcatcctcgtcgtcccgaaccgcgccgccgccttcttccgcttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctcccgtcggccgtgccggcgaggccgccttcgggcgtgccctcgcggctgccaagtgggcccggccgtcagccgcccgcgcccgcgggtgcggctgatgcgtgggacccacggcaccggccgccgtcagccgtgtgcgcccggtccaccgtggaccgagaggctgacgcgtgggccccactcccgtggacccggtccgcgcgccctctcccggctgacgcaataaatgagattttttaattaaaactttaaatgaagaaatccgcaaatatccattaaagagcatataaacttcaaatggccatatcttggccatttgaactcggaattggaccgttcaagtctctaatttttccttaagaagtcaagaacccatttttgtgctttgtttctgttgttatgtggagtttattagagtaaaagcctttttcttttccgttggtcgtgtagacgctgcagcttcggaagatccgctcttcgtggaagtcgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgctattgttattattattcccttgttcaccctagagcaaacaaaacctcaactagtggacactctactcatggcaccactagtttaattttaggtagatgcttcgcaatttaattaggtaacattaggcggttttacaactctagactttgggatattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 40609 - DNA, 1501 bp, Oryza sativa
ggcttggcttccaacgtagccaagaatccgcgaccaactatgcttaggttcagggcttccatctgttgattaagttcgggcgggatgccacggacgttaagagtgttgcaatggctttttcgacttagagcgtcggcgaccacgttggccttaccaggatgatagtgaattcccacatcataatccttgatgagttctaaccatctcctttgccgaagattcagatccgactgggtgaagatgtatttcaaactcttatggtcagtatatatttcacagcgattcccaatgagatagtgccgccagatttttagagcatgcaccaccgcggctaactccaagtcatgggtagggtagttgccttcgtgagtccgtagctgacgtgaggcgtaggccaccacatgaccgtcctgcatgagcacgcaccccaatccttggcgcgaagcgtcacaatacaccatgaaatccttgcgagtatccggcaagattaacaccggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttaggttgcttccaatcagtgacagcggtcactatttcggggtccacagcaactcctttagcagatatcacgtgccctaagaatttgacttcggacaaccagaactcacacttgctaagtttggcatacaattgatgttcccgcagctttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggtcaaaccgaatgacatcaccgtgaattcatacagcccgtatcgcgtggtgaatgcggtcttcgcaatatcttcttcacgaatacgtaattggtgatatccggaacggagatcaatcttggagaatacagtggcacctttgagctgatcgaacagatcatcgatccggggaagagggtacttgttttttatggtgacttcattgagagctctgtagtcgacgcacatcctcttcgtcttgtctttcttctctacaaaaatcacaggagcaccccatggggaagtactcggacgtatgtaccccttttctttcaactcttccagctgtttctttacttcggccagttcatttgctgccatacggtagggtcgtttgtacagaggagtggttcctggagcaagatctatccggaactcaatctctcgcttgggcggcataccgggtagttcttccggaaacacgtctccgaactccctgacgatggggatttctgacagtcctatctgatgaagttctgaacttctgacagagg

SEQ ID NO: 40610 - DNA, 1316 bp, Oryza sativa
cagaaaaccgtacttccaaaataagcaagcgaaacctccggaaccagtgttcggcccaaggcccatctctcctctacgtccggcggcggcgcatcccggcctcgcgctccggcggcggcggccagtctgaggcggagcggcaccgcggcacgggagggcagggcgcagcggcgacggcgaggaagccaaccgggcgcggcagcaagggagaccgcgtcttgtctgcacggctccattagcggctggaggtgggactggagccgggagacccaactagcgtccaccgcctctccgccaccgccgccgccgcctcccgcaacttagggggttttgctgcgccggcgcggctccaatccgctccggggcggacctcgccggtcgacggccgccatgtgagccccccatcgccgtttccgctcgtcaccgcttggtgttcgttaatggcaggcaggctgatctctacgtcttcctcctcctcctcgcaggggcttcgcgcgcgtggagctgcggtgccctagggccctcgacccccgcccgagctggaccctcggcgacgtcctcaccgagctcgacgcgctcgaggccacttgccgcaccgggcagcccacgcccctcaagcagccgccggagtggtatctctattctccaatcccttgcgctccttgcttatggtttcgccgataagctgcaatcgtttccctctacattgcttctatatgatttttttttggttcatttagggctagcagtggcagcgtgagggagaaggcctttgtgatgcgggttgaagaggaagatgacacggatgaggacgattacgacagtgatggggagtcccgggctcttgtggccaaggccactggagcaaggttctcatgcaatgatcttgaatccaggtgaagatttgatgctgaaatttggccactgcaattgcaatttatttgctttgaagtacggtacattatctgcaattaagtttaaatgaatggcgtattgtgtgagatatccccttcttttgttttcttcctagtgatgctgaagaatcagaggatgaaatggatggcaggattgcaccatatcacctgatggagaaacggagcctagagaagagcattctgcttgagctggaacgtgagcatcatctgaaagttcaagtgtgtattcatcaatctatactgttatatctttcttactgaatgcagtacttatgggctgatttttctttgatgtgttggcaatagaccattgaattattttcattaccattaatcctcattctagtttagggttaccatggcattaggttacactttacg

SEQ ID NO: 40611 - DNA, 1501 bp, Oryza sativa
acaaagggaataataactttatagagtaggaaaacatgctttgaaaaatttcttagtagtgagtatcctactccctccgtcccaaaacatatctaattgacttttcatggagagtaattctaatgtttgatctttctactaattgtgattgcaatgtatgatattgctaatatttatatacatatatacggtttatttggtagatctgtaactacacctctcctaaagatggagctcaaccaaagtgtttaaccttcacctagaaagggcgtggagcagattaaagtgcttttacaaaatgaaatagtgaggtgaatctccacaactctacttcaaacctagcttttggagttaaatttaaaagtttgaactctattacataataacatagatatagtacgctagtaacagagcttatacacggagtagaaacatgtggcacctaatttgggtatattgatttttgctgtagctagtaggtgctccctctgtttcattttataagtcgctttgaccttttttcctaatcgaacttctttacgtttgatcaaatttgtagaaaatactaccaacacccgcaataccaaactagtttcattaaatataatattgaacatattttgatgatatgtttgtgttgtgttgaagatgttcctgcacttttccagaaacttgagcaaaagttaaaaaaaagagcaacttttaatatgaaatgaatgtagtacaacacttcaggatgtccttttgttttacacgtcagtttcacatgttgtccaaaaggtttacaaatgaagctatatccaaaccaatatattaccttcgtttttctaatatttggcgtttgatcgttcataaattaagtacaaatatgctaaaatataagcatacttaaaatttcttaaatgctaaaccatgtcacaataaaatacataataattatttagtaagataaataatcaaacatcatactaaaagttaatggagtggtctattgaaaaataggattgttatatacttcctccgtttcacaatataagtcattttagtatttcccacattcatattgatattaatgaatttagatagatatatatgtctagattcattaacatcaacataaatgtgggaaatactagaataacttacattgtgaaacggagggagtattatatatcactctataaacgtacgtacagctccaacgaactactccctccgtcccacaatatctcgattcctggagggagggctttgtcccaaaaaaatcgattcctgcacagaaaaccgcgtgacctctctatccgtatcatgtgtggggataggtgggtggtgagtggcgacttctccagaatactcctctctcctcccagaaccttatctcctcccagccgcatactactcgtacgcttctctctccccctctcgtgtttttctccctcccgttcctccccatcgcccttcacccctctggatcgaaggcatcgacgcggcggcgtctaga

SEQ ID NO: 40612 - DNA, 199 bp, Oryza sativa
ttgttctgaatttctgaatattcacaggctcactacatcctacagcctacaggccatcatgcagttcaaagaaatttcagagtccaaagattcctctttagccatagtctaggtttttaaaagatgatataaactttaattaaactcagttaattacatcaagataataaaaccgtgctgagagaggggcataccttca

SEQ ID NO: 40613 - DNA, 507 bp, Oryza sativa
catgctaactttgtatatgcgtatgcaaagtttgtatacatgtatattttttatacgtcaattttttggtacacataaaaattatatatacatatgtgtatactttgtatacatacgtagaaactttatactgataatacatatgtattatacaaaggtttttacgtatgtatacaaagtatatacaaacgtatatatacgcgtagtagtactgttgttgtagtgtagtagttgcaccagcagttgtagtagtagactagtagtagtaccagtagactagtagtagtagtaggagtctaggaggagcgggctggtcgcgtggctacgcccccgcgtgaccagtcgcttattaggggccccctccagtcgactcgagatgtatggcattgcacgtatctttcaattcacgcatcctaaaggcacatgagagcattcatatattagagtttatctgtgtttaaggggaaaaaatataggccgaagaaggagaggcatatctgcactaca

SEQ ID NO: 40614 - DNA, 294 bp, Oryza sativa
aagagcaagtctaatagtacagtcctctactagctccaattcatctatagtcaatctaatagccaattatacaatagttcttattacattattaatatatggtcacgcctatcatacacacagtgtgtcttagaatccgtgctgcagctggctacagatctgtagcccctgcttttctctctcatcgtttatctcattaaaatatgtttatagctggctaatagtctgctattataccttctctaatggagacaatctgaattctacccacatgggcatgtaccccgggccaca

SEQ ID NO: 40615 - DNA, 505 bp, Oryza sativa
ttttatcgtcatggatgaacatgcttgcaaaattatggctgatacaacatgcatatactttttatacatgaccatgcattatataatttgatgtgtactgaacaatcgtagtaggcaaaactggaaatgtgatctccatattaagtgctcatgttgataataaagttcttgcacaacttgttaggctcaccatgtggtttactttataatatgatttaaccatacatatcatttagaaggcagagaaacattggcacaatttactgtatgtgctttctttgagattgctatggctgtgagccaattaacatggaaaatctatgtaaatacaacatattagcatatttataatccttaatctcatcattcgttgtgatttactatgtgctgaaatatccaatttataatccttaactattgatgcaactaatgcagccaatggcattgctgaattattctaggtagttggcatgatgtaataatagtacctgcttgcatttgtagg

SEQ ID NO: 40616 - DNA, 266 bp, Oryza sativa
tagggcgaattcgagctcggtaccccatggtgtgtggatagattgcaaaaagttaatgattaatttcttgggagacagagaaagatgaagagattataattggtagaaatgggctagctaaatagagatagctagctaacaaataatacacacagtggtcaagagtcacatagatatacatcaattttcatcaacaacgtcatgcggaaaagagagataacaactctcgttagcgagtcatctcgttaaacgcctccccctgcagt

SEQ ID NO: 40617 - DNA, 217 bp, Oryza sativa
ctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacggctcgccttcctcttcgctcgcgtgtttcgtgccttcgtaga

SEQ ID NO: 40618 - DNA, 1501 bp, Oryza sativa
gcagacactcgagcacctgcttcgcatcattgacggatacgcaaggggcgaagaggataccaagcgacggcaagcaatccaagctgagtatgataaggcctctgtcgctgctgctcaagcccaagcacaagcacaggtcgccgaatcggctcctctcgctgttcgctagccacagccagcgaaccaaggataatcgccaaggccaggtcaagctcccatgacttggaggaaattcagaaacgaccgtgtaggcaaggccgtgatggctgttgaagaaattcaagcactccgcaaggagttcaacgcccagcaagcaagcagccatcaacagcccgttcgcaagaaggtcagaaaagacctttactgcgccttccacggatgctcttcgcacaccaccgagcaatgccgaaacattctgcagcgtggcaacgtgcaagatccaaggccgcagcaaggagcagcagtcgaagcgcctcacgaaggtattcaagaacaagcacccccagccgaacagtggcaagatgtgcagtgcagagtaatccaagtgattacaagggccgacccgccgaatcaactgtcaagacggcaaaagaagatgcagctgtgaatggtgcacaacatcacttcggcaggcaaaggggccccgcgatatttgaaccagcagatctctttcgggccagaagatgccgaaggagtgctgttcccacatcaagatagagctatcttggccgaggtactggcttcgaagttcagcgaatcctagtcgacggaggaagttcggtcgacgatggggttgcctatcttagccctcacccaagcaccggcggcttcgtggttttagcggagaagcagttcaagttctaggccaagcacacttggtggtagccttcggcacaggtgaaaacaggggcgaagagcaaatactgttcgacgtcgtggacatcccgtacaactataatgcaatcttcggccgcgcaaccttgaacaagttcgaagccatctccgaccacaattatctcaagctcaagatgcctggccctgaaggagtgatcgtggtcaaggggcttcaacattcggctacatcaaagggcgatttggccgtaatcaacagagcagtgcacaatgttgaggccgaaccgcatgaccgggtgaagcacgtgccgaagcccgcccctcacggcagggtgatcaaggtgcaggtcgacgacgcctatcccacaagacttgtatcactggggggtgacatgggcgtaagagaagctgagatcatcctagaggtgctcaagaaaaacattgatatcttcgcctggggccccgacgaggtgggaggtgtttcgacagacctcatcatgcatcatctggcgggcaagccggatgccaagccaaggaaacaaaagctgcgcaagatgtccgctaatcgccaagaagcagcgaaagccgaggtgcaaatgctgtgcaaggctagggtgatccaggagatcgaccaccctgagtggttagc

SEQ ID NO: 40619 - DNA, 241 bp, Oryza sativa
caaggactatattaagccacacgataatctttttaaggatttgtttggacaatgcaaaatgtaaaggactaattcgacccctagcaaaacatcaaggactgaattggctatttaccctataaaaaaatggaggcgaaattgattctatagcatcgaaagtttttctttttaatttcatatcatccaaagttcgcggtcaacttaacagcacccaaaatatcatttcgttattgttgaaagc

SEQ ID NO: 40620 - DNA, 1501 bp, Oryza sativa
agtagggttttatttgcataaacagcatttaataaacatttcagaatttaatgaaactgttaagtaataattaaacaatattaatccaacgctatacaacataccctgttgtataggcccaaccattctgaacaaccatacccggctgtacagatctatctccaaaccaggaatataccattccaaaccaggagctaatcaaattattatcaattaaagcatcatttattatggtgagaagtgtgagactaatcacgaaagacattgttagacccgcccataaccgcgggcacggctattcgaatagttttactctgatcagaggtgtaccactgtacccacaagacacaactccacatcatgtcaccatgtgcctcaataccaccacggtacctcggaaaggagttgtgacaataccccttgcacaacacaatccactacagtgcacctttcctggatcataatcacccccttataaacaaggcatggactccccagtgacccccgtgggcttatctctgccacttctcagtctggtgccccgcaatgaaccatgctatacaaaagataaagccgttgcccatgttggcttgtggttggcatggttaatgtttcacaaccgaaactcgtgaaccggtccttaattgtcatgagcacgactctcaaaaccatgtgctcacaacccaccattatcaagttttagttggcacattaattaattaaccaatcacgattgaccatcgtgaactatcaataagccatcattaaataatagtgagtcataaagttatcccaatagtgtgctaaagtttctaagcagggctaagcaattatatctaatacttctagttgaaccaacatatagagctcaactagtcaagttataataacccaagatatcaaggaataaagtaatccagaacaaaagggctataacaaacaataggttaattccacccaatgacattcgaaaataaatgcaatagttgaaaagaaacaatagctttaaacgggatcaatatgctcaaagggttgtttgggatctgtgtgacttgccttgctggccttggaactcttcaaaatcttctcctacgaaaacggactctccgggaacgtcggaatctaagcaggaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagatttaatcggattaaaacacttatattgattttaattgaattatgacgcaataatgaattatttttgaaaagaaaaaagggatttattgcgtcagcggctagggtttgcggtggaccgggcgcacggtggcggctcacggaaacgaacggccgagattgatccatccaaaacggacggctgagatcaaccggtccacggccggctcacgggggacagtcccga

SEQ ID NO: 40621 - DNA, 1501 bp, Oryza sativa
acgcattttaggcttttaggaaatatacaaaaatcctccaagccttatttgacttttaaatttgcaccttttaattgttggaggctttcacatggattttaattattctatgcacaatttcgaggatgtattttagagtcgttttgggacgcgacaggactcatggaaataaagtttgctctcaaaacatcaagcaaagaaaatatagccaagccccctccacaatcatgccaagagaaccaatttggagagaaagtgtaggaaaaaggaggatcatttctttattccataattccacaaaatatttgacttttccattttccaccgtaaataaagacccttgatctaggagtatgactaatgatcttcttgagtccatatttttggctttgcaatatatatgatgtaggcatgtcaccagtttatccctaccaagcttcacatatcagccttagaataggggtaaattcttgcacactttgcgttggtgaggatccaaatgaaaatatacatctttgagagataagagagaaagtcaaatatgaggaaaagagatagtttgcgaaaattcataaaaatcccatgagtttgacagagaagcaagaaggactgaaatcaagatcgttccatcccaaaaatccttcttttatttattaggagagggcatgattacattttttttaacattatgctcatgcttgatggagcataaattctttttttttcataaccatgcctttccctcctttctttttttttctttcaaaaggatttttctttttttaggagaagaaagcacatgaaagcatggagaatttattttggtggtaatatgcatatggaatggaatattgcttagctcccagtgtaggagtttagcatgtgcatatatgtgggtgtatgatcttgatcatagagcatgagaagtatctacacaagtcataagagtttgacaaagttcaatggaaagtcaagcaaccaaaatgtatatagtttaatcatgatagcatatttttggctctggtaggaatttatatcaaatgaggaactttcaattttatcattttgaaaacaaatcatcggaatttaagtcaaactagtatcaggatcatagctactcttatttactatctcatatctcacaatagcttggacttaaatcagcaagtgcagcccatttaccttaggttcccggataattattggctacttatattcaatctttgagagagcacttaccaagaacccatatataagagatataaaacagagcaacaattcatcatttcaacaaagagaactagctagtcttacctagcatgactcaaacctatcctatctttttggtattttctattttgcaaatttttatgttttttttgagttttataagatgcaattggaaagcaagtatgcaattggaaagggaaatatgcaatgggatacaagttaccttagtggggggagagatgtctccctccaagcttgccttttgctcagg

SEQ ID NO: 40622 - DNA, 1501 bp, Oryza sativa
ataagacaagcgtcactcaacaccaaatatacaatgtgaaaggcagtggtaattaagtggagtcggcactcaacaacagtacgcatgtcaatgttcaacttcggcataggtacacgtcatctcgccgacagatcatcatcagaattcagatagatccgaatcatacccagctggtgcaagaacgcatcacaacgggcccctgaaccctaacgcgtatatggtccatgatggattgatggatatgcatggctctcgatatctctccaaaaacgtgtgattttcactgatgaaaaaacgtgtgatttatgctatcctaatgccagcatttcccacgtgcacgattggaaacattcctggatattgcagagatcatatgtatccatttcttgcttaggataatttgttttgtcagattattttcttaaaggaaaattcccttctcaaattaaagctaagcatgagctcgtttcagcgtgtaaactgagattttttattgagagggagataagtcatcagtgcatgattaatcaagttaattattatacactaaatattggatttatttgatttaaaaaacttcaaagttttttataaactgaaaattctatatagaaaatttttcatgaaacacacggttcagcaggttgggaaacatgctcatggagaataagtaagttgttgttctgaaaaactgtatgtatttgtgatatacaagtattcgtatcactattggcataattttggggtttttttaatatccttttaggatggataggcatgtgagttgtctattctaagctcctcatggcctttttaagataatggaagtacttctggcctggttatctatgatcgtaagtaagactttttagatataaatctaacaaatttaatttatttttgtcataaaaattataccctaatagagtaatcgttggccgaagtcttatcctatcgaaataaaacacgtcttatatttatattttaagatgaatggagtataaataaagccatgatcagagttagccaatcatagtgaagaaagcaaaccctgatgacccactctaaattaacataagttcaaataataaatatatagctcaaatcataaattgtttcaatcttttacatactcttggcaccacattaaattaaagaccagcaataccctactctctccgtcccactcactaagacacacatgtattttaaaattcaactcttttaaatattcgactaataaatagcttattataaattaaattttatttgatgaaaataatatcattggattatcatttaaatttactttcatatggttatgattttgttgctacaaatattataatatatgataaatttaaagtcaaatatttgtcctgaagactatgacaaattcgaccgtgtctttgggagtgagacggagggagtgctacataaacaccagaaccattgtgatttctgagctccatggcatgcagagtttcattcaccttgtcca

SEQ ID NO: 40623 - DNA, 1501 bp, Oryza sativa
acgtcttgtttggcttgcaatgaaaaaactcaagccaacaccatatttaaacgcaacatagaagacatcctcggaacgtagagttgaatgaaatttggaaaaaattcaaggaaaatgtactagttagccaattactgcaaaaattacttttttattcaaaggaccattggtgattatgttaatctcaaaatatattggcccagttttctagaggtgtttatagggatagtgtgtgcgtgtgtgctcatagaagcgggtgtgtacgtgttgttaatgtctacgtttgtattgtgtttctaaaaaactgacaaaatatccaccttaaaacgacggatcatactttagaggagctcttggtgaggttaaattaatcaacgtgtgcgtcaatggaaaaaaaatcaagattagagctatggatggacatatgatcaagctacggatgaactcaaactcaagttgaacatttacaattaatgtatataaatggacatatgactaattatacctactgtagaatgggggacttttggtggaatttccgaggagttgaactaatttcgtttgaaaatgctgtacaagttcatgtgtttcaaaggtgctttaaagccttatccgtagttcctaaaaggttacgaaattacacaattaagatggatgtatgaccggttttaatggcgatagataattttggacggcactgcaaacttatggatatcccttgcttcaaagttttcaactacttcctcgcacagtgacttatactaaaatgaagctattttttcaccttcatcttctcttagccaagcataaccattctcttcaccttgtttctcatctccactaatcataatcttttttcaattatctctacctattttttaatacccgtgcttgtaaaaaaataattacattatgggatggaggaagtacatattaggcgtaagcaagtattttgggccttttgggccagatgagaaaaaaaatgtattttgggcctaaaaaaaagtggagtagagaccatatgcatgcctataggcctgaaaagagaggcctgattgcagttttggggccaaaatgaggaaatcttgaccccaaaatgaactgagatttcaagtgaggctttgttttcctcctaggtgaactttggctttttaattatgttttatttaccataaatcgagcatcaatttccctaaagtagtacttcctccgtttctggttataagactttctagcattacccatattcatatagatgttaatgaatctagacatatccgtttcaggttataagacttccgtcattaacatctatataaatatggacaatgctagaaagtcttataacctgaaacggacgaagtattaccataggttcaaaggtttctggattgctttgtttataattatcccagtgattttgatctcctgtcctttaatttgaagtgcatgtattgtaattaaaatggtataaattaacctatgaacacgagagctaatg

SEQ ID NO: 40624 - DNA, 1075 bp, Oryza sativa
caccgcggtggcggccgctctagaactagtggatcccccaaatagtttgggattgatcggtaataattaatgcaacaacacactttcatatatatgtatacaaaattaaaatgtgtattaaaaagtacgcaatactacctgtataccaaggcacggtaaccttttgttgtaacattgtgatgaaactttatgttgctgttgatgtccatcgagtaaggcatatctccattgtggcaccttaaccactcatcgacacttccctaattatttgttagcataaagagataaaataagtaggtagaattaacattaatgcaaaatgtatcctggcgaatagtaagttgtatatgaaattttaccatctttatcccaagagcttctcgtgtgatgttgttgttagcccaaaaatatattaaataattgccatatgtctgttgctggaagaaattaggaattaatggatattcatatacaacttttggtggcagtggcacataactatactaaatggaaatgaagtgatatacaagtgtttatgtatgttcggagaacaagggcgcatgcaatgttagagcagtcccaataccagactgcatcacctagtcactggtattaatattaggcttagctcacccaatgcacaatgtttaaaatggtccaaataatgtaatttcatcctctcatttttttttcttcttcaaatagctctttcttttcaattgatgcttagactctattctctgctctattagttcatacgaggcaaagcttttgccctcttttcaaaaatgcttaattatactctatatccacgacccaacgagcttggctctcgtgaaagacctacatcatgcccctctctctctctctctctctctctcattgacatacccttttctttatccttatatccccatgcatggccttttagcctcagattatgattcataaattacaagggatgtttgataagttaacaataatgcactctatataacaattatctagccacttgtagtgatatgaatgaagccaatacataaggctgacttacaatacattctcttggaggaaa

SEQ ID NO: 40625 - DNA, 1501 bp, Oryza sativa
gagtggaaagagaaggggaagaaggaacacggcatgggcagtttggtccaaaagaaatttttagtgcggtgataggaaatttagtggcacatattaaataacccattaaattgtagtggcatgatttcaaatagttaaatattagtggtattttttaaaatcaccaaaataataatggcacgatccaattaacccaaaaaatttaacgccaaatttctatggaatatgattaatttagcggtttcttttttttttagttaaatttagcagtttcgataaaacagtagatctaatcctggttagcctcgcaccattactgagacgggaggttgccgtcgccaacgtaagccgttgttagcgaagggaacgacgctgatgagtatgttccattgtacggacaatgcgggttcttttagcaaattaccagtcgccactcccatcaatgatagcgaccacaatgacgaactgaaattcctatttggcgcacacgcgtcagtacaccatgtcgagcacacatttcgggccaccagaccacgtgtcgtgttaccctttttgagtgatttttggctcacctggcccactagtccacgtgtcgtgtttcctttttttcgacccaacgtggccatgtgttttcattcctttttttttcattttccaacattttaatgctcttggttttaaaacctaaactttcaactcaaatttaaaaactttcaaaccaaattttaatacttcaactcaaattttaaaaacttttgactccaatttcaaaactttaactcaaaattcaaaacttttgaatcaaatacaaaaactttcaactcaaatttataaattttcaaatcagatttactttcaactcaatttttaaaactttatctcaaaaatttttaaaaagtctacccaatattaaaaaattaaagttaaattatgaaagttttcaagtcaaatttgaaattttcaatttaaattttgaaacttttaatttcaaatttaaaactttcaacttaaattttaaaactttttgattccactatttatttattatttgtttgtaactaatcacgctaaactagtcgcacttaggcgctaaccgccctgcttagcgaggggggcgcggcccggggacgcgtttgtacatttccaggtcgcggcccaccagatatccgcgagagttcaagacgatgggtactttggtccagatggaagcgtgggccggcccatctgtaattattgggcccatttgcattagttgcaaggtacgtcaggcccactgttattgttgggctctgatgcttgtaaaacagacgcctgtctgttcatctccgaccgaccgacagcaaattaaaatcaatacaaaatcagcttgatttgggattatcgcatttcagacaagtatatgcatcacaaattcacgatgtgaagatagaaatgttctccacgtccaaagaaaagcaaccaaaaaaaacagaagaaaagagagcaagtttgccaacgacat

SEQ ID NO: 40626 - DNA, 1501 bp, Oryza sativa
ttatgcgtaatcaatgggtcaagagtgtgggacaattttgtagtgtcaaaagctgccgatcggtaggatctttacctatgaacaggttcttcatgtttggcttggtatcagtaaacatccatgcaaaggagacagccatagtcgcaattagaatcgcaaatacagcttctaatttcctcaccccgtagttttcaagagacaaaaaaatgaaactgaaaaaaaaaaaagaaacatctcgtaagtgacggtccaaacaaagatagttccacaattttcatgactttgaatactaattttgaaacagacctaacttagcaccgtgcaaagcacaaggcagaaatcctcacagaaactagcaagtgattaatattctaatccaattagtagtttttagtgctagtgaacatgtgagcacttgtacagacttctgaatcatatcattaatcaaagcaagggtctagaacgagatatataaaataactcttgatggacaacaacagaacatgtcctacttttatcagaaccaaaagtcccgtcaaagaattgcataagcacaagcagtgagtacggagttaaattaaaatacagtctatagctgtcagcagcatcaatccatcatgaaaaggtcagcacagtaacttggtactttatattccttcaggacaaacccaaaactatcataagcctctcctgacaaaattaagttaaattgaccaaaaacatcacatcattgagtaatcagcagcttggaattgtgaaaatgaaaaattcggaggtacaggttccgtgattatccatatttggaacttgggcattaatttttcatttctcatgaattcgcagccaaaacagatctgagactgtgttcatgtaaaatgaattggggcgaaagctaaaattcctcaagcattcaaccatcctacgttatagggtaccatgaatatgaagtctatcaatatacagtacagttatctccaacacagtgatcgtacgccgccaattttaagagaagtgaacaatcctcgaaattatgaaattaataaaggaagtactgtggtttacagcgaaatgagaagaactgaaccaacgcccaaaaaagtgaagctacaaattaaacgaaaacaacgaatcagcagcctataacagtcacagcaaaacctcccccaaatccagctcatgatctaacatcacacccaaactctttagtagcaagtagcaacaacacatttctttttttttctcaaatatactaagtatcaagaacttaaagcagcagcatttttttttcttttggaagcatctcaagttaagttggtgatagggaaaaagaaaagcaaacttctaatcttttggaactatggtgtgtgatctagacctcgtcaatcacaatcaccaaagccatgcgaaagatccaaaccaatcaggaatcgaaaccgacccaacaaaaaagaaaaaaaattcacaagactgaccaatccaaggcggtgatgacgacgccggc

SEQ ID NO: 40627 - DNA, 207 bp, Oryza sativa
atagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacatatcaacaagaagagttagttcctttaaggtcttgtccctagttctggtccattctttccttgtctgcttcccctct

SEQ ID NO: 40628 - DNA, 822 bp, Oryza sativa
aaggtcagccaaaggggcctcgttggcgctattgacgtcttcatactaatcgatggggtcgggcaatgacgcattggtgcagaggaggcatggttgagctgatgtcatgtgatgccatggagggaagagaaaaagaacaggagggttatggtttggagggatttacacgaatcttaaagcaacccgatgatctaaaatctacaagattgtaggggctcccaaaatttaactccaattaatcttggattagggccgaaacaattgatgatacttgttcatgctgatgttgctgaaacaatgtttctttgtagaaatgaatttacatcttatgttgcttgcttcatagagtagtgcgaaagagatgcgcacgatctcgcttcaatctgatcgcattgttgtccttggaaacaagacaacgctactagaacagggaaccaactcatttacctggcgaagtatgcaaggcgacaattaatggaggggatacactgaccaggattgggcatgcagaaatatgtgttcagagcacttcgggagatgctagcctttatggccatccagttcccaggctcccagctttgcgattggatcaggggagtgcaaatgcagtcatgtcgggccctggggtagagaggagcctgaagaacttgcatcactggctcactggctcactgcatcacaacacaatacaacgaccgcgaacatagttacacaatccacaagtactcagcaaatatgcaaaagccggatatggtgtaacactattgccttacgccagtaatctacgaagacttcattgttcccacaagagagattactagt

SEQ ID NO: 40629 - DNA, 1501 bp, Oryza sativa
atgtccattgtactgtactcattttaaatgtacgtaccgttaacttatatagttatatgcgtttgatcatttgtcaaaatttagtgaaactttaaaatttattatacttaaagtatatttaatgataaatttaaaataaaataaactttcagctgttatgttcaaaatcaacatcgtcagatattttaaattaaaggtagtacttttaaaaaaaggatttttgcggtgtgtcgtggcgaaactgctaccaagtttcaatgatcatatgccatttcataggataattactctcatcgtggtaagtaagaatcgattgcctattttcggcaggctgttgtttcaaagcatcgatctgcttggacaacttgagcaaagctagctagaactgggtcgatataattgcagcactaggcaatcaagagacggagctggccaccagctagctgagctgagctgatatgatcaacacagtgcagacttggtcgtgttcgagttcgatcgacggatggctgtcctgctcttgcgctcatgcatgtcatctcttcggaagtaggagtacagcagtacttgaggaatattattagagagtaagttgaactgttttcaatagttcagggtgtaaactaagctgaggaattgttaggaggttaaatgctgtggcaaaatagtttggaggagcgaaatgatttttttttcatatgaaaaacatctaaatttattttttgccaaaacactagtatatcatcaaattttcatccattaagaacgccttctcaatattaataattccaatgtgatatcttaatgctcaatgaacctaaaatagtttggatgagtgaaatggactctttttgagtttttttccatatgaaaacatctaaatttatttttttttgccaaaacactggtatatcatcaaattttcctccattaagaacgccttctcaacgttaataactccaatgttattatcttaatgccaaatgaacctaccatgaacgtcatgctcacaatttaattaacaacaaccgaggcactcaagatcattcgcggttgccgcttctcaccggttgcctgaacccttgggacccctccaaaagcttaattacccccaaaaccgcatgatctctctcttctcttctcttctcacacgtcgtcaaagcctctgactttggatatccccgaccccactaaacttaatcaacttgatcattacaacaattaagttgcctcttgaatccaacgaagtagctggtcaactctccgagctcgtagcctcgctctcccgcctataaattcaccgatcgatcgatcgatcgatctcagcatcagcagcagcagcagattcatttcttggtcttcgtctccgtctccgtccttgggttgatatccagaatcagtcggtttggtttgtcagcaatggcgaggctagccggcgttgctgctctctcgttggtgctcgtcttgctcggcgccggcgtgccccggccggcggccgccg

SEQ ID NO: 40630 - DNA, 267 bp, Oryza sativa
ttctcttcgctcttttttttcccgcttcctctctccccactaattttgctgcactccttttcctccacactctccatatctctcccacttcttccctcctcccatcctctctttcccactctcgtctggcctcctctaactcgggttagcggccgcaacggcgagagcggcaatgacttgcattgctcaggaggcgacagcggcctcggatcgtgcggatcctgctacctttcgcccccacacacttagatccacccactgcggcga

SEQ ID NO: 40631 - DNA, 1501 bp, Oryza sativa
cattatgtatacagcagtgccgtaagaatgttattgcacatcttattcattctttcaagaatgctggactgattttcaaagtgaccaatacatgtttaactttatacaattgtttgtctataggataggaccacatacttattgttgacgttgctctcaactcctgatggacagaagagagatgttagtgatgactactcctcgctgtcaagaaggccgatagatgttggtaacttctacaaggactaggctccatatgtaaatatttgcacatgcacatacaggttaattgcttctatttgttatgtacaagactgctaactggcctttatggttaatgcgtactccacatgtttgattgtttctggccttcatgaatattgatatactacttgatacattgatatccacctattactttatgttgggattgatatccacctcttcctttaattttgggatttgaacagaagtatctatctatctaacagtgcaactattatcatcattttattaaggttcacatgcattgggtgttttttctaatttactccattcaatatatgttaacgtgccttgcacgtgcacactcactagtaaataaaaatatgaaacaccatcgaagtatcaagtacaacatttcaatccaaacccaaaaaaatccatatacattggctgaaacatcaaaaactcaaaattgtaccagtcgaaatttgatttcttcctcctcttcaatagggccacataaaagcacaagacaatccaactaaatttctctctcctccgatgtgctgcgagctcccccatccagcagcaggcagcaagggagggatcgagcaaggagcgcatcctgctgccggcctccgcccgtgcgatgttgccgccccgccgacgacaaggctacgggcagcttggtgatgacgaccttccgcagcgccaacctcgcctccagggtctccgtgccccacgcctccaatgctcacagactaggcgagaagacaagagatgagaaaggatgaggagagagggagagagagcgcaagagggagaaggcgaatggataaggatgtagaggaagagagatgcgaggagttgagaataagcggcgaggagagcgcccaattgatcttttttttcatccgccgaccaacactaagggtttccacaaaaattagtgaaatatttaaaatatgaaaaataataataataatttttaatgctattagggaaaatgaaaacttttggtgctaaaaactaaaaaaaattaaaacgaattatgcaaaaaataaataaaaatgacaaaccgtccaaatgcatcagaacacgagagcaagttaaacaccaacgcggataagtcttctctgacatcagtgacccacgtccctctgactttacgtcagaggagcgcgatccaacaccgacggtcatatactacagacggactgacacggctcgtgtcatattccattcccatcaacccatcctacgttctacgcttcta

SEQ ID NO: 40632 - DNA, 232 bp, Oryza sativa
aaagttttaaaaattttattctaaatgtcagatatttatgatcgaatgcagcacattttcgtagctaaaaacaagtattttcagttataacagcattctgttatgcaaacttcattaacttgaaaagtacctaaaaatgttgtcttttctccatccattgagcaggtatgatatccatcactaggacatgaaggtttcctcttttcttttcttcttttttcttttttacagg

SEQ ID NO: 40633 - DNA, 314 bp, Oryza sativa
tgaatttttctgaatagtgtgatgctcgatcaattaaggcactaaaaacatgcaacttgtagtcacaccttgatgcctcaatcttacttttatttttgtttatagttgaactcatttcgttttatgaatattataatttcctaatttatttcttaaatagagtgtcatattgattattcttttttttttttggaatctcaagctcgcagactacccaatgcccatctctattttattgccactgattatcttggctaagtactcgagttacatctcaatgaactatgtcaattgtgcgccttaatgtgattcaa

SEQ ID NO: 40634 - DNA, 907 bp, Oryza sativa
tgtgagactagtacgaaactaatgagtatttctataaggtcgtaataattatatctggttaacaaatacaatagaggaaaactgatacatgaaaattattaatggtgatggttattgtccgccgaagcctcattcagccaactgttcatatgtgttgctatcatgtcttgatttgaaaggtactacctctgtttcaggttagaaagtacctctgtttcaggttataaaactttctagcattgcctacattcatataaatattaatgaatctagacacgcgcgcgcgcgcgcacatatatatatatatatatatatatatatatatatattcattaacatatatataaatgtgagcaatgctaaaaagtcttataatatgaaacggaggaagtagaagcgtagaacgtaggatgggttgatgggaatggaatatgacacgagccgtgtcagtccgtctgtagtatatgaccgtcggtgttggatcgcgctcctctgacgtaaagtcagagggacgtgggtcactgatgtcagagaagacttatccgcgttggtgtttaacttgctctcgtgttctgatgcatttggacggtttgtcatttttatttattttttgcataattcgttttaattttttttagtttttagcaccaaaagttttcattttccctaatagcattaaaaattattattattatttttcatattttaaatatttcactaatttttgtggaaacccttagtgttggtcggcggatgaaaaaaaagatcaattgggcgctctcctcgccgcttattctcaactcctcgcatctctcttcctctacatccttatccattcgccttctccctcttgcgctctctctccctctctcctcatcctttctcatctcttgtcttctcgcctagt

SEQ ID NO: 40635 - DNA, 1501 bp, Oryza sativa
agtggtgttttggcatttcccgttttgtttcttggaaaaacaagaaaatagatatctaacggtgactacaaatccaactcccaatcatgtgatgttttaccgctactcgaaaaagtttcactactaaataaaaaatatttcagactattaaatggtgaaacacagtttaatcatgattgaaatgtattattctcatagatgaaacatcaaactttaacagttgaaacatcaacaaattacaagagtaatctatactaatataaaaagtacaggttcatccccaatcctgcaatccttcagatccaatatcacataggacccacctgtcatccggctcaaacaaaccgcgccatcggtggatagaggtggccaaacgggcggcccggcccggcacggcacgggcacgggtccggcacggcccgtttcggcacggcccgttaggcacggctcatgaaacgggccgtgccgtcccgacccacgtgccgagccgccggcccaagcacggcccgtggatggccgggccgtgcccgtgccggcacggcatgcgtgtggcccgccgtgtcagtacgggccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctggccgtcagttgggagggatgagatacggacttgcggaaggatgagatgcggacttactacagtagccgtgccgtgctgtgccggcccgcgggctcggccggcggcccaagcacggcacggctactcgtgccgtgccggcacggcccgttactgtagcaggccgtgccgggccgagccggctacaggttccgccgtgcctcgggccgcccgttttggcccggcccgtttggccacctctatcggcggaccacgtcgcgcacgagaaaaaggccgataaaaaaaagaacgccaaacaacaaaaaaaaaatagcgattggtcaaacctctttcccggtagtgcgcctcgccgcctcccgcgcctgcgcgcacccgccgggcagccggccgtcgccgccggctccgggcgcggctccgtcgcgggccctaccctgccgcctcctcgctcaaagcccgccggttcccctcatccacttcttcacagtctcatcccaatcgcaactgccggggccaactccggccgccatcctgctgcgcctcctccccaccaggtcgctcaccgccgttgggcgcccttcgcctccccccgctggccacctcgcccacactccaaaccgccaggccacccaccgccagccggcggccccctcgcgtccgcgcctctctgcgccagaaatcaatccgccagcatccgccggacaatgctacggggacaactgcaggatggccaccctacaccgccacctgctcgcgcgtgcccgccggacagccggtgtcc

SEQ ID NO: 40636 - DNA, 310 bp, Oryza sativa
ttactgttaatgttcatcgcaatgtcaacattgtgttattatgtgattgttgatacttattctatattaagcatgctcatgttgattacattcaccactatcactagatcaaatctcattgtaaatatcatgtttattatcttgttattttggattaaaatatgccgaattatgaccaaagttccaacaatccaaaaacctgataggtcattttcggtagttggctttgctgcaacactgaaaccacatgcttttgatggttctaattataagagatggaaagcacgtgcactactgtggttgacagcga

SEQ ID NO: 40637 - DNA, 1501 bp, Oryza sativa
tatttgcatacaggtcgtagtactagattgatgatcatatagagatgagatctccctttttttttctttctttaacttggcttgcttccactccaagcatgtgtaccatgtaacatgcatccaaagtgtcgtttcatcatccatgatggaggaaaagctagctagccaacaatttgaggatgcataacatgttttttttatatataaagaaaagcataacgggatgtagttattgttgtttttaaaaaagttttatatgaattttaccaaaagctaattaattatctctggcaatatgtggttaccataccttgttaattatagtgtgttgtgcctttttttttaagttgatgtaaaataaagtcatgcatgattgttgcaatctgttttgcagaaattgtagttaggcaaaatatgttatcaagacgtatcattctctctatatattaattatagtattaccgtttgcattgcaccaaacaagatttgccatacaacatattgtaataccaaacggagcgacattcgattgacaaagatcaacctatgattttggagatattctgcttttctgatttgagaaagacaagcactacatataactataacttggaagcatactcctgccaaccttagatggaaatatctgtcattgagggagcatactatttagttttatttttccaatcaagccgtagttatgtaagtcgcaaacattcatcctgcaatctagctctatattatttggccataatattttgagcaaagatcgggataaattccattataaaaaaagggagccaaataaatagaaaagttagaacatgtgccaaaattttgtgcacatatgagtgagctttctaggaatttaggaatttagtgagactagagatgtgtcgctagtctccgtctctttaagaggagacacaacaaccgtggtgtgaccgtgttgtaaccgtgttgtatgtgtgcgcgtattccgtataataataataataataataataataataataataataataataataataataataataataataataataataataataactggaacagctaagctaagctgtacgtatgtacttacacttctgcgaatcatgcatgatattaaaattaccaacagtacgtaccgaaatagatatcttaggtacgatactggatacatgtactgcacacagtagcttagatatttttcaatgctattagctccctctgatgatcgatcagctagctcctacaattattatatataattaactagctaataacaagagagatcgatcgattgatattctttaataattatattccatccatccacatgattagttagacttatttcatatttaagtttttctaaataagttgtttctatttgtagtctctatacatataagatttaaatagaggtaaattaaatgtttgatcagaatccgatgagtcatcttaatacttactaagcattcaaatgattagccccaat

SEQ ID NO: 40638 - DNA, 1501 bp, Oryza sativa
catttttaactttgactattaatagcaaataaataaaaaagatcaatcaggtaaaattgacattagtagatttatcgttagataaactatcacaatatgcaactctttttatttaaaacatcttacttttatagatattaatgatcaaattagcatctcagagaacgtgttagactttaaaaatgcttatattttgatacggaggaagtatattctcaataatatttataaatatacagtttgaaaaaaatatcgataaaacatgtgtattggagactattatgcatgcactgataagagcaagtctaaaactattagtttatcttaaaaccaacgtcaaaattaaaacacaagtaaggtagcagcttaaaacgccaatagtatgcatctgaacagtgacctcagtgacatttttcagatgtgcccctgccccctatatttgagacaagaaaccgtgtacctcgacagattagaaccccaccctcatgggctcaggactcctataggccagcttagtttcgatgatctattggcttcaccactgcatccactcacaaaccattacatttgccgtgcaaaattagcaagaaaattaagcatgcatgtgcagtagtaccctggactctgttcttgtggttgtacattcatacatatattatcagtactggctttagctatagggtgtacctccaacaaataatagtacatgaaatcaatcaatcaattaattcatgcatgcatatttagatcgatcaacagtgttcatgtactagctagctagagtacttcctatacaactgatcatatgctgctatgtcaagctttagatcgatcgatctctattgttactaattaattacttcctcattacaaaaaagttacacctattatttttgtcgctaagatcaaagagaaattaactcaggttgcatgtaacgaaaattaaggaatgtatatgcacacatgcaactaatactccctccgtccagaaaggaggacgttctaggttagttaggaaaaattagtgttatgtgaaaatgaccattttgccctcaatttataggattggggctaatcatttgaatgcttagtaagtattaagatgactcatcggattctgatcaaacatttaatttacctctatttaaatcttatatgtatagagactacaaatagaaacaacttatttagaaaaacttaaatatgaaataagtctaactaatcatgtggatggatggaatataattattaaagaatatcaatcgatcgatctctcttgttattagctagttaattatatataataattgtaggagctagctgatcgatcatcagagggagctaatagcattgaaaaatatctaagctactgtgtgcagtacatgtatccagtatcgtacctaagatatctatttcggtacgtactgttggtaattttaatatcatgcatgattcgcagaagtgtaagtacatacgtacagcttagcttagctgttccagt

SEQ ID NO: 40639 - DNA, 609 bp, Oryza sativa
ccatcccatgaggtgggcttttgtaattttccaaagaattaatcttcgagtgggctaaggcccattcattaattccaacagtattaaccaaagaaaagaatgtttacttatattcatgttgatctatacgctacgctcccgatcttatattattaattaattgtaaagatgatctatactacattgctaattgcttcgcttgtatgatcccattgggcctacatctcataaattaaaagaactccaagtgaagttatagctagccaagggtgatctccattatcatcgcattaaccaaggagcatgcaggcaaacgagaagaaagatagccactccaaacatgttaccagtgaccgttcaaggaaaaaaaatgtttccagtctaattacaagttcctataccattaatcccagcatacacacttacatcacccactatcccttatattataggacgaaggaagtatatactaggaggcatatatacattgtaggatcgaacacaagcaaccaaacctaccggggggtgaatagtagggaaaaccaaaaacccaaaaacttttagcggaaataaaagttaccctcaaatcgatggaaatctcaacatagt

SEQ ID NO: 40640 - DNA, 1501 bp, Oryza sativa
ggctgcaaatcgtggaaaacaagcgagtgggaatccctgttgagttggatcccctgagtcgatggctgtggagccaggaaggaagccatcgagcaccatgatcaatgatagtggctgcttgcagcagggatgacattgccaggaataactgggcggccttgtgtcttgccgcagctgctctacccagctcaccattttcgtgttgcattgcccgattagagcacaatagactggatgcaattaattgataattgcgtgaaattaatgtatatctgataacaaacttaaaatgtatctgatcacaaacttaaaacttgagtgacttggatggatgacttcagtaggcttatggagacattgttttagcatctgcatctccatcttgtccaagacatcagcaagttgctcattcgattttttttttataaatgaagagcaaaccacataacataaattcagccagttgttcttcatcaactactgacctgaagacgacctattttgtatagcttaattacacaacaatgttcaggattcccagttttgcataactgattagcagtgatatgaaggtaaatacacatattgaacgtagtaatgtcccaaaaccaaacaacattttaagctgcaattacacatcagccgggaagaaccaagtcagaaactgcgccacagctccatgcctcgaagaccttaggtgccattggactcaacacatactgatgatcagtcctaaaaaacgatacattaccggctgtttaggatcatcatggatgatgcactgaatactgataacatcttgatgatgacatttttttcgtcatcgagagatcaagaacatcaagcaagcccttctgctctctactgagagtgtatagcttccctcggaagaaggcgatatcagatacatccatggttgagttctttttcctgtctgtaaatgagctgatgacgacgattcctttctgttgattgcaataggagacagaaatggcgtctccctgcaatatgatggcggcttaagataggaagcagcgggtggccgccggcacgccaggaacggcacaccgtgcggaggcgggcccggtcggtgagggacgggaagcggagcagcacgaggaccagcaggtcggtggggagatcctgccatgccgatgacggcgctgccaccatcttcttcctttggcggggaaggcgaacaccagtggtggcgggggcggcggaggggtaagaggggtgtcccccctccttctaaggggtcatgtatttataccctcggataagtggaattagggagacaagtatggatatgatccgagtagttcttagtgcctgaatagaactctgcttttccttccttatccaaaacatctttcgtatatgaggcatgattctatataaaacatggtatattgtgggccctgccgaaccctacccaagactattgggtataccttatctataacaccgacaatcaccaaattcaaacttcacttagcca

SEQ ID NO: 40641 - DNA, 1147 bp, Oryza sativa
cccgaaatattcgctctgttgatatgtgggagaaaacggtgccctcacccactcccaatctcgccgctcacaccttcctcctctccttcccacgcgtgggagatcggcgcgcggtttcagagggagtgtcaggaggttgcacgcgccgacggaggaaacggaaattctgttggtaggctttctcttggagagattagttattttgctttctatttcagtttaagaaacccaaaaacaaatttttggggaagattgtacgtaatctcttggtgatgctctaataatggaattgtctcagttgacaatacaaaatgcagtcaacaaatcattgagttggttttacttctgctatgagctgtgcgtcagtttggcataaatccaatctcttttgtatgcaattactaggaataacgtgcagacattgaacatgatgacatatgtccagttcttttccagagattggtgctgcatggaattagaatttacttgtacattaaatgattgcatcaaataaaatacggagtactatatcattacctgaaaaaatatggagtagaatatactctctctctctctctctctatatatatatatatataggcccaatattacaccaatatgattaagaaatgctttacatgcaggtagagctaacggtgaacaatgttttcgtggaggtaaaagaggaaactccaggtctacagccagtgtgcctcgatctactctctgtacgcatagtaaattgttggcttaggaggcatcaggagctccggtaacaccatagtgtgcctcgatctactctctacgcatagtaaattgagcttgtgtcgctacaaccgtagccacggagctagaacttgcttccaacctgatgagcaacaatgtcggccttgcgtagcaagcttaatggggtgaaccagtgcagcactgccgctatgtgcagcaaggaacatggcttgccgcaggtgctgtactgggccatttggtttcacgctacctggacttgcatatttgcatactgtcttatattctcataatgtcgtcaaaattgtatgaaattttatataactatttaaaccgcatgcatactaccatggtacctaggtgtaaaggatattttccccatgctgcttcaggggagtaaaga

SEQ ID NO: 40642 - DNA, 389 bp, Oryza sativa
cccaggattgggttttttttgggatggagggagtatgtgatttcaggcagaccttaattattgtgttcagcattcaacataataaaatgaatcatgagaactctcagcgcctcccaggcggcatagcacatgcaccttaccgctcagtgcctcagccaccgtcatatttccaatgtcatatttcccgtttggtttggtctgttattcgaatggttttaaatttaaaacctcctcgaaatgtaactcatatgtttgagtattggcttttatgtgtttctaaagacatgagaatctgcttttgatgagcgcagcagctctttgttggtccatttggctaagcaggaatggagtattgtttggtaacaaaatgttgtcttctcctttgcagg

SEQ ID NO: 40643 - DNA, 1501 bp, Oryza sativa
acatggattcttaattcgatcaacattcatagtaatacaacccacctaattaagtacctaactgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattaattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccgtcgccgtgtagatatgggatacccataatctccacagtagcccccgagtcctttgcagtcgaccatcgtagccttctcaaagttgataacccgagtacttcaaactcttcaagccaaaacctgccgagtggactgtaaagggcgaaaagatgaagaatatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacattctaaaaagttcacgaatgaacacacttgacaggcatccgaatatacaaactctaaagattacccatcaagtatcataaagattatggtaataaataagtcaaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatcctatatccaagcgacgcttcgtcttccccgccattttccccattccctgctacagtgcaaagctgcgccggcgaactagggttcacgactccggccaaatccacctccgaaaagtgcattaaaatccttcccgtgatccaccgcctcaatccctcacctctcccaagccatccctcgaatcaaatcagcacatttgagtgaaaccga

SEQ ID NO: 40644 - DNA, 1501 bp, Oryza sativa; identical to SEQ ID NO: 36318

SEQ ID NO: 40645 - DNA, 1501 bp, Oryza sativa
tgcaaaattgcgttctggagtatccaaacggtaccttaatactcttcaagcattcaaacatactttccttctctaccttgctcagggtgtagttggctggacgcaagtaatggcttcttttctccttcggttccgaatgaaggtcgtcgcattgtttcatatgcttgagatcattacgtgcttttagtgcatcttacgacttcccatataaacctaggaagcctaccaggttgacgtaaaggctcttagtgaggtgcaagacttcccaacagggtatcttctaaaaaatagacttcttcttctacatcgccgcgtgaccgtcttcactcactattggttggctgccaggtccctttctaaatagtactctcagatctttcaccagagcaaacacggtttttccgttccgatgcttaggcttagtacgttggtctgccttctattcgaaatgcttgctttcttccggacaaggtggcttgcaataaggaatcgatgacggcccatataaacaaccttcctacaatgttataaatacgtacttttagtttcatccatacagtgcgtgcaagccttgtaccgattatttgactgtccggataggttgctaagtgcaggccaatcgttaatggtcagcaacgctcgtaggccaatcttatttgtcctcgttccacacgggggcaccttctttcttcacaacagtttcagattttcaaccaatggtcttagctacacatcaatatcgtttccaggttgctttggaccttgaataataattggcatcatgatgtacttccgcttcatgcataatcaaggggggaagctgtagatatatatggttataggccaagtgctatgaccgctgcttatctctcccaatggattcatgccatccgtacttaaaccgaaccctatgtttcgtgtatcctctccaaagtcttcaaatgttctgtcgatgttttgccactgcaacccattggtggggtgtctcagcatcctgtcttgttgatgtttttctgcgtgccaacgcattattctagcatgcgctttcttcctgaacaaacgcctcagccatggtattatagggaaataacacatcaacttagttggaactctcttttttgaaggttgtccgtcaacatcacctgggtcatcttgtctaattttttgtcgtagtgccttacaaatcgggcatgttgtcacaccccgaagttttcctcccaagccaaaattgtaatttttataaatgaccctaagaaaatgctggtgaaatcaggagaaaaccctaagaaagtaatgcaaataataatcggatttgacatgtggaatttttcttgagttctacatgtcgaaattcattaacaggatttttagtggaatttttagagctctagaaataattttaaccaattaaaattgagcaagcaatatttttaattccagggaaaatcctttttcctttttctttttcttttccctccctttttcctccttttttttcgaa

SEQ ID NO: 40646 - DNA, 195 bp, Oryza sativa
aaaacgactttctttagtagtacggagggagttttaattagttcttgatccgttcaatggttcagctcaaaaaagttaaagttgtacacaccagaggtcaccagctatattattactcgtatggtttaagagaacacacaccatattaagttttttttgcatgggttcgtgctggtcccacatgttcactgcagg

SEQ ID NO: 40647 - DNA, 1501 bp, Oryza sativa
cctccacctagatcttcttctgtaaacatgttaataaagatttacaatctccaattatctttaggggaaataaagaaagaaaggtttggaacatgagaatcaccttggatttatgcacattcatgtatggtacggtcatgctcgttgttgcttgccagcttcttgcatccttgtagaattcgtcatgattcaacgccagtccaaatagatgcctggacgctcgattgcctcggcagtggaggggcacaggacgccaaccacatcaatatatggagccgacatggctgaggaagccgcagagctccaccatctgcatctgcttgcctcccatggtgcaaaagctgaagaactcgaagaggggcggcgacggtgacaaaggctcaacggtttggagtgcgggggaggcgcgagcggggtgactgctcggaggcggtgtgcggcgtaagtgatcgcggaggagggggtgggcggcggggtagggcgagcggtggaaaaggcggctgccgacggtgaccacggctctccggcgagcacgcgcgaggaggcgacgacggggacaccggctgtccggcgggcacgcgcgagcaggtggcggtgtagggtggccatcctgcagttgtccccgtagcattgtccggcggatgctggcggattgatttctggcgcagagaggcgcggacgcgagggggccgccggctggcggtgggtggcctggcggtttggagtgtgggcgaggtggccagcggggggaggcgaagggcgcccaacggcggtgagcgacctggtggggaggaggcgcagcaggatggcggccggagttggccccggcagttgcgattgggatgagactgtgaagaagtggatgaggggaaccggcgggctttgagcgaggaggcggcagggtagggcccgcgacggagccgcgcccggagccggcggcgacggccggctgcccggcgggtgcgcgcaggcgcgggaggcggcgaggcgcactaccgggaaagaggtttgaccaatcgctattttttttttgttgtttggcgttcttttttttatcggcctttttctcgtgcgcgacgtggtccgccgatagaggtggccaaacgggccgggccaaaacgggcggcccgaggcacggcggaacctgtagccggctcggcccggcacggcctgctacagtaacgggccgtgccggcacggcacgagtagccgtgccgtgcttgggccgccggccgagcccgcgggccggcacagcacggcacggctactgtagtaagtccgcatctcatccttccgcaagtccgtatctcatccctcccaactgacggccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacggcccgtactgacacggcg

SEQ ID NO: 40648 - DNA, 1501 bp, Oryza sativa
tctcttctcagcaatcatcaaaacagataataacaatcaatgaaattcacaaagagaacacctaaaattaatcctaagataatttcaagcaggcaatcagcaatgcatggaacacagaaaatcagcaacgaacctgcacccaacatcattcataccaacataattgctggattgaccatacttaaaatctcatgctaaagcattagtacaaaatctcgttgcgcaatgtaaaaactagtaagctgcactgtaacatgggtatcacagataacaaaaggatttgtttggtaaggcgatcttcagttgtctaggccgggcacctgcatgcggcggttggcgtccgacttcttgccgccgaggaactcgtcggggacgaccttgagctgcttccgcttcttggacttggcgatcttctggatggtcttggggttggtgacccgctgcagcttggtgcccgagcggagcacgttctccttcttgcgcttctcccgctcctcccgctgcttccgcttcgccgccttgctctgccggatctcctccttgagctccgccacgcgggcctggtacgcgcgcttcagggacttgtcgcgggcgcgctgctccagcggggtcggcttccgggacgccgccagcgcggaggcgcggcgggtgcgggcctccttccagcgccgcccggagacgcgcccggcgatgacgccgtcgtaggtgggctgcccgaaggaggcgggcttggaggggtcggacagggagggcaccgcgcggagcttggacggcctcggcgcgtcggcgtcggcgtcgaggtccatggagtcggcggcggccgcctcctccgcctcgcggcgcttgcgcttcccgcgctcgccgccgaggccctcgtcgaggtagcggaagtcgaggtgggacgccatgggggggatgggagaatcgggaagctagggtcgccgccgcctcgggtcggggaggaagagaggttggaggcgagcgaaggggagaagttttattagggtttgcatcacaagaggcggcgggccatatgggccagcttgcaaatatttgggccaggccagcttagcgcggccttgtttctttttttttccttttatgtactatttccgccaataatgtgagaataaatcctcttttacattgcaaaatttagactccataccgcaaaaacaagtcattttagacttttttgtcaacattatacaattttttactaccttttaacataaattttaaaagttacatatttatacatccaaaatccatattttgaataatttttattgttaaagtaaactcatgttcactacatgcattttaaacttattattttgagaccagaacgagttcttagaatatataacaagaattagtattttgccagttaactgcaacacaactctttctacaaggaaatcaggcagacattatcattatagtaaagatcagaatatgtaataataagtagaagtaatcaacgcaatagtgttacagt

SEQ ID NO: 40649 - DNA, 1501 bp, Oryza sativa
aaacctatttttcagtttgtttggtttgaggacaaataagatgggatgatccatgacacagaatattcccctaagaccaagatcaagttagcctagtcccttagaaattggcggaccaattcaacctattatttttctcactgacacgtggagaaaattccaattctaaaaataaatctaaacatacaccatattcaaattaatctttatttttgggacagaacgagtagcgtattcaaattaatcttcaggactgaaattttttgggactgaacgagtagcaagaagagaccattaacgggcagatcgtcagcaacatctttaggctgaggcttgtttatttcctaaaacaaaaacttttcacccatcatatcgattgtttgcacacatgcatggagtattaaatgtggaaaaaaaaacctattacacagtttgcgtgtaaattgtgagacgaatcttttaagcctaattgtgccatgatttgacaatgtggtgctacagtaaacatttgctaatgacagattaattaggcttaataaagtcgtctcgcggtttcctagcggaatctgtaacttgtttttgttattagataatgtttaatatactttaaatgtgcgtccgtatgtatgtccgtatattcgatgtgataaactgataccccaaaacaaaaatttatggtaactaaaccgggcctgaatgtttctgcggggagacatgagagacataaatcgacgttatgcggcgtatggagaattggagatcaccggtttgcatatatcaaaggccggcaaaaacttacatgcatcgatgtgccatccctaaacagtgtcagtgaaaaatggatgtttagtttacagtttgcaagaatcgagcgttcacaaatctttgcacctcgccaccacacagctgcaacaaggtattaataattaattgtcacatggatcaagagcaataagcagttaagcacccagcacagatggtgactcggtgaccaaggtctcaaaattccagaacataaaccaaaccaagcagcgcggcatcttacgatcttcaagaaagctatgaaagcagctcgggagcaaacaataggaaatacagttgatccagggttcaccaagctgttctgggtagggttaccgccacctcacgatttgactggtgcaattactgcgagatataccattatttccacacggtttggtaaaccctggtatgatcacttcatagaaacaatcgaacatcagaccaaaacacttcagagaaacaatcgatcattgggaccaacccgaaattcagctcgtcgttttacaatcactgctccctgcttgtttcagtccaaagagattttgaattctgatgggtggattttttccccctctcttctcagcaatcatcaaaacagataataacaatcaatgaaattcacaaagagaacacctaaaattaatcctaagataatttcaagcaggcaatcagcaatgcatggaacacagaaaatcag

SEQ ID NO: 40650 - DNA, 680 bp, Oryza sativa
gccagcgtcactatgacccccccccccccgaaaaaacccgttttctcttccctccttcctttcttttcctttcagttgcattctttttcgccggttaagctggcaagctgcatgccactcacagctgcccgaaaggaggttggctgctattttgaaaaccacctgcatattttggaaaccctctattaagggaattcgtttcatttcttttgttccactaaaaatgtttcacctagtgtactcacaatgtttcactatgtatagatctaatgttgcagtgaattgaaatattttttttgcaacaaatcacccacatatgatggaaaccctctattaagggaattcgttcatttgttgttccaccaaaaatgtttgacctagtgtacttataatgtttcactttgtatggatgaaatattgcagttacttgaaacattctttcgctatttgctgaaacattgttttcatataaggtaaaacaacgctcgacttaaaagattgaaacattttttatctacctagtgaaacaattctgatatacttagtggaacaacgtgcaacatttaaaaatgattcaataataagctagttttttcatcggaatatatccatgtgtggtcttgttttaaatatttaattacaacgaatttaatcgtgtaatcggatcatgatttggataa

SEQ ID NO: 40651 - DNA, 1501 bp, Oryza sativa
tgcggcgtttgggccagaaaaaatggggttgaggcccaggtttggcctcgtcacccggaacgccaacctctcttttcgcgttgtctgttttgtttggtggcgctctcttctgccggtgcacgtaaaaccgcgcggccctggtcgttccattcccgcggatgttaaggggggtgatgtcgactgtgaagcgggaagagtgacggtgatggtgccgtgttcccgtgcaacgagcgttgttatttcaagatagtaaaaagaggtgatgttagtgcattgggcttaaccgttcccctaacaaatattgggcaccacgttagcttctaccgcatccacttgaagtccgcaataccaaacttggtaacgtgttcctcaatctgattcagggagagtggagtgtggagcgacaaagaacagtgcgttgtgggggtcgtgacctcgctgtgtaatcctccacccacgagctcggtccccacttcccaaatcgccctcagccatcctctcgcgcacgcgtcggctgccatttttcccatcatgtgcctgtcctcaccatcccttccctcattgccatcccaccatggctaggagtagccaataaaggaagcaacaaaattaaagttttccaacataaatacaggaccaaaacacgaaatcatcacctaatttctacatctacaagattctcaactcaccagcaaaccctaggtactattcaaatctacagctttcggtggtgcagcaactgacgttggggctggagcggtggcggtggcgctagagttaccggtggtggagccgtcggtcccgggaccatgatcacatcccgcatctccgttggggaaagcggcgacgccctaggtctcgacggtggcggcaccacaaccaactcctttcatactcgtagccactgcggagcttcatcttcagtactcttgacggcgaggactggcaacacacggagcatcacgaggcgaggatagaaattgcgagaggagggatggaaaagatgagtcgtgagaggaggcgataagtcacaatagaaaacataagggtagcaatgtcatttaacccacttgtagctattagtctacaaggccattaggccacgacgtggcctcgttcacacccactgtagggcaagtagtctccatgtgtgtcttcggattttatggatctgtataactctctttctgcgcacgtaaattagagcaactcattatcgcatgattaattaagtgttaacttaaaaacttaaaatagagtacatgccaaatactatatctataattcatgattaatcctccatttacagtttggtacaataaagtttgtttttctttacgaaattgactctaattgcaaatttatttttttttctaaatatggtacttaaaaataaacgagaaaacccattccctctctcttcctccccaatacccccgcttttggagtctctcctcgaagaccgatcgcatccgcctccaaaccctagacgcggcggcca

SEQ ID NO: 40652 - DNA, 402 bp, Oryza sativa
ctgcacccctgatctgtgaatgaatctatgaatcgatattgtgaatgaatctgtgatgttgtgaatgagtatgtggctcgatgttgtcaatgaacctttgaatcaatattgtgaatatatttgtgatgttgtgaatgaatatgtgaatggatattgtgaatgaatttgtggtgaatctgtgaatcgtgctgtggagttgtgatgtggatttggggtttgatttgatgatatgcataccactcgattcgggagaaaataaaaaagaaaaaaggactagctgatggactgccgctaccctctctttagtcccggttgatgacaccaaccggacatcaaccgggactaaagatcgatctttagtcccggttttttcacccgggactaaagatagcgatctttagt

SEQ ID NO: 40653 - DNA, 1501 bp, Oryza sativa
aagcccgcctccttcgggcagcccacctacgacggcgtcatcgccgggcgcgtctccgggcggcgctggaaggaggcccgcacccgccgcgcctccgcgctggcggcgtcccggaagccgaccccgctggagcagcgcgcccgcgacaagtccctgaagcgcgcgtaccaggcccgcgtggcggagctcaaggaggagatccggcagagcaaggcggcgaagcggaagcagcgggaggagcgggagaagcgcaagaaggagaacgtgctccgctcgggcaccaagctgcagcgggtcaccaaccccaagaccatccagaagatcgccaagtccaagaagcggaagcagctcaaggtcgtccccgacgagttcctcggcggcaagaagtcggacgccaaccgccgcatgcaggtgcccggcctagacaactgaagatcgccttaccaaacaaatccttttgttatctgtgatacccatgttacagtgcagcttactagtttttacattgcgcaacgagattttgtactaatgctttagcatgagattttaagtatggtcaatccagcaattatgttggtatgaatgatgttgggtgcaggttcgttgctgattttctgtgttccatgcattgctgattgcctgcttgaaattatcttaggattaattttaggtgttctctttgtgaatttcattgattgttattatctgttttgatgattgctgagaagagagggggaaaaaatccacccatcagaattcaaaatctctttggactgaaacaagcagggagcagtgattgtaaaacgacgagctgaatttcgggttggtcccaatgatcgattgtttctctgaagtgttttggtctgatgttcgattgtttctatgaagtgatcataccagggtttaccaaaccgtgtggaaataatggtatatctcgcagtaattgcaccagtcaaatcgtgaggtggcggtaaccctacccagaacagcttggtgaaccctggatcaactgtatttcctattgtttgctcccgagctgctttcatagctttcttgaagatcgtaagatgccgcgctgcttggtttggtttatgttctggaattttgagaccttggtcaccgagtcaccatctgtgctgggtgcttaactgcttattgctcttgatccatgtgacaattaattattaataccttgttgcagctgtgtggtggcgaggtgcaaagatttgtgaacgctcgattcttgcaaactgtaaactaaacatccatttttcactgacactgtttagggatggcacatcgatgcatgtaagtttttgccggcctttgatatatgcaaaccggtgatctccaattctccatacgccgcataacgtcgatttatgtctctcatgtctccccgcagaaacattcaggcccggtttagttaccataaatttttgttttggggtatcagtttatcacatcgaatatacggacatacatacggacgcacatttaa

SEQ ID NO: 40654 - DNA, 507 bp, Oryza sativa
caccagcaaattttaaatatggctcgggacattaaaatattcttattgcatttttttgccggtttggtaaaaagagaacatgtaaatgtaaagcatatatgcccttcagtgactgccgtacatgacctgaaagcaagtcaatgaggctttatcaacaactaagcctaagggactcacccacagtcttcaacaagatatatttacaaccttaaatcttttcttggaaactaggcagaaattgattaatctttttatcagaaagaaaacgaccacaaaactgtcactccgtatgtctaaattccaaagttatttaggaagagagagatgcgtttcagattcagggtattcttttacttgacccatcagaattgagattttctttctctttaagtggaggcatgggcgacgcaaagattaatagcgacattacattagaagtggggatctactcggccatgattcttggaaccacgaaatctttttgggttttgtttgtttcgtcctagt

SEQ ID NO: 40655 - DNA, 1501 bp, Oryza sativa
ctaatttctaattccaagcaattatagttcagtacatgcagtcattcttgtgttcaatggagaactagcaagctacaacttaatgtgggtcaaataggtacccaggtccctaatttcttcagcaattctaatcagcaacaacgcaatggcaaggcttacaactgaacgaaagttgcattgttgtttcactgcattgttgtcgtacaacatgtattgctgctggtggcattgcagaaattgaacatggcctgaacatccgcagatagcagccaagggggtcagagattaaaacgctggcgccaattgccattcaatttagaacaatcagttggacatggtctgaacaattagtttcattttagctagctgctatcagtagcagtggcctccactaccaacaatcggctaggatctggcaagttagagtcctttcatgttgttggtatttactgggtaaatctatgagttaattttgtctgaaatctgaatttggcatcgggggtcaactttcaaagacttgtttcagtccaaatgataatagcagggtgtgattttttagactggcagcaatggcatggtttatttcagaaaattcagaaaataaggtggccttagaagaacaattgagtgaacatcttgctgtgtaccagggaagacgcagatgatcccataagcatactttatacaatgcgataccgggcagttatttgttcactacatgcaaactttattagttcagtgactgaattgtctagcaggttggcgtacaacattcaggattcaggaagagaagatattcggaagaggatttgagctgaagaagcaggacgtagatatccaactgagtagagcagttgcaccaagccatggcgtccgagtggatcattggcagtgcttccatccttgttgcacgaggctgccattgacaagctccgagctcgatggcttcctctctgcctccgctaccattgactccacggttttatggactgtctcacgcttactttctgctattccaacgcactgcaggatgcaaactgttagtgagtgcacatccaccatgtttaacaaacttaagtcagattttggctgaaactaaggcgaaagtgatcgaggcaacataagtttaccttcaaagatttcaaaggatttctgatgcctcctaggccaaccattgcaagctgctggggtgcagttgcctttgtctccctgaaggactgaaccaatgttcatcttcatcactatcctatagcctatagcatttattgtgctccttcattcactcatgggtttacatatggatagcctagaatggatatatatgatgtgaatgagtcatgacataaagcaatcaagtgaagtgcattgaattgttttgttctctttgggtgtcaggctttcaacaatgcaagccatcaagttctcactccgtctaaaataagtacagtgtattgtgttcttcaatagaggatctgctgatctggaagactgttacatctct

SEQ ID NO: 40656 - DNA, 1501 bp, Oryza sativa
gtgaactgttttttccccctctttgttgatcaggttgttagtcaaaatgcaacctagcaagttcaccttccatctagagaagtgcagcataatgtattgtttagaaactgattacatcataccatcaaaaccaaaatagtagtcatccgctgagtactgaaacattggaagaaattgaagcatcatagataccggcacctcccaggcctaccaggcaaacccattgtgaatagccattgaatttacctttcatccactatgccaaacgaaaaaaaattgttctagcaactcatttctctcatggttacttcctctgatctttcatcgagcaaaagaacaataggcctgtactgtagttattccactgagagatctcaagatgcagtatagccatccgacggagatagtcaaactatcaaacaaagcgcagatcaaaataggtgatagttttgaaaacacggtaagatcgaacttagagaggcaagaacttgaattcctggactggacaaacaagtgaaatctcggtacctcccaagcctaccatagccacgcagcaaataagctgaatttcgagtttggcatccatcaaaaacctgaattccctgtggttcattctcctgtgtctctcagctttagctactactcaccctcttgttatctcttttatatatgggctggattgggagagcttgtatatcatatatgtcgacaaccaaatgtactatctgattccatgcaataattattgattcagcacttgcagctagtcatgttcagtacatcaggccaccaccaaaatagtgctgccgtgatgcaaggggagccgcataagtctgatcactgatcagtttgggcacttcaattgttcatcagttcaagcagcaagtgaaactgtatccttgctaccactcaatgggaatcatgcattccgatgataaattgcaagtcttagaacagaatagcttggaaaacaacaaacagttaacacaaagggaggatcaaatgccaccaattgctgtgcggtgctgcatgtatccacattgctatgtcagcaaatctcaccagagttgtcgctttaaggatcgtattggcattagcattgtcgagatggaacagatgtggaatgttactgcgactacatggtgccattgcatgcttcggttcgccatggagaaagctcttcgtgatgccgttgccagttcgacacagtcgtttcgtgacatgaaaactcctgatgcctcctagtccgacagccatagcaacccagcagcatggctggttggagtggccactgctccatgttcctcgaagagctactcgtgtcagctactccatgttaacttgcaagaacttgatgatgcgcaccatgaactcttgttcatgatgatctctattaattcttgctagctaacatgagaagcgagaaatacaagcaaggttttgtgcaatctatttctcgcgcacgcatcacttttgccacctcatctggccttcttatgga

SEQ ID NO: 40657 - DNA, 157 bp, Oryza sativa
gccaccgcccttccaccccccgccatctccctccccttcgctctccccccaccacctccgccgcccaaggccatggcgatgatggccatggatacgccaccgaccaagggcatggcggtggggatggaggtggagctcccgttcccggacgacgagg

SEQ ID NO: 40658 - DNA, 1501 bp, Oryza sativa
agttcgtcatcagttactgaaggatcataggtaacaccggtatcaaactggaactggtcctgaaacttgtgaagaactgaagacgagcaaggctaattgtgcactactacacttgcatcatgggacggttcaatttgcccccaaatttgcatgtgacaatttttttgttgtcttcatgaaagacatatacttttgaagagaatttgtaaaattaagatactatatgtttgctgtgaattttgtaagcaatgcaaaatctagtcgcttttgattctttttggaagcaaatttttaagtcccattgtctcaatatctcatttccagtttccacctcgaagcatgatcttaagcacacgtagaattattattttatcaattttatttacttgttcatgttggctcatgcgtggagttgacctgatttaaatgaatttgtaaatagccaacataccgaactgacaacaaggttcacaatctcgaatgcctgcaggtcgactctaggatcccctgccagtgaatttcaagccacaatgagacgtagattttttttttgttaattttgatgaatttcgacaaattttgaatgaaattgaaaaataatcaaacaaaaacatttgagatctacattcgggccagctcgagatgttcaaaattcagagattgtgaaccctgagtacgtttttttcctcttttttctaattatagccttatacatgattataatcttctaacttcttcttaactggctgttattttatcaaaataaatcttatcaaattttggcaatgtcaaaattttggtaagtgggtaatattgccaaattttgataggattccttatatatttaccaaagtttggtaaaaaaactaaatgtatatctttggcaatttttttaaaaaagacatggtttgaaatgacactaatctaaacaacccttatacttttaatatagttggtatcactaacttctaaaactcagtatgcaagtgtacaacatcgtcatccactgttaagtattatctatagtattttaaatcatatacaagtacgtcacatcatcactcactaacaattattatatcgattattttaaatatcatgttagcatgacatagtataatttatgattttgttgtatttttaaaacttaatacgtaaacaatgtcaaatcgtcatctccacattacttttacattatttaaagatgtaacatacattcatccaaatataacgtagcaaagtgctagtactgtatcaatatgaaacactgaaacctaacaccagctggtgcgtttcatttcaaatattcaaagcaaaagggaaaaaaatgggcctaattcgaggggacggcccaggtgaaagcccattgggcctggactgagacggcccagctaggcccaattcgaggagtagtatagaatcccaaagccctaaactaaacctacgcgctcgcgtgcttacccgcctcgcgtacccacaccatgggcggcggcgccgtcct

SEQ ID NO: 40659 - DNA, 1501 bp, Oryza sativa
tcgatcgattgctagcttggcttgagtgagtgagtgaggttggaggtggaaggccatggcgatcatcgaggagtatatataaggggggacatggagatggtggagaagctttcacaagctgataattatgttgtgctaactgctaagttagctaacgagtactatctccatttcagaatgtacgacgacgttgacttttcacataacgttcgaccattcgtgttattaaaaaaattagtatagatatataaaaatataggttaagattataatttatttgatggtcacaacaaataaataaataatattgatgtagtttttttaataagacgaatggttaaatagtatgcgaaaagttaacgacatcgtacattttaggagagaggttgtgtatactacctttgtagtttttttccctgtcagaatacgcatacgtctacaccatcatgtatgcacattacactcacacctgcaaatacgttcatgacacatgctcgaagagatggagtccagtgataaatccctagctttagtaataaaaacctattgaaagtgcaaccgcttgtgcataagttttgattaattattttttctttagtattttgcagtcattgagatgacaattagacttacattttgtaattttatattaaaaatgaaatgattatatctgtgactatgttttttcactatattatatacaataaataaataaaaacaaacttttacttttattataatattttgtaagaaaaatttacatatattttgttccagtacctttaaacagttttagaattgtttagaggcaaagatataaaagtttgatcttaacattgtccaaaacgtcaagagttgtgtaacggccaagcggaagtatttagggcatgttcactttgatgccattttcaaccataccatttttttggtaaagttgccaaaaaaatgtctacgtttagtttgttgccaaatttggtaaatacataagaaatcctgctaaaattttgacaatattgctatcttgccaaaatttggtaaggtttattttggctacaatctgaacagacccttaatttgctaactagtaatgtattatagttgtagttaaactctagaaagtttgacggcggagattttaggatgtcaagtaaagaatatgggtagtatcattattattagaccaaattattagtattgttttggaaaatcattgcatgcatgtatatataatctattgtgcttatgttgttgttgatgatgatggattgagatgtggtttaagtttgtgatgaacatatagattgtggagggggacaaggtaatctagtgagagagattggatacttagttaattcagttgatgttattgcttagctaatgatatgagtgtaaggttgtgtaggcctagtcattgacaggtggacatgacattgagattgcagtagtgcagacattgttacctcactttttatatgctaagacttttgtggtttccatacat

SEQ ID NO: 40660 - DNA, 1501 bp, Oryza sativa
ttataattaaatatacaagcaccatcgttaagtttataacttacacgtgaatatattgtactataagaaacctaaccaactgaaatatataatcttgtgattgcacttgatcgtttgtgtttccaacaaagatgagttttatgtgtaagggtgtgcttccttcaagacattatatgctttattgaggatttgagattgtgtagcacaaccctccatttcaatttgatcatcccctaaacaaatgacactaagaccaaggaaaacaaaatatttattaatctcaaattaatcctcattggttaagctcattggttaaggtgattcatcgcttcgtatcatgtgaattgctcatgttttaagtatcgtatgccattgcactaatagaaattaatcttggttggttgtatgcaacacattaaatgatgcatatttaatctttgcacaaataaacaaagaaacacttgttagacgataatcatttttaggaaaacctcaaaacccttaagggatgatcaaaatatgatggagggagtagtgaacagaggaatacaacattgtgctttatttctacgcaacctcaaaaaaattcttacggaaaaggttgtaggtgcaaatatgcttgtgttttaaataaacttttacaattatgtatgtacggcacaattatcttggggtgatatgtatatgtaggtgtcgtacctatctacatcaaagcatctatggactacggtgacttcactaatcttaaaatactccaaaatataatagattatggttagatgagatatatactaatactacaaatattgacaggaagctgtttagatttatagtattaagatgacggaggaagtatgttggtcggtgtacatgtgtgtgtttataaagacgcctgtttgtgggtgcatggtatgttgtgtgtttccgaaagagagtacttgtaggtatacaatattgatatgtatctcttcatcctctccccatcgtcctcgatgaaaatatctatttcatcgtgagatgagtcacaaaaagttccataaaaggtgattttcagaagaggatgacagtatgacttaaaagaccttgacttaatcattcgtttcatcgagagagaagaatattgaaactagaaaactcattaccagatgattaaataaatattaattattataaacttaaaagttaatatatttagttttttaaaagacaatttttatatattattttacgaataaatatacagtatagcagtttgaaacagaaaatgagaaagttaaagcatttaggctgcgttcgggaggagggcacgtaaaacgaaatacgtattattgcatgagtaattaagttttagctttttataaaataggttaatatgatttttaaaataatttttatatagattttttttaataaaaaatacacggtctggcagtttcaaaaacgagaaagctgagttagaaaactgagaaataacacaggcaggcttaaccctgacggaaga

SEQ ID NO: 40661 - DNA, 295 bp, Oryza sativa
tccctctacctttatgttagaggatcctaatccatatacgagcgtttatattgtgtgtgaaaaaaaaattgccaaccgtaagaagtattgtacggtgttgtagatgatccattttcgttcaatcgcgtcctaggtggtgccgtgctatgttcgtgggaaatttcagcacttgttagctacattatcgaaaacaaatatacgctttttttttgctttctcaaggaaaaggcgtatgatcggcagtccaaaactatacactaatgagcttgcctgtctttctgtctatctgtctagc

SEQ ID NO: 40662 - DNA, 318 bp, Oryza sativa
aatatccaaaaccaaaaggggaagcagccgttgacgactccggtttcagggaaacaaacaaagaaacgaacacaagaactgcaacttgatatgcgccgcaagagggattgataattgattgattgattggcctgataatccagctgccgaccgcctgaaagacctgtttaattctgattttccctgatttttttaaaaaattacgtacaaacacaaatttcactcaccgctatatacgcatgcacgcacatcctacccttataagcgtctccgaaagactgagctgacatatcttaagattgtcgaaatcaccacaga

SEQ ID NO: 40663 - DNA, 276 bp, Oryza sativa
gaatatgtagtgactcataaaatattatttcacggcataacttaattattaaatcctctatcagtgtacttttgaagaggagtgacagaaacaagaaaagcacggaagactcgatttttgtctccttttcttgtgaagtgttaactcctatataaactgattcccgtgaaatttccgtggttgaaaccaaagaattaatgagggtcgcgaagtgagcatagtcaactggttaggttccttgtggtggaaccagcccacccgggttcaaatcctaga

SEQ ID NO: 40664 - DNA, 604 bp, Oryza sativa
acaggaagcagcaagcctgagagggaaccatgttatagaatggcagaatattttgtcagtcactcttgatcactctagcaacagtcagaaagagtagtatgaatagtgatgtatgaattaaataaaggatgattatgttaccatggaaggataatactatggacaatgtaattaagcaacaaagcaggcaatattgtatccatgaaaagatatgtttacatttgagagctatctaatactgttgcctatcaacttgtctttcagatatttttacaaggaatctagtgtttttcaacttgttgcagatcaaggcgtgcaagtgaacttaatttgtttccttgtttgcatagtttttcacctatggatttattaaaaagagataattgcttatttgacgctcttttgtgttggaaatatagtcattaattggcatgttttaatccaaaaagttaaagcaataatcatggacaatcaaaacaaagacttttctaaactggacagtgggagtacatgtataagtgcaagtagatgtacctgtattttgtgtgccatagatcagtacgtagaaaacaaacccaacccagccgtacgttcttcaacatgc

SEQ ID NO: 40665 - DNA, 1501 bp, Oryza sativa
agctaatgcctactaaacacctaaatctcaacatacaacatactccctctatcccataatataagacatggtcaaagttgacatggtctccaaaactaatttttagcttataatttttcatatactaccaagtttataacaacaaaattataaccatatgaaagtaaatttaaatctcaatctaatgatataaattttaataaacaaaattcattttatattatactaagtgttggtaaaatgttttagaggttgaatattgaaatatgtgcacgtcttatattataggatggagggagtagtatttattagcattcctaaaatcaacatacgagcatgccacatcaacccactaagcacacaaagtttaacatacaagcaaacataatctacaacttatttaattctaaaactaaacatacacatgctaaatcatcattatcaaattattttcacaatatttcaatccaaaatcatttaatcatttctacaatatctcacatatatcccgcggcagagcacggttaatcatctaatatttaaaattcttctcattttatctctacctaccttcctacccccacatatctcttattaagggatattagagccttttcaaccttcatccatgctctttatattttaaaacaaactgacgtggttacatccatcgtatatccttgggatctgtccagatcggtgctattttaaaccatatattattgtttggtagaattataaatatataaaggcatttagtttgttatcaaatacgctgtccagattcgtagtattagaatacgtcacatcgacccaaaatcccttataatatgggacggatggagtattggtcagtctagagaatttaacaaatcacatttagtctattgtactaaaatttaataatgttggtaatttatcaaaattttggcaatgccaaattttaaaaagatgaaaatatctataaactgaactttcatccactgagaacacgctttcactataggaatatccgaagaattttcagggagatgccaaccgtctcccctttctacaaacacgagacgctttcactagcttttcaatatttgtcacatcaacaagtgtgaacacttagaatatgtaacaataaaccgtggtatcttctggagaatagtaacaaaatcgtttgcctctggagtcaagggctcaaggctgtaacatcgaagtgcttgtcaagaaagaaaaataaaccatagcactgatgatgatgagggcgacggatcggagaccacagctgccggcggatatacgagtgggcgctagaaccctgctccaagacccgaatattcatcgaaattatacttcaaaattttaagaaatagaacataaaatataaattttacgtagattatactatttaaactttagtcttgacaaaattctagctccgctgcacgcgcatgtcctcctccgtatccaactcaatatatgctatggtgcccactacagcatcgttaag

SEQ ID NO: 40666 - DNA, 1340 bp, Oryza sativa
tgggacccaattgtcagctccattcctcccttcttcaatttgtatgtgcttcaagccgcactatgacacgtcaaagtgcggcggtgtggcttgcggtgtgtacagattgaagaaggaggagtggggctgacaactaccccttcccctgtttttgtttattttcatccttaccacttacatgtgagacccatttatatttttaattcttttaatgactgagataccaccttaaccaagccaaattgctacatcagcaagaaccgctttcaaaaccaccgacggaatgaaaaactggtttttgaagttgggggaggtgttatatcctgttttgtggtttaaggatgtcatttgaccaacagcaagggatgagtgaggtgaaaatagacttattcctaaatgtatgatcggacttggatgtcccattaaagaaacatttcgggcctattcagattgtagccaaaataaaccttaccaattttttttcaatttggcaatattgccaaattttgatatgatatcttatgtatttatcagagtttggtaaaaattaaattgatgcacatatttaacaactttaccaaaaaaaatggtatgatttgaaatggcatcaatcttaacaacccattcatatgatcaattgatcatgttattacaagaagcaaaacaacttaaattttgtttaaaaacacataattatatattatcccaacaaataaaacgaaagaaaaattatttttcagagataacaaaactgaagagaaaaataataatgttacgtaacatggttaatcaacaagtctcggagatcgattagccactgcatccgaagttccgaacatccgtctcgcaaagtgcatgctcccagactgacagaagaaaaattattgtatgtttagttaacatcaaaattgaaagtttggttaaaattagaacgatgtgatggaaaagttgaaagtttgtgtgtaggaaagttttaatgtgattgaaaagttgaaagtttgaaatttttttttgcaacttatcacggcgtaaggcgcaagaagtatagttaaccaacaccagtaatatcgtacagtactactccaacatgtcaccaaacttctctcggcgcgcccggggtgaactccaatctacccgggatcctaactcgccaccaaacctcctcgtcgttcttcttttaccgcggccggacacggagcaggagcacgcacgcacgtacggcgcgcgctcgcctcactgcatttctatcccggccatcggtccggccgtcacgatgcgccgccgcgtcgctctgtgcctcgtgcttttcgccttcgccggcctgcacgcggcggcggtgg

SEQ ID NO: 40667 - DNA, 1501 bp, Oryza sativa
actacgcattaggatttggacggctaacatgagggaagtctcggtaatgcgtattagggaataagaatattacgagtgtcgcggtcgtatcagggaagtctccatttggatttggatttggtggtgtttaaaactcataagaataaagattaagttagagcacgtaaaatgagaaaactattagcacataattaattaagttttaattattataaacttaacagataaatatgtttgatattttaaaagcgactttcatatagaaaattttcgtacggaatgcgtcgtttagtaatttaaaaaacatgcttacgaaatcaggcatcactcttcgcttatgtatactgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggggtcgggttgcgcttgccccggccccgagggccgaggcaccccgaccccttaaagaagtctgcgccacatatatgggataagtgagcacagctgtgctcacctaaccgcatttattgcagtctggtcaagcgtgtcacgctgcgtacaacgcagtacagcacgctcttttatccggtctgtgaccagtcacagaccggtcagatcaagggttaggtggcgactgcggtctgacgcacgcctcgccccatcccgtcaagacgaaagcctcaaggcaactcgtctcaagccggagctagcgtgttatctcttagagatggcacgttagccctggttagatttataccaggcttcatcctaaccatacaggcaaggtgttacacgaagaagggcaaacatgcacgttgttaaactgacgcgtggtggacaagaatgaccgatctgacactggtcgcatcagcaacgggcagccacgatctcacgttgcgcccgtctccgccgggagtggggtaggtgtgagctgtcccatcgaagtgtcgtttggacagcaaccataccgatctccgtccataaagaaaagaacagtctagtttggaaagagaagggtgcatgtggtatccccttgaagtataaaaggaggaccttgcccatagaaaggtgggttgattcttttcgagattaagagcttagaacaggggagaagggggctgacactttgtagctcattcatacacaaatccacaaaaacacaggagtagggtattacgcttggcagcggcccgaacctgtatacatcgccgtgtctcgtgtgtcttgccggcgagtaatctttccacatacagagagagcttgagattgcaccctaagcccccggccgaaccggcaaaggggggcctgcgcggtctcccggtgaggagccacgagctccgtcatctggcgcgccaggtaggggggctcagcgtgtgttttctgagctctcagactcttccgtaggcgccaagtttcccttgttcagcctaa

SEQ ID NO: 40668 - DNA, 907 bp, Oryza sativa
ccctgctgtactgcgttgtacgcagcgtgacacgcttgaccagactgcaataaatgctgttagtgagcacagctgtgctcacttatcccatatatgtggcgcagacttctttaaggggtcggggtgcctcggccctcggggccggggcaagcgcaacccgaccccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatctcccttcccaagggaagcggtcaggtgtgacgccacccctaaagcctagtgacaggtgggaccggtctccgtagttgggcaaaatacccaacggtctcaatccatgcacattggtattggtaactttggttgtccatactgggcggtctattcaagactgccacatcacttgagcagcgcgcgaatctgggtgagcagatttgtttcgctcggagatacggtaacgccgcttcggtcggcgagcgtaattaacgcgcgcacgatacaatccgtttcgattgccacaaccgcatatccacttcacgcgccgtaaacgggcgaatgggattagtggaagcgtgggtgcgggaaacgagggagcgagatagcgagatacgagggagcgaagtagtgggcgcgagaaacgaggagccaggcccagcgatggcaagggtataaaagcatcgagaaaaggatttgctcccttcctttcgccattgttcctcttgcctttgccgcttaagctctaactctttccctgctacgccctactttcgccacacacgctcgttcccaatcatctcttcctccaccgcca

SEQ ID NO: 40669 - DNA, 1299 bp, Oryza sativa
tcgtccgccgcccgcgtttcgtcaagtgtgcagcagccccgtcgtcgtcttcgtcctcgcctccgcgtcgtcaagcctcgtgccggctgtgtctcgccttcgtcccaggatcgccgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttccaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaactgtttgctttctttttatgtgttgttattgcttctttataggcttgtagctttgcttgtgtgcttcgcgtagctttcgtcgttccggaggttcccgaagtgtggttcgcggtcgtcgccaaaggttcggaaggccgttctctctgagcaaggcaagtcacatcatccttgagcatattgaatcccagtttataaaattattttgatttaaattaatgcattactgctttatttaaattcccgcgttatcactgtttatttagccatgcctatttatcattgttaagacattattattgctattgttattattaccttgttcaccctaggaaaataaaaccccaactagtgggtactctatttatggttccactagtgtgaacttaggtagatgcttcgctggttaaataggcaacattaggtggttttataactttagactttgggaaatctcatatcatttggacattatggaatggttggcttatggtggaattggacatacacctctcttcctctttcaaaacccctaaaacctgttttccggtggggtttgggtgcatgccagttgtgggaagtagcaccctggccactataaggattaa

SEQ ID NO: 40670 - DNA, 889 bp, Oryza sativa
attcgttgctgtcagttaattttcttcatttttggtggtcagttcaagcctgcagtagtagaattagattggttcatgttgtttagttaagagaaaccaattgtatcatgctgctctgatctgaatagatggttgtgttcaacacctagtcaactaccattagcaatttatcataaatcagcccgtacggtatttgcttttgtaatgcagccagtgggcatcgatgctgattcatgatttgtaccaccagcttctgttaaccttgtattgtgccacgtggaagcctcataaccataggcatattcaactcctgttgttctaattgtctaagagaattaacaaaattaaaatcatgatagagccgcttgttgcttaattcttgcaaatatcttgccttctaagtcatggaataacatgcattttacatcatgaaaattctcagttattcattaccaaaccaatataatgatggcttgctactgttttcttgggagacaaaacaatgccagggcaattttagtttcaatatttctaaataccgtacggtctgattaatttatgataaatatgttgtcccagcagagaccaatgcatagaagttaatgctttttttacttttcggatgttgctttcctctggactaaatttctgagcctcactaatcacactaaatttgctattgcaaatgttccccttgtattgtactgattccattgtacttgttccgtttaattgcacatgctatgttgatatattactttaactagatgacaaaaataaaatgttaacatatggtgcggttctgaaagaaagacatttggaatagatgcaaggtttattgacaagtttctattttctgttgcctctgtatttaatcaattcttgaagc

SEQ ID NO: 40671 - DNA, 1501 bp, Oryza sativa
atgtccacctgtcaatgactaggcctacacaaccttacactcatatcattagctaagcaataacatcaactgaattaactaagtatccaatctctctcactagattaccttgtccccctccacaatctatatgttcatcacaaacttaaaccacatctcaatccatcatcatcaacaacaacataagcacaatagattatatatacatgcatgcaatgattttccaaaacaatactaataatttggtctaataataatgatactacccatattctttacttgacatcctaaaatctccgccgtcaaactttctagagtttaactacaactataatacattactagttagcaaattaagggtctgttcagattgtagccaaaataaaccttaccaaattttggcaagatagcaatattgtcaaaattttagcaggatttcttatgtatttaccaaatttggcaacaaactaaacgtagacatttttttggcaactttaccaaaaaaatggtatggttgaaaatggcatcaaagtgaacatgccctaaatacttccgcttggccgttacacaactcttgacgttttggacaatgttaagatcaaacttttatatctttgcctctaaacaattctaaaactgtttaaaggtactggaacaaaatatatgtaaatttttcttacaaaatattataataaaagtaaaagtttgtttttatttatttattgtatataatatagtgaaaaaacatagtcacagatataatcatttcatttttaatataaaattacaaaatgtaagtctaattgtcatctcaatgactgcaaaatactaaagaaaaaataattaatcaaaacttatgcacaagcggttgcactttcaataggtttttattactaaagctagggatttatcactggactccatctcttcgagcatgtgtcatgaacgtatttgcaggtgtgagtgtaatgtgcatacatgatggtgtagacgtatgcgtattctgacagggaaaaaaactacaaaggtagtatacacaacctctctcctaaaatgtacgatgtcgttaacttttcgcatactatttaaccattcgtcttattaaaaaaactacatcaatattatttatttatttgttgtgaccatcaaataaattataatcttaacctatatttttatatatctatactaatttttttaataacacgaatggtcgaacgttatgtgaaaagtcaacgtcgtcgtacattctgaaatggagatagtactcgttagctaacttagcagttagcacaacataattatcagcttgtgaaagcttctccaccatctccatgtccccccttatatatactcctcgatgatcgccatggccttccacctccaacctcactcactcactcaagccaagctagcaatcgatcgatcgagctcaatgcctccatccatggcgacggcgagggtggcgtcaccgtccacggacaggaagcgcaaggccagc

SEQ ID NO: 40672 - DNA, 1501 bp, Oryza sativa
agaggcacctagcttccttccacatagttaaccatatctgcagggggcagtacccaacatgtgtcgctttcatcaagatatgcagatctatgcaatttctcagggacccattggtatctagttctttaatttgtttttgtgcaaacctctttctgttcatatttgatcattactagggggaggtctttgtctttgcttctgatcacttcttttctctggcctaaacaggaacacatcaattgtttgccctgttacaagtgctatgctgatgtcacttcaggtaccaactagccctcaataatgtaaatcttgttgtaagatgagctcaaatccagctcctgcattcattggctcacagttgagagttcagtaatctgaatgtgaaagtgggaaaaatcctatttgttcagatatacctttcttcagagggagggcaactgcattagttctcccaaactgattagacatgtactggtatccatcccatgtgataaatgagcaaacctttttcacaacagttagtaaatgaggaggattagtcatacatatccccttgtccaaaaggtaaataaaatttcttctctgggatttttccctgtgataatcactgttgtctgccatttcatattactggattggtgactcatcagacattgcactgcactgatgacagctgattgcagatagtcatataaaaaggggcttgatctttggatcatgtttggccacaatagcacctataggatcctaaatgatactttcttttgtattgtctagaaaggagaaaaagtttacatcttttggcgacatgcatgcttagtgctgacaaagtacagagaatggttgacaagagtgcaataaaattttggactcgatcaggcctgcctccacaatcacccctaactcaatcttatgtccatattagccgcctgccttttcgtgtgacactgacctctcctcctcgaaggtgcagttgttgggattctcaaggatctgaaaaacgttggacagtaattttcagtagcagttacagtgcttattacaggtgttgtcaccaaactggggagctctcttggcccttttctcatgcagatgaaagcagattgtgataccatttttcttgtgcagatttcttggcttatctaaactctggatctctgcatgctgacgaggttagcaagttgctcaagtaactgagcatggagatgaagaccgacaaagtatgcttcagagaaaaggttctttgaaaaatctgtctttttttcgtacgagtctgcacaactttcttttactccctttatgttctaaagttcttcataaccactttatcatacatcccaagaaaaaataaacttacatactgatgactgccttgaaaaaactcacatactgaataatatttacaagtatattagtatgcattctagattagtcctgttactaaacatggccacttaaaaacgtttttgacaagaacatgtcaattagcagttacaaactt

SEQ ID NO: 40673 - DNA, 1501 bp, Oryza sativa
gggccattacatccgaggtcaggagtgccggcttgagctgatgcacctcctggcagtctccagtgatgcacattcatgatctcccctagtctggtagcaacagcaaatgctctgcaaagcttctgtcagctgaacgaactacttctgcatgacaaagacggaaacaggaaactctcaagcatcatgcgaatcgatccaatttggatgctgcaacattagtatggggatacataggagagggagaagaggagcaaacccatggatggccaaggtagaggtcaggtcatggtccctgcagtagctcgaaccaggttgggttgctcagtagcgtcagatttccatataggattaaccatttcatcatggttaaatgtgcttttcaccttcttgttagtttgtgttgtgctatgtgtacaaatcctggagttagtatacagtatttcctcaccgatgtactggtattttggttgtagcaacgttggtgttgcatcctgtatatataacattatactagtagtatgtatgtaaaactcttatatttccttgtgtaaaaagatctcttaatttttccattctatttccttttgtaaaagaatctctttttttttcctttgtaaaagttgagttcgtctacctcagaaaaaaaatgttggattcttctgggctgtgtgggttggaattcctggggaatttaactatttgtcacttttaggttcgtcacttatccaaatgctcctcatttgtgcttaaaaatttgccactgaaaagaggtaattttttaactatttgccacttttgtctacgtgatgtgtccgcgtgaaaagtaacgtgggccccacctgtgagccactcccctctccttctacctacgaccgccgtatatgtatcgaagtctaaaagtacttatattttaggacggagtatgtcaaagttccaaaatacttaatacttatattttaggacggagggagtaaaagtgataaatatttaagaaattaccactctcaagtagaaaattattaaacgtggacctaagagagtcatttggataagtaaaatcttaaaagtgacaaatagttaaattccatggaattcccaatgcctaatacagtagtacagtactacagtaataacctgcaaaatcatttactactagctctgtaaaaaaaggttttggcgccgagtcatgggtaatttgagttttaaaccctacctcatcgagccccagatcccgcccgcgatccccagattcccccaaaaatccaaaatccaaaaccccaaaaaaaagcgaaacacgattccacgaaaccctcgtccccctcctcgtgagatcggattcgattcatctcgtaggcgcgtctcccctcctttcgaattctccatttcgcgctcttctctcccattcccccaatctacttaacctcctcctcctcctcgagctccgaatcccaaaaccctagccccacccgccgccgcacgccggaggaggaggagatggctg

SEQ ID NO: 40674 - DNA, 1501 bp, Oryza sativa
  unsure (1)..(1501): unsure at all n locations
tgacttttttaaatatgtttgaccgttcgtcttattcaaaaacttttgcgaaatatatatacataanaattatatttaacaatgaatcaaatgataggaaaagaattaataattacttatttttttgaataagacgaacgatcaaacatgtttaaaaaagtcaacggcgtcaaacatttagggacggagggagtaaattacaatgaccccgggtgtatatatttatacccatgggtagatactagaccttgtgggacaaaaaaaaagaaactttactaaagataacaggaaaacataaagtccttatcggacactaaacacacttttctaaagataaaaggaaactaacaaactattcctaactaatagataaactgtcatgtcgcatcctcgttaaactcggtcgcttatggataaccttcctttagtagattaatttccttaaccgaatatagcagaaatccgactattggcgacttgataacttccatcggccgattttaggactctgaaaccgatactgactctaagtcgatgattactccggacttaccaaattttatcgttaacaataagctaacaagaattaaaaaaacaatgcatatgtagattgttttctcggtccttaattttcagctttatgaccatgttctttttagaattttttccctgcattcttgccactggttatttgctccatgcttctaaatatatgatttctaaaataaccttttttctattgcattgactaaaccgctcattccaagctatttgtgaagatgatttttttaaaatgttatttttatcgtggtaatcaaatacaattcacgttaatggtccggagaaaatgataactcaaacatggtggatttacatggtttgatgaattttctttttgttaattctgactttctgagttattttgacggacaagtcaacgatttaaggcaaagttgtacggagtggtagcgaaatcgatggcgataataatgaaaatgactactgatgtactgctaagcaagaaaatgggatgtatggaaaaaaaattgtattggatggagttggactaacatagagtttcaccacttgtgctggagcttttgtggatgctttgtaaaagaaaaaagtatggaatgatatctattgcccttttatattagttatccatcgcttttgataaaacatatggcaaaagatcatattaattagatgggagagggggagcttggaataaagccacaaagattaagattcgtactaggatatctcatggacatatacgcatttacaattcaatttgtcgttacatgatatttagtcttaattaatgaatatctaaaattgtccccctcgccccaacatgacagtcttacacggtggtttagggtccgtttgaaaatgtgatgaatgacacatgaaattaaggttaattatggagattattctctggaacgaacggatcgatggattaaacattagaaatttcaaaaaaatgattcat

SEQ ID NO: 40675 - DNA, 1501 bp, Oryza sativa
aaaacaaattaaagaactagataccaatgggtccctgagaaattgcatagatctgcatatcttgatgaaagcgacacatgttgggtactgccccctgcagatatggttaactatgtggaaggaagctaggtgcctctccttttctatcttgatcaagttgactagtatcaaatgtaagctctatccatcaccaataaaaagcatccatcctccccaatgctaacatcatcatcatcacacttgcacaaaacaaaggaaagctaagatggcaagaactcagcttccatctcccagcaaaaggctacctaaaaagtacagggcggtcctcctccagtacgcttatgacagcaagtctcccactaaagcaaaaaagaaaaaaaaaattgatgcctaacaagttaacagcagatggccacaatatatctgcagtatataactccattattggctcttgaaaggataacacgacgcataaaacaattctattcgcctcaccactccactttagttgttagttctcacttgtcacttctcagatcggattgttataatatcaatagaagtaacaagaaggatgcatgtcttcttctttccatcactatctttgaaaataatagtactccaaaaagaacagtgatgtaattaactaattactattactgctggtgcctatatgtgctgcttattgtgaattctgacctaaccatcatgctttttgtgcaagttaactaatttcagaaaaggtgaactatggtctacggtacatggtaaaaaaaaaaactgaatattttatatagctactattacagtagcatctatccccaggatgttcaacaggagcacatacaaagaaagtattgtaggattgcttcttatggcctaacctaaccatcattctagagccagaagctgtgggcttgcctgattagactagaccaaaaatcctaacaagattcatgactttgttaatgggaaatcgctttcatcaaaccccctgacgaatagtcaaacggcgcctgtatgaggcataccagccaatggaagaaagcttgtcatggaaatttcatgccttgtatcatgattcttgttttcttttaggaaaaagagcaggggtacacacatcaactagtgagatgtgtacaggaaaagatgacagaagcatatgcattgtgccttgcccctgggatatgtacaaccagggtagcatagcaccactacaatgtatgcaagggccaggcaagaaaggaaggagagataagcaactaaaagagagatccactaactccagacaaaactcttttacctcctgattcctcacaaagaccctccacaagcctcaattattacctcccgaaaaaaaaaattcccctctgccttctcctacctcgtcatcctttataaaagccatctgaaaactgaaagaagatgcaccatacatgagttgcaaacctgagagccagaaagcttgaaccacttacatggtaggagatggagcaggcag

SEQ ID NO: 40676 - DNA, 1501 bp, Oryza sativa
taaagtgcgatgctctttacaaatactcctttttttcttaattgaagtacagctatatgcattacaaattaaatcataactcaattcagcttgagtaaaaataactaaactaaatccacaatgaattatttatacaagttcttcatgttaaattaaaataataaacaaattactccctccgtttctatatataaggaattttggttggatgtgacacatccgtataacgaatctagatagatatttgcttaatactatcttttacctattcctcaaagataaaggtcttattaatgagtttttaatttggatataagaatcttatttttaactttacgttcaataattaataggagtcatacggattacaaaataccacacgcaccaaatggcacatttgtttttagaattttgaaactacaaccagtcagtttttatcgcgtatggttatccctttagtttattatttaagtgatctagcttaaatttataagagacttgaaccgaacttatataagtgatgtagcttatataagtttattatttaagtgatatatatactagcttatttaagtgatatggcttagcttatggcccgttcttctatagttactagctatgatcacaaaattatcaccagcacacactttccaagtttctagacaatatgatttctctgagaactattttttatcaaatatgaatcatttttttgaaatttctaatgtttaatccatcgatccgttcgttccagagaataatctccataattaaccttaatttcatgtgtcattcatcacattttcaaacggaccctaaaccaccgtgtaagactgtcatgttggggcgagggggacaattttagatattcattaattaagactaaatatcatgtaacgacaaattgaattgtaaatgcgtatatgtccatgagatatcctagtacgaatcttaatctttgtggctttattccaagctccccctctcccatctaattaatatgatcttttgccatatgttttatcaaaagcgatggataactaatataaaagggcaatagatatcattccatacttttttcttttacaaagcatccacaaaagctccagcacaagtggtgaaactctatgttagtccaactccatccaatacaattttttttccatacatcccattttcttgcttagcagtacatcagtagtcattttcattattatcgccatcgatttcgctaccactccgtacaactttgccttaaatcgttgacttgtccgtcaaaataactcagaaagtcagaattaacaaaaagaaaattcatcaaaccatgtaaatccaccatgtttgagttatcattttctccggaccattaacgtgaattgtatttgattaccacgataaaaataacattttaaaaaaatcatcttcacaaatagcttggaatgagcggtttagtcaatgcaatagaaaaaaggttattttagaaatcatatatttagaagca

SEQ ID NO: 40677 - DNA, 1501 bp, Oryza sativa
tgaaggtgggcatgaaagtggtttactagattggtcagttccacgccaccatatcctgtatcgctatttcgtcaaacacctagttggtgttctgtggtcttgccgacgttgtcatcgctcagctaaggctagtcgctgccgaaccgctagccctagctggtcaagggaggatgaattgtggggaagagagatagaacgagaggagaaggggtagttcaatgacatatcgcgtaaacacatgaaaaaaaaataaaggatagtaggtcttttagggtggagtggagcgggaaaaacccagctcaaccctcgtagtatgattttgtggagcaactctgctacctccgctcaaaaattgaaacacatctctaactatagggaagttggagttgagagctaaaaatgtgtcaaacgggcacttagttttctcttattttgagtggcttgatgtgtactctagatacgttgagtggtacccaccatcccatataaaaggccgtaaaagagacgagagactgtttgcacgtcacactcacaaaagcctatccccacgaatacgggtggacagaaaaagatcgaaccgaaaagactgagaccgagacgagaaattcggtcatcaattcggtactaggcagtgaaagaccgaattttgttcggtcaattcggttagtctctttggttaaccgaatataccgaattaacagaaaatgcctaaatgtaacctacagtccactaagttcaataggattaaactataactttcacatccctacttcttctaggcatgcaatctaataagagtctttactcatacttgcttacggattttcttttttgtgatttttgtgttgaaaatttccattatttctttgcacatatgaaaataatgctgaatttcggtcagaccgagaccaagaccgaaaagatcgagaccgaatttgtcggttctaacattttttgcgttgaaattctgttttcacttttcaaagaccaaagatcgagatcgaaaatttcggtcagaccgaatgcccacccctacccaagaagatgaggcgggcgagtgtgcggtgctgtggagtggaggtggtgttgcctagtggagtcgtgcagaaggagaatagatggggattgggatttggggagggttgactagggttagaagatatatatatacttgttcattgggcttcaattctatgggtcaaatgacggataaattttagaattggtccctaactccaatgaatacatgtcaccatggaagatgggaatgggtcccgatggtgatgagttttgaatcattaaatttcccataaatgatagatatcaaccatccccatccctaaatatgaattcaccgtggggaatcagtgattgggtcccgttgccgtctctgtacggcagtagtacaagtgagaggaggtttttccggttgagtggtggtacccaccatcccttataaaaggcccgtaaaagagacaagagactgtttgcgcgtcacact

SEQ ID NO: 40678 - DNA, 1501 bp, Oryza sativa
tccaccattgtggtgcctttgacgcatctcctccttcaccctaagcatatatatctagtactcacgtactacttccaccactgcacccgtgctaacctataagtctgcattcatctgacctactacaaattctctagaaggaatccaactcctatctaaaattaaccgtgtcgttgtaaggtttttgggtccggtttcctttataaactgaatcaattcttttattttatagtgcattgcaagagctctattcctgttccctcggagaaaagaataccattttttttagaataccatttgtccaccttcaattgttgggtgcaagatactcttccggttatcctcctagcatcaccctgagcgaaacctcacatgccaatggtgaataaatgacttcgctaatcgctaacaaatacatactgatgccctgttatacgttatgcataaatagatttagggcttcatctttttgcttatgcttatatttattagccaaaatttgaattttcaatcttaaatttagagttgattttgaggttttttttcattgtagtttatttttcagcctttgttttttgattgttaagaacacgtatgtaaaagttttattcacgaattatttttcatttgtaaatatgtcgtttggtagagctattaaactgtaatggcgtgttctaagagattaatagagttggtatggattatttgggccgcacttctaaaatacgttttttaaaagttatttgttcgctttttataatatttagttcatcgttatgaactgatatttttttctctatatccataatctatcaaaatcatcatcaccatgcccataagttacatgttgaaccattctaatgcatactgctaatacccctaacacccattgctttgctccttgactcaaagccaagatcaaagatgctctcagatcatagtctttaggtcagctatcagctcctctacttaaaccttgaacagtgtttgtcccactaatacagtagtagtaattcaatgtgcagtgtactaatactagtggtagactgactgagcagtgggccccacacggtaactggcagtgtcagtgacccgtagccgcggcggttgacccctccaaccctctctcatctcctcctatatttattcttcttttccactcttctccaactcctcctcctcaattccatggcgatggccaccacccaccacttacccggctgagccaagccacccccaagaacacgagggagagggatacaaacaatttcaaagagattcagttgatctcatcatccaagattcaagaagacgagacaggcaaagaagaggaagaattctgttcaattgcaattgatttcatcatccaagatccaagaagacgaggcagagaatagaaagaattctgttcgattgcaattgatttcatcatcccaagatccaagaagaagaagaggcagggaaagaattgtgttggattgattttgaagaagtggaggca

SEQ ID NO: 40679 - DNA, 1501 bp, Oryza sativa
accaccacacaaagttgcccctcacacaaagccattcatcctccattgtcgaaacaagatttcggcaataataaaaagggtagctatcaagctaggaaagtggatgggtttggagacaaggaattttatacaggttcaggccttcttattcaagaagtaataccctactcctgtccggggatgattccgccgagtgtgttattgattgtataaactggaaaaaagaaccggcccccaagaggcacacggaccctccttatataggggaaggaatccgctttacaaaatatagtccatatcctaacggaatatgggattatagataaaatacaatcgtaaccgactaggatcccgggtatttccttgacatacaagttaaaaactaacccgagtccccataaagatattctatctatatttggtaccatatatccgactaaagtataactgtcatacagatatggggtatccataatctccacagtagcccccgagaccttcgcagttgacgaaataaccttctcgaaacaaaaaacaatagtccgagtgcttcaattcaacttgctctagcttgccgagtactaaaaatcaaaaactgtgaagggcgaaaataaaacatggtgcatcgagtagatgcacctaattaggtgtagcccccgactatgtgattagttgaaaaactaaacatatagtcaagaaccaagtggttttatagcgaagcacgcatggtacttagtaagatacccagccacctgcttctcaacttgaacacaccaaggacaaaaaatacaagaagggccgagtgataaacactcaaaggtccagaaatagacatgtttgataggaatccgggtaaaaatctcataaaatgacccaccaaacatgatagaaaatcatggtaattaatgagtctaatagcttaggctgtgacccttaccataaccaaaataagcatataacatgctaaaagaatgactattaataaaccagtcatctcaaatcaacccaaacagcttttgcaacctaataaagcttacaaaaaaggatataacacctttctgtcgggcacctttttatgtgcatcataataatttcaaagaattattaaatcgcgttaaaaaggattttaacagcattgggccacaccattgtgaacacaaattgccaaagcaaaaagtgcctaagtccttagggatcacaacaggccacgctgattatagtattgggctgaagtactgtacaggcccaggcccattagtactcccgataccctaataataccaaagtgaaaaacgtctctttgtcttccccgccgagactctcgccattttccccatttcctgctacagtgtaaaactgcgccgggcaaactagggttcatcaatccgctccaatccactctcaaaaactttacaaaatttctccccgcatccatcgctccgattccccatccctttctagccatatctcgaactaaatcagaccatccagttcacattca

SEQ ID NO: 40680 - DNA, 656 bp, Oryza sativa
aatgacaagcaagataggtttctttttcactaaattcagttgtttctactcccctccaatatttactggattcagaataacttgatcattcagaaaaagaatgaacgtaataaaaaaaaaacttagggaagcaccagtaatatgtgttgaagttgtggatacatgaatccacccaccatggtttaaatcctaatgctcacgagtattacgcaaatgtaaatggactttcaatgggttttagtgagagcaagaatatgccgctgatttcggactctttgagcatggttaggagggtgtattcattggcatgcgtagtgatacgtgtgcgcgcatatgacgtgtaataaaaaaaaaagagttaagcatggaagctcaacagaatgtttgaggcccaagaaggcggcccatgtttgaggcccaagaagggcccggcccattccttccgcgacggccgaacgtgtcgtcgtctccgaccaccaccaccaccaaccagcgaccaaccaccacacacctgagcttcagctccagcggcggctctcttggcgtgctcctgctcagctgagctcgggtgagctctttctacctccaagatttcctcctcctacctccactccactcgcctcacctcagctcacctcagcgtcgtcttcttcctt

SEQ ID NO: 40681 - DNA, 1501 bp, Oryza sativa
gaaggagaaaaagaatttcggcccaatttaagtagaattggtttctcaattttgaaaggaatttgaatggtttggtttgaagagaatttaaatttggagaaagctaacaaaggagatatttttcccaatttattttgagtgcaataatttggagataaaatatattgaaatttgatgcactcaaatgaaaggtaggggtaataaatagaggcagataaataggatttgaatcctaaatttgatagtagaagtatttgaagaattatttgtggctaatagggaaagttgagtaaagaatataaattggtattttcttagcacaagagcaattattcacaatatttgcaataatactattcttgtgccgaagaggaaatgaagccacaggaattaaatcagtggctagatcaaaaggaagaatttggatatttgtatcgagaatcaaaggatgggtttaagatcaaagaatgggctaataattaattccaataaaattggaattactttggtttaggttcaagggaaaaaaattaggaaggtttcttggaccataatccataaaaaaaaatagaaagggttttcaaactaattttgaataaagaaattttagtcaaaagaaggttttaaaccaaatcaagaaatacctcaattcaaccacatgtattttaaatgaaaaacacaaaagaagttaataccagaaagagattttatgcaagttagttttagaaggtccctctaattatattttcctaggtttaggaagttattaagaacataagactcagcatgatgcagaattagaaaatggttaattttcggtatgttacagagtgcttccgcacgactgctcgttctcgccccaccatgtctgcgcctggagccggcgccgctgctgctgctggaggagatggcggaggtggtgcgccaccaggagctggagccggaggtggtgcgccaggagctggagccggtggcgcgaacaacaacaccaacggaggcaattctgcctcacaatctagcggagggccattctcggggtatatccttctcctgttcctgttcccgttgttagcgctttactgctatgttcctgttcctgttcccgttgttagcgctttactgctatgttcctgttcctgttcccgttgttagcgctttactgctatgttcctgttcctgatattcatgaataatgcctctagcatgctattgcgttactgctatgttcttgttcgtgatattcatgatgcgcatgatgtctttagtatgctactggttatgttacatgttgtcactagatcaccctacactgcttatgccatgattattgtcttaacattttggattaaaatatgccgattcatgaccatatttccaacaatccaaaaacctgataggccattttcggtagttggctttgctgctgcactgaaaccacatgcttttgatggttctaactataagagatggaaagcacgtgcactattgtggttgacagcga

SEQ ID NO: 40682 - DNA, 1501 bp, Oryza sativa
cctagccattctcctaccaaagcccaacctcgaccaatgctagccacatatccacttaaccagttagattattcggtatatcccctattatccaagaaaccaaaaaccacacataaaatataagtgacaattgttacttaatcccctctagcctccaacccttcagaacatacacatattagcccagtaatccctacaccctataaaggagataggttataccctaaaccctagcccttttagttgtttatcgttttcttgttattttatggattttattgaaattggttcttcctctttcttagtagagtctattttattttggatggcaacctgtggtatttcgaggatcggataatcaggttgtctatcttggatttatttgcgttggagcaaggcaagttattattcctcccttgaacataattaccctatattctatatttctattctatgcattagccattcatgattttgaatgcataacctgaatatatagcaaaccagatatgctagcttttgcttagccctgcctagttagactgcataaaaatataatgaacttagattgggacagtacgtaaaatttggttgatttccgggtggctagtattgtctcagtcgatataagtttaccaaatacttatgtcaaacgaacgagtacgaccgcagcttctagaatagggacagacctagatattatgttaattaacaatgtgatacctctgtacagtggttccttttgtatgtcctcgcgtaggaggcaatcttatgccgagcagggcatcttatgatatttaccgaggcgcaggtaaatatactgattttcgctcatgagctatgtgtgtgattttatggaaacctggttgagatgacgtggggtctctcatccagttctctctaaaaaccccgagaacgccagaactcctctcgctgctgataacgttacgttcagagcgcatggggactagagttcatggaacaggtgccacaattattgataacctaatactgggccatgactaagctaatgaatattggcaagtcgtggactgcgggtaaagcgtacatctactgcagtagaatattcatgaaactattcgaatagccgtgctcacggaattgagtatcgggactcatatggtatttggttagaaacttaattccaaattttattaaatactgttgcatcaaacacattgcaggatttatccttctatattctctgcttactgcaagtaatcatagccctactgaaatactactaattcatacattcatattgaatataatagcttgccgagtacattgtactcacccttgcttcaaccccctttttcagagtccatttggatcgagttcttatcaaagccgggagttcaatcacataagttagttccctttaaacctagtcttgaaatctagtattgttagatggtttaactctatagcaaaacattagagttgatttattctatagtttctgctatattagttagcc

SEQ ID NO: 40683 - DNA, 1470 bp, Oryza sativa
tttctcaatgattcagttggaatggttttcttaatcagttatgggattataagtacacacttgtcgtattaaaacataataattatcatttatttttgttgtggtttagtttatcactaaaggtaactttcacatgacttataatttttacatgttttcatagcttttgaataagataaatgatcgaacatatttttaaaagttaacggcaatatcttttgaaaaccggagaaaatatctaatattatttcttcgagatggccgttctgttagcttatgtgagtactaagttgattttcttttcattatcaggtaataaaattattatgtgcgcgcgcttatttcctcgatgagaattggtcacattgttgcagtatttttgttatatgctcccttttttttttcttcttatgtaacattggttacttgaatttgaactaaccaacttcgtatggaaataagaatggagggaggacgtactaaatgtatgtttttcttatcggttcataaccttctctttctctttggaagaaaacttactagattgtcaatactttatatatcttagtagtacaccttaacatgctcagctgcttttaacgtttgggattactttatttcattcaagcagttagcatatgttattaatatggagaaaaggccacacgctagttggcaatttgcacatggtctgccatgatttagccccagtctaacatagttccatacttccatgtcatgaaaagaatgaatggagagagagaaaaaaaaagtgcagggcactaagtacatggatcagcatataggaagcatctcgccgagatgcctgatttgttattacatcctagatcctcgtcattatcatccatgcaaaaaatattcgaatccaaccaggacagggttttttttccttcgtgccaaagatatttgagaaagcgtgtatttgtttcgacttagtttcaaactaacagcgtgccaaagatacacatttggcactgaaaaatcgatttacctatcatataatgagagagagataaaaaggaaattaattgaaggttatgaatttgtcgttgccatgtgcattttaatttgagggtgtgttaaggacacatttacggagagtgtgtgcgatgtgcatatatagtgatatgcgtgcacatgtctttcatataataaaaatatgggaaatacttacacacagatatgggtagaaacacgtttggtttctagcgcaataattttattctaaacaaaactattttttatatactcctcctctcaaccaatcgtaaccattattcatcttccctataatcacaaattaaagttaaaagagtcatcaaaactagaagaaaacaaatagtgttgctcatgaattttgccaatctccccatctagaggcggatcatccatttggctcttttacatttgagtgtgtattatggtcttaacgcaaatcgatattaaccc

SEQ ID NO: 40684 - DNA, 221 bp, Oryza sativa
cctgcaccccaaacaaccaagcacatgtttagcgcatcaccaacagtctactaataatctatcgccaaaatttaatttttgggattcctaaactgaaaataggtgttgaaaaaaccccttcctccaagagatagcctaaattcaatcccaaaaactaaaagtgggcccttctgttaaactaccaatagaaattctagtttttttcttttcccgtgcgcaga

SEQ ID NO: 40685 - DNA, 919 bp, Oryza sativa
attacgattttggaaggaaaaaaagggactactcgtacaatatattttttttaaaaaataaaagaatcttgtaaaggttcatgtggcgtattggtattgggtctatatttttcatctcggattgggatttgggaagccttttcaacaacggattgaagtataatttattaagtattataacatgaacaaaaaaaggattaacatgtttttctttctaaagcaccttttgtttataatttttttctcagaaaaaaacacactatttagctgttcgggatgcgggtgtgttagaaacgagcgagtagaagttagaaatgtgtagtatggaacaccctaactctcaaatcaggcaaatgagaatttagtcagcggaattatgaaataaattatggactgttcagattgtagccagaataaatcttactaaattttggcagtgtcaaaattgtgtcaatttggcaattttctcaagtttttgtaggatttcttatgtatttatcaaagtttataaaaaactaaatagatgcacatctttgataattttaccaaaaaaaatagtatggtttgaaatggcaccaatatgaacaatccgttagtgcatgtagctctgctcttatttaaattaacctgattatgatattaaacgagaaaattagaatttatttgagggtatgtgaattagtacttttttacatgtagagccaatgacaagatcaggaaaacacggacggtataaaaagctgaaaaggacactgcaaagatatggggtgtgtttggatgagctatggcttttgaaaaagtagctgtggcttttcgaaaagcagttgtgaaatatgtgttgtggcttttggaaaagctcgtttagttcaatagctgtagcttttgaaataaatagtcccacttacaagcgagccccaca

SEQ ID NO: 40686 - DNA, 491 bp, Oryza sativa
gtttgtcgccccaagcgccgtcgcgtctgccgcagcctgaagatcaccgcccgcaagagtacctccaggcccgaactgttcgtcagtccctggcgtggacctgcttcgtcgagacccctcgtgccgagcccgcgcctgtggttcctcaggaggagggagcctccggcgttggcagcacggaggatgcgctgctgctcaccttccgccctggcccgtcgcagaagtagacgagcagttagtaggcttgcgcgtgtgttcttctcgtttgtttttctgccagagtcgtgtggggcatggttataccggtgtgtggtataactgtgtcggagcctgtctttattttatttgcttaagcaacttgaaccttaatgaaccaatttaatagcagtaataaattcaagaattatggtagtcgtgggtggttagttttaatagtcagctctctctgtttgccggttctatgtgggattttcagatggtgacaaccagga

SEQ ID NO: 40687 - DNA, 929 bp, Oryza sativa
atttataaaatttatatatctatcttaagatggacagtctttccacagttgattggaccacatgatgtggttaatgttaagataaatctttaaaaattacagagcataaaaaatacataaatccggataataacttttccatatcctatagaataccaaactctgtgccccattaattagaaaactaacaattcatataaattctggaggtttcgatattttttaacccttgcaattaatcaaagaaatgcttaatttcttcaaatcaaaataaaatgaagaccaaagctgaagaaagaagatgtatttacttcttagtctaaaattaaaaaaatctggaaaggaatacagatattgaagaatagggcctccacttcatcttcttcaatcgattaaaactgaagaaaataacaaagatcaaagtgtgaaaaggattaaaaaggaaaggaaataaacaaagaaaaacattcctcgaactaccgatcactacttctcaatggctaccactcccacaacccatgttgttgataatagtgtctttttatgtgcactaaaaacaaggcaaacgagcaataaacataacaagtgggttataaaatttaaagtgccagcgcacctattttctagtgtcttttaaaaacggccatccaatttgcaagatttttaggttttgccacccatattgtgatcttgtcgctccgtgccactcggtgtatctgaccaggccgtcctatagtgcgccaggatggggccaaacaagccggataattgtgttagcttagataattaggatggatcagctaggagcttgtgtcacaatatattcatccaaactcgagtatgtggcttcacttatacacatctttataacaatatataactatagttagtggaagatgattatgccagcgtgggttcgcggtgtcagg

SEQ ID NO: 40688 - DNA, 1501 bp, Oryza sativa
tatacttcaaatgaaattttctcctaaattacttattcgatttatgatccgattacaccgttatgttcgtaacaattaaatctttataacaagattttacatgattatattttagataaaaaattacatttttttataatatatctaaattatttttagatttcattaaattacttcttagacatataaaaataaattcaataaagcttaaaagtaatttacatatagtaacttaaaaagaagaaagtaacttgttacgacattaaaagtaaatctgttgtggggctagaaacataagtctatctagaaattaaatttaataaacatattataaaactaaccaataaagtaaactgttcactgtatgtctaaaaagtaattaatagaatctagaagtaatttatatatatatgataaaagtaacttagatatataatcaaagtaatttacaacataaatttttttattataatataatcatgtaagatcttattataaatatttaattacaataaacacaatagtgtaattagattgtagatcggataaataattttatttgaattttagatggtagaaagtagatggggtatgtgacaaaagtaacagatgaaattggaaaagtgagaggtcttgatttaagactaacgtgctactgcacgctacatagacgcgtccatatttcaaattaaaaaaactttccattaattgctgagactagaaccgattggatggtattcccaacccatcccaatcacatgggcctttgcatcatatgcatgcatggatatttgcaatgcacgtgtatattcctagtaaatatatacaacaaatataaaattaaagaatggaagagcttacctgcttggcaggaagagagaccatagctatgaccataagagacatgacaaagagaacagcagtaccatccttcttgaaaatcgccatatcgcgggcgatatacctatagctttctttcctttcttgtgtttctaattttctcttatatttcagtatgcttgtaagtatattggcaattttcattcgtccttacttatatagaagtagacaatgaacctttcagatactaaataataattaaatatatacattcaatactttaatagaactctatggtattcaattgccacgtatacaggaaaacaaattttcatttattggactacatcttcagaatttggatgtcgttcatttaatggttttaagacattaatatcacatccaagaatatataaaaaaaaatggattgttgagaaacttgggcttttggcccaagaagaccagcccaacacactaataggccttaccctactttccacatatgagaattggctatataaagggaggagagtcgaggcttttgtatacggtgaaaagaacgtgaatgagaaaactctgtccttgcgaaaagacatgtagactagtggttacaagagcttcagtagcacctgaggccctgggttcgactccgcatgggagc

SEQ ID NO: 40689 - DNA, 1501 bp, Oryza sativa
ctacaggtgaaaccatatgacttgccacaaggcgtatcaccatactttcgagacttaatttgtggtatagtaccaaactttccacctagtgttattttgttagatcatttttggtttttcatctacatggtagcttgttttcgactgaagtctgaaataaggcgaatcatgatcgcaatcgaagcggaaatcgaattcaaacgagggggggggggggggaggtcaaaaaggaggaattgttgctttgcagcaatcaaaaccattacaagatggatggatgtgatcacagtttgctgccttttgccgtgtgtgtatgcagatgtggctttacagtgccaatttgtgtcctggcacgaggcagcagaggctacacggcagtgaacaaaaaaacgattccttctgctgcatttaccagggaatatgacgcagcagcagctgcagatggcaattgcaattctgattctctatcttaagtgaacccatcgcttttcttagccgaatgattgtctttttaattaataaggcctcgtgtgacacaggagataaaaagagctcttcaggtcgtgttcatagtacccatcgtcttcgtcgtcggttagggcctatttggttgcatgcatgatcttaatacgaaggacgagtgtttgaaatttctaaaatcttggactcctccggcacgcaactaattcgtctgaaattatgtttttttgaatttagtcaaagtttgtttaaagttactaaaaagttgtttgaaatttccgagatctcgtaaatatgtaaaacgaaatttcaaaccctcgacggtggaatattttctgatgcaagatgacaggaaaagtgtgccacaattgttggctccatttatcaagcgacatcgaaatcacagtaccatcaatagatttattgggagaaattaccttacttgaaagttacagctttatataaggtggagtatagtggggaatattgcagggttgaatgtaattggtgaggtgatgaatataaaaaatggatgtggagattatggatacctcatatctatatgacagttatactttagtcggatatatggtaccaaatatagatagaatatttttatggggactcgggttagtttttaacttgtatgtcaaggaaatacccgggatcctagtcggttacgattgtattttatctataatcccatattccgttaggatatggactgtattttgtaaagcggattccttcccctatataaggagggtccgtgtgcctcttggggggcggttcttttttctagtttatacaatcaataacacactcggcggaatcatccctggacaggagtagggtattacttcttgaataagaaggcctgaacctgtataaaattccttgtctccaaacccatccactttcctaacttgatagctacccccttttattattgccgaaatcttgtttcgacagttggcgcgccaggtaggggcagcgtcaagtttttgccgactaagtgcga

SEQ ID NO: 40690 - DNA, 1501 bp, Oryza sativa
agtacataactagaaagaaagacaaaggtaggaacttgcatataatggcatctaccatggggcatctctttccaaattcctaagggcatcaccaatgtatatttaccaactacgccctccattccaaatcgatctacatatatttttttaaggttattcctaaataatctatatatttgtgttcatttattaagtctattcgttatttatgcattggagtaaatggatattgattcatgcatccatgcacacaagtatttataccacacatgcaatatcttgatttgctattggctaggaagtagtggggatgatgcatgaattgagtttgttgctagagtaaatatagtatgagagagttattagcttttcttggtcttgttgtacctatgaaatatgtagatcaatttagaatggagggagtatgtcggagatatgggcccgggggtatacgaagtgaggggaatctaccttcccatcctgccacgtatccctatagcctggtcctgtccccgcattccgcgaaccgcaggagcggccggggagtcggggcctcggggtgccacatcatgcccctcgggcccttgcacttcttcgcctcgaggccctcgcccagccgccgtttggcggggggagcaagcgaggagggggcccaggctgaacttcctttaatgcgtgcagcgccccaactgccccctatcgcatttaatgcagtggggcaaacgtgcggcgtgctaaactgacgcacaatggtcaagaatgaccggtctgtgaccggcctgacgccggtcacgtctgactggacggacaaccgtgctcccacgtcgcatctgcttccggcggagtggaggtaggtatgacccgtcccatcggggggtcattcggacggcggccaccacaagtcttcacctattaatgagggaatgacagggctgttccccatgtcaggcgagggacgacgctgggccccgctcaaggacaagctgtggtttagcttccaggcgaaggcacgggtggagttccagtcaagatagggtgggtccccacccgaaagaagagtaggtagaggcggtgcatgtggtatccccttgaggtataaaaggaggaccttgcccaccgagaaagtggatgactctcagaaaatctgagcttgtggaggagggaagtaagaatgttctcccgagtttaggaactgttgtaactctcagtctaaatcccacacacaggagtagggtattacgcttcatagcggcccgaacctgtataatttggttgtgtgcgagctagctaggagccttggggatggatacgcgatttctagaggcgagcttcttcccccggccgaactcatgaagggaggggggtctcacgatcttctgctagagaggatcactcctcgacagctggtgcgccaggtagggggaagtcgtgcgctttaacgagaagtcgtttccttccgtcccaagtttcccttgaccctcgatgatcatggtcgaggtcc

SEQ ID NO: 40691 - DNA, 1501 bp, Oryza sativa
  unsure (1)..(1501): unsure at all n locations
ctaacatactcatattatttttcttaaaatttttttgatggatgtctctccctccaaatttcattttcttttataagtatgttttctgaactgctaaacgatacattttctgccaaaactttttagacaaaaagttcttttaaaaattaaataaatttattttttagtttgtaacaattaattaatactcacttaattatgtgctaatggctcttctcattttgtgtgcagccatcccgtggcatcaaatgcaatcaagtgtattggtagttggtggctgtatcacaaagatatataagaaaggaaaaaaatgcatatgtgtttgatttatgaaaaaaataaaggtgagatgaattttttggggggaaattcattttggctctgaatttggatatagtggttagggactagtggtggatactgttcaatgttctatccctcttttcattgacagcgagtgcttttgacaaaatggtgcacaaatgggaggatgccaaatcatggaatcccagctttatatatgcttgtggagtttcaactttcaacatctggaaggcacctccttggtacaaaagggggaggtcaaaaagaatagcttatttcagactaattgcatgatcagatgttctcattctgatctgtcaataaatgcggttaattgaagcttcaacaaactggagcttaagtatgtgctcttaattaattttaaatcatctcatcccatcttctagtgagattaaaaaaattgtttttccctgtagtattcaattgaaaatttgagtagttagcaaacgaagccttaatgttttggtattgaaagtaaaactattgcgcaattctaacttttacgaattcaattttagattatatttccatgaatgaagaacttcttacttcaagaaagaaaaaaaatactccctccttcccacaatataagggattttgattttttttcttgcaacgtttgaccactcgtcttattcaaattttttttacaaatataaaaaacgaaaagttgtgcttaaaatattgtggataataaagtaagtcacaaataaaataaacaataatttcaaaaaaaattgaataagangagtggtcaaacgttgcaagcaaaaactcaaaatcccttatattatgggacggagcttatattataggacggagggagtatatctttagtacaatcagtatactcccttcgctttttactagacatatttttaagagattactagacatattctgatttcagaaatatgtatatcctctatttaaagaaactaacttctgattacaatctaaacatagattttttaaaaaaaactaagtgagtagaaaatatttgggttcgttagatggtgtttggagtaaatcttttgtgcacacaaaacatagcgacatattaaaatatgattaattaagtattacctaattttttttaaaatagattaatatgatttttttaaaaatatatttttattgaaaattattttttata

SEQ ID NO: 40692 - DNA, 1501 bp, Oryza sativa
acaattcagtctttcagcccagagagtggcatcctctatgcacttagaagctaaacgattaagtgaaggggattcccctctgaaaacaacatcatggcgatgattccatagtccccataggcagagcaggaagaaggtgctgaagtgtttatctggcagactaccgcttggttgtagagagtgaagttccctggtatcactgatgtttgggacaattccaatcttcagccagaaatcaacagcgaaggggcaaaggaagcatagccgtttcttcagtcaggtgacagagatcacaagatgccgattgcacaatactccctccatattttaatatatgacgcagttaactttttaatcaacgtttgaccattcgtcttattcaaaaaatttatgtaattatcatttattttattgtggcttgatttattatcaaatattctttaagtataacataaatatttttatatttaaacaaaaaatttgaataagacgaatggtcaaacgttgttcgaagagtcaacggtgtcatacattaaaatacggagggagtatctttttgagaagattacctttcgttgggagtctttcctttgacagaagccaagcaaagaactgcacctttggcagggcccggatcttccacacaaaagtccaattagggcttgataaatgtcttttgtgcgcaagatcccccttgaactcgtggggtttctacggttgatcgatattggagcttgagaggatgataggatagacagagacgacggatcagcaatcaaaagaatctggagggaaactttctggctagctagctagtggcaccagccatggatatcatttcaggatttgggcggttgcattgcacaagacaagatggtttgtcgcatcctttctgctgcaccccacccctggtctgttcctgcttcatcctcccactgccaccactggcgccacctgcttcgagctttagctttatggcaccgaccatcagatccagcttcggtggagaagatgaacagtagaaagatggaaattgaaaggaccttaatgtcgcctagagggggggtgaataggcgttcctaaaaattatcacaacttcatagcatattagaatgatgagaactttcggttcaaatagtaacttccgatatgagattggaagttccggtctcaaccgaaaagttcggcggataatgaaataaaacactagctatgaacttgtagctcaaataaagaaaatgtatatgaatcaaaaggtgacaaataaggtatctaaacaagatataaggtcaccaactaaatcaattaagcatgcaagtcgatcgggtaaaaacaagctcaaacacaatatgagagaatgcacaaatgggcaaaccaagagaggagacgcgtgatttgtttcccgaagttcggttccacggatcctacgtctccgttgaggagccacaagggccgggcctatttcaaccctttcctcacgaggttgcacaaatgcactcct

SEQ ID NO: 40693 - DNA, 455 bp, Oryza sativa
cctgctactgcatcagtagtattgtaaaggatatgcatcatatatttatatatatatatacactaagctttaattaaaataaaataatcaaacgttacgtgaaaatttaacgatatcatggatgaggacagaatagtatttttcataataacacaagtggtctcaaagactggtgcagtagagagaagagaatagtgtggtcagtagagaggaggaaaagcctcttgtcgtctctttgacccaacgaccccgccattgctcacctccacctccacctcacctcctcctcctcctcatcccctcgccggagcggccacgccgccgggagggagggagctcgccgcagccgcagccgcagccgcaaccagccagctactgcgtgctgcaacctgggattttcttttttcttttttttcttgtggatttgatctgaagtggaggtgggaggaggagga

SEQ ID NO: 40694 - DNA, 1501 bp, Oryza sativa
ggagcggcgtccgcgtgagctggtccctggcatccacgggtgacgcggtgataccgtgaccgccctcgaggaggagcctggcgcactgcacggcgtcgtgcttgcaggcgaggtggagcagcctcgtggacatctcctggtccagcatccgcgacgcgtcggagccctccttcctgaagcttcccaccgccgcgagcagcagcgcggtgtcgtccaacgcgacggcgcgggacacggcggtctccttccccgccgccgccgccttgtccttgcgcgctgctgccttggcgcgatccatgctcccggtcgtctcttcactcgcgtcctgccaaaatcaaaccacaaaacgaactcttcaaacacttgaaacacagatgaacacaacgaacacataaataaatttcgctcaagtttacatcaaccgaaaacccatagcctcacataaacgaaatcaagaaacaaaatatcatctctgtacagaaagaaacccacgaaactcgagccatcgccgcactgtacgctaaacattttcaaacaaaagcagcaagcggaagaaccaggagatgggactgaaactgcagacagattcacaaaaatggaattccacgaatccatcagtcgcctctgcttttaagcaggcacgacaaggaaaatttcgcacggcggctgaaattggtcgaatcgtggcaccacaaataggtggaatacacacgaacgtaaatcatcgaaaagcccaaatctccaaaaaaaaaaaaaggaaaacaaggcatgaagccatcaacgaacagcacctaaaaccctagcactggtcaatccagaagcgccgagacactagacgacgcatattagcagtacgcatggatgacttgtgcatcggacaaatccgaacggagattctgaaaaaggaaaagagaataatcaagcattcccctactttgcacggggaatgattaaaatcctcaaaaatccttgtcaaatgaggcaaatcaatccaaaatccagaaatcaaatgaaagcaccgcaaggtagttaaaaattttcccaaacccacacaaaacgcaaaaagcacaagcgaaaaaaaaccgcatcatcgcaatatacataacggcatatttaatccacgagaactccaggcaaatggaagccagcgagaacccggcgcttgtcaaaccccaacatctcacgacgaaaccaccggaaacagagcaccatttcctccccctctcgtcgcttcggcgagcaacagaggcgacgtacgccatgctcgcgacgagagcttcgaggaaacgaaacgcgcaaaaagaggggggccaaaaccacacggatcccggcgaaaatcctcgaaaaaaacgagaaacccaactaaaacacacgaatctgagaaacaaggcaaccaaaaccccccaaaccgaatcaacatcaaaacgatctcctcgatcgctggacgctgcgcgcctcacctctcacatccgcgcttctcccccgaaccgcacccagcagt

SEQ ID NO: 40695 - DNA, 1501 bp, Oryza sativa
gccatcgtgtgagtagaagcaacaaaaggctacctgaagagctttataatttcccttagctgcagcactgtgtactggtgtaagaccaagtttgttcccctggaaaactctggcaccattcttcagcaggagccacacaatcctgcacaaatacataagacaactaagtaaagagaatgcaaagagcagtaagaactagtatgttgtattttaagtttttaacagttgatagaacaaaattctgatagcataccttggctcctgtgtgcttgaactaccactaaggcaccagtgaagtgctgtgtttccttcaggatcggcttcattgacatcaacatcccccatcaggagcatctttgtgacatttacatctccaacctttttgccgggtcggcggaaggacgccgaccaaatttcattaagatgaaagaagagttaccagtattacacgacattagactgtcgagccggggaagaaccccgaataaaagaagaaaaattaagaaaactgagaaagactatttacaagcaccaaagagcttaaggctactcctcgcaagagaaaaggccggctgctctccagatcaggacttcctccttaatgtctgcaactaagcgatcagccacaaccgatttattctcaaaaaccctggcattcctttctttccaaactctccagcaaaccagcatgaaaagtgaatcaaaagcagtcctgaacctcatctgaaaacagcggcgggcacaatgccaccaatctgccagttccatgccaagctgagcagggagaggaaaagtgacattcacccaagccttcaattgctgccacactctgttagtgaaagggcatttgacgagcaagtgattgcagtcctccggcgccgattgacatagcagacaagtgggatcatgtggccaacctcttttgctgaggttgtcggccgtgaggcaacgccccttcaccgccaaccagaggaagaacctcactcttgctggcgctttggtcttccaaatcagctccccgtgggggcatttgattgaggtggagaagagaaactcataagccgaagaagccgaaaagaccccgttagctgagaaccgccataaaactgaatctgcctcaccactctgaagcgagacgagctgcagctcatcccaaagcgccaggtaatcaacaagagctctattagagagagacccctgcaaatccctcacccatctgttgtttagcaggccttgtgcaacggtgatcttcgtgcgacccacaaaggagaaaagaataggccagttgtttgcaatgcttcctccacggggcagccacttacctctccaaaaatcagtgcgattgccatctccaacaatgtgctgtgccactgaattgaagatgtcgcgaacatccttatcagatttccaccgcaccattgtccaaggtctgtcttcttgctctagtctgttgaattcccatttcaaccttaaagcctttccgaagcgatcgatgtccctg

SEQ ID NO: 40696 - DNA, 809 bp, Oryza sativa
cgtcagcgcttatcatttcctttggaaaaatatttaataattgctcaataaattggtattaattatagaaattcattaaaatggctcaaaacttctaaaattcatatctaattcattcgaactccgaattgggccattcaacttgcaaaattcatctaaaattgagctctacatgtttgtttactttttatgtactctttgcttggtgtttattagagttttttttctcgttttgtgtgccagcgagtagattctgttgtttcagaagttcgcagtcacaaggatcagagttcagaagattgttgtgaagaagcaaggcaagtcacacattccccttgagcatgttgatcccaatttataaattttttatcgtttgcaaataaacatgcatgttttgctaattacatgggatcatggttttacctatctgcttggttgtgccatgtttacttgatatctgtcctttgtcaacattgggtaataaatcaactagctcatgttacttatgtgacatagctagaactatatgcttagccatgcttaattaccactagctcagttgatgggatgattgcagtattagacctttttagcaatagaacgagctgcgtgctcgagacacctggccatgtttcagtggtcgtaattatacaactaaaatgcgactgaatagtgggctgtgggtgcatggttttgctagtcgcaccctggaagaatttctcgtacttaccacaagccagcgtgggcaacgactgggcctgtagtgtagctttcctctagctgacgcatccaggcaagggtgggcatga

SEQ ID NO: 40697 - DNA, 374 bp, Oryza sativa
gacggtgataggctcttcttctgcaagtagttcatcaggtttgataacctcggaactacattaaatctgcggccaatctatcaattcttcccttgtaactagatttcaaaccctacacctaataaaggtccttaattatcaaagaattatagaaaacaaaatgcattaaaaattcatgctaagatcctctattgatgctaagattcactgcaccaaaatcatgtatataaaatctagcccctacattcatccaaaacattcacagacaacaaatcacatttaattcatctatacagcagcaccaataatcgaaacaacaaatcacatttcattcatctaaacaatgcaattcatccatcggaaaaaaggaggaa

SEQ ID NO: 40698 - DNA, 1501 bp, Oryza sativa
atggtctatataatgcagtagaaaaaaaattattttaaggaaccacatttttttaataaaccgtagagcaaatgttaatccctatacaactctcaatttgattcagtgaaagaattaaggtaggcccaattgatcatactaaacgtcttccctgcaataggttgatcatacaataaacccgatggagctgcccacagtaatacaaatcaacttggtctgacagagataacatcatactatagactctgccacataagtacacaatacaagaattgacagccttgtagtatattacaccaaattattaaccgcgacttatctagctaagtacctccaatgggagctcatatatctatcagacaagatttgacagctcccgtgtagtttatcacgcaagtgtgtagttgaccgaggcttaattacttaattatcccccaaatctgagttaagttacatatttaattctactagtgttgtaacaggtttttattcagtttagtttgaggattttaacccaacaagcagtttgttttttttttaaaaaaaatggttggttattaaaagaaaacaattttttaggtgtacggtttttaggagagaaatgaagtttccatgtggaggcagaggagaaagacattttcataatagtatatagagtatttactgtaaaactattctaattctcaagggcatatcttcttgttatttgcatattaattaaataactataaaaaatttaaaaagatgcattaatatactacttcagtcccataatagatgttgctttgactttctgcttacaatatttgaccattcgttttatttgaaaaattaatgtaaatataaaaaggataagtcacacttaaagtacttttgataataaagcaaatcacaaacaaaataaataataatttcaaatttttttaataaaacgaatgataaaaaaattacaaacaaaaagtctaagcaagttaaaattcaacttatacatatcgcaaaaaaaaaaacaaacacattaaactacagctagttaacgtatactcacagttaaatttatttttttcgttctaacatgtagaagttgaatttttaacttgtatacttatggagtgatatatcacatgttagtacatcttcttattttttttataactatttaggtgacatgcaaataataaaagaggacatccctccagagtttaaaattctctctcgatatttactactatttgagagacagagtaggttagctgctgcctctgtcaggtagtaaaccggaggtagcacaagagcagcgtctccctgactgctcagatgcagacgtgttcttgtctcacccttcacctgcatgatcctctctttttcaatccctcgatccactcatctctcctggctaagaatcaatctcttcttcacatcaatatcggagtgatcgatcagtctcgtcgcggttcgatcgattggcctctgatccgtacatcttcttgtgtgatcgatcaag

SEQ ID NO: 40699 - DNA, 1501 bp, Oryza sativa
gaatagaagatgtcagaccccgatctgaataaggtaaggtcttttctgccaagttctatttgaacatgaagttatttacccgcataaatgcatagtttataaaaaaagttatttacccatataaatgcatagtagtagagaataagcaagttgtgcctacttttagagattttctgactccgcccatgcctattaattgcgatgtgttatatgtacacttgactccattgaccagttgctagaagatctccattgatattctacacgacaaaagtttcaggaaattattagccccgtatcgtggtcccatcagctggggcacatgctccctccctctctcctttttggataatattttcttcacgacagaaaagttcatggcttgatgccattgccgccgattcggcacgtcaggagctgcgaattccgtgtgcttttgcaggaaggccgtatctgtgcgcttgcttgcgtcaaccacgtatccgagcggattctcagcgtcgaaacttctcacctgtcgcgttgaaaagttttggttgaaaccttctcctcctccaactaccttgtgtgtctggatgtaaacctgcattgacctgtgaccccagcagcacacactggtcccctttttcatttctctttcgtttccatcttctcaggtggcctacgcttagtcaaacgttaacggagaattggaattaagggaaaaacaagaaacggtctattgccgatatggccggcagtggtatatatctgactatcttgatcacatgggagctgtatgatcatgctagtatcgttttcatttcgggcctctagaatttccgttcactccatggcctgataggaacagtgaagcaagaaaaaaaaagaagaagaaaaacagcgggcaggctgtggtcggctgctgcacctgcttgccgaagaggtctaatttaaatgggaatgtgacaccacataaggtaacgaataatattacacattaaatgaaacacgtgttatacgattgagtaatttgaaaattttagtttttttatacgatgatcattggtcatggaacggagagggagatagtactaatttcctaggacttcatactttatggtcaatttcactcgtaagcattaaccgacttgtgtaaaagttacagagagtaacatggacatgatttgttaaccatcaaatcatcgattggattatacagatattgctcataatctgaaacgcatcgtgcaaaaagaagagggagttggcaacgtacggtgcacgcagtttacaaaataaaacgacggattgagatatgggaggagaagctccaaatcggttttgcttgatcgtgttggatctgtgcacgccatcgatcagtcggtttggcatgtgacggatacggagaatctgggtgggggtgtatgtacagttcagaatcctcggcaggtcaggaattacaatcgtacgggcaatcgcatctgtctagcctttgcccttctttctcacttgcattttt

SEQ ID NO: 40700 - DNA, 570 bp, Oryza sativa
ctagcaccgttgtaattggcatcatagtaacaaatagatgatccaatctccaataagggtcggacatctaattttgagcatagaaaatatcaaatagtattcggataatccgatcgccaatgaggaccggaccagccttataccattgattgtataaatggagtttgatgataaacgtgtttcggctctcattgatctggctttaatcatcaagatcaagatagattaagaacacgcagatgttccgatcgccaataaggaccgaacatctattgtgtttaatctagaaaattaatatttattcaatgtgctcaccatccagcgcaaatatcttgaatggcggcatgttgtcgataaatgactcgacttgacgaaggacgccggctgcggtgtttaattttctccgcagtggcagcggcaccggtttgctatcaccaggcgacttcaatctcctctcctgattttcctaatctactaagaagaatgggatgaatgaaaatgggcagatgggtgtctcctgtggcgtcctcggcgtcccccgctctagatgggttctgctccttatatagg

SEQ ID NO: 40701 - DNA, 1501 bp, Oryza sativa
cgccgtcgagcacttcgaggcgatgcggagggaggggttcaagccggacgccgtgacgttcaccggcgtgctcacggcgtgcagccacggcggcctcaccgacgaggggctaagatactacgacctgatgagggcggagtacggcatcgcggcgcggatggagcactacggctgcgtggtcgacctgctcggccggtcggggcagctcgaggaggcgatgcgggtggtgaccaccatgccgatgcggccaaacgaggtggtgctcggcgccctcctcgccggctgccggatgcacggggacgtcggcatggccgagcagctgatgcagcacctgctcgagctggaccccggcggcgacgccaactacgtgctgctgtcgaacatctacgccgccgtcggcaagtgggacggcgccgggaaggtccggagcctgatgaaggcgcgggggctgaggaagaggccgggctacagcgccgtggagatcgacggcgacgtgcacgagttcgtctccggcgatcggtcgcatccacaggcggaggagatatctcagatgcttgggttgctcatgcatgagatggcagggcatgattatgaccatgtaatcgattgcttggatgggggatgaattcagaccctggagactggagaatgcagaagactgatattctgaagtcaaaagatagccgacgttagattagagaactgttgtatatcagtagttcagtacatttagctgtcctgccactatgattccccctcatctgtgtagtcacaggagtgaagtccaacatgaattgaattatcgcaaaacacactgatttttctggacaatttcacggtatggctataaaacaaattggattttctcgtcaacagtcaatgacatacacaaggaagccactttacaggtacaaaaacgctgtacagaaacgcggtcagaaaagttaactgtgccgtgagcactgagctttctacgtcccctgcttggctgcttccataggccactaggcgagataccactaatcctccttttgaacctttcccagtttttatccaagtcatgaaacgtagttcgatggttcgcactggaactcataatccctgacaatcagcactaaaaactttggacaaccaactgttcaccctgatggttgtgaaggcacggagtaaacacctgacaaggtatcttctgttcacatgatccagcagcctgaaaggtatcttcagttgaatatagcttgcacatgctgtaagctcgacttcctacaaactaccgctgtatcatggcaagggatttgggatcatcctcagcatcaacagctttcctgtttccacaggtaaaattaaaatctatgaaatgcaacagagagaaatccattaatgtttgcaatacaggatcatagtcatagcgccctatttcttgaaatttttgtatgagaaagaatggaatactgaccagcttatgtacaagcaagtttgttagcaacacaagagtgattag

SEQ ID NO: 40702 - DNA, 1501 bp, Oryza sativa
gaagtttgtggttaaggtagtttcccttgctatagcccgtgatggtgctagtggaggggttgttcgtaccgtcactgtaagtgctcccttttttcgtccttattgtcattgtctgttcccttgttgtagatattttgaaacatcagataccggaactgattgctttagttgacttcatacaaacatgtaaatttctatgctatatttgtcatgctgtttgctgtgatggccatagaatatagtatcagatgaaacttaaaatgaaaaagttggccttttttaacttccatggactggttttcttgccaaaaatggataatatttcagtgtgatatatcccttatacttcattcagacctgttttactcttttactaaaatgtgttagggtattgtagacaagacattggatgattggaagcattagtaacaaattttcttatgtccttgttgggcatctatttgctttgattgcattttcttgtagctcttcctttttctgaaaatgtgtagcatgtggcaaagtaaattttaagttgaggcatgtcttgttatctttgcttaaaatgctattacttttctgaaagaccaatgattcttgaacttatggatatgataatcttgcagataaacgcagatggtgtttcgaggaaatttcaccctggagacaaactacaactgtggcatgaagagctggagccccagaactcgttgctggacatacttgcagctgggaaccctgatccgatggtccaatgaatctgccctccagccatacacctcccttaagcaactttcttctgtatctgactttcactagatttactgaagaactggactgcagaattatgttcagctgtgcgcaattatctagtgcaagatgcttcttgtgctgtatgtaatttcttttcgttaaggaagttcaaaaatatcatttagactttgatttgcctccttttgtggttttgatgcatatggcttgccccctcgtattggcagtatgttgctttctcttttctgcatattttcattttgtggctccatatgcacgtcgtaccttatagtcttcaactgaaaaccagactgttgtgtttattcaggcatagttagaagataaaggtgtagatgaagatttaagtttttttacgtaaaacgaggtgatactaacgtatgattggttaagttttaattattacaaacttgaaaaatagatcaatatgatatttcagagcaactttcatatagaaagttttcgcatgacacatactgtttatcagtttaaaaaccgtgccatgaaaatctttatctttatccaactcttgttggagaaatgaacaggatctatatatgttgtgaattgtatcgccaacatatcattgggatgctaatgaaaccaggataaaaggggatgaattctgaagaaaacctgaagaaaccaggggagagcaaaggctccgtgccaacgtgcccgcggggaaatgcctcagccctcagccatagac

SEQ ID NO: 40703 - DNA, 1501 bp, Oryza sativa
tctccagcagtttgctgctctcaactatttcttcatcgcctcccttaagaagcaaagatcaagtcattgcccaatgcgttcctatgaaaatgacctgcaagaaagatgtaggattggagcaattaaagaccacatcattgctatataaccaaattgcctaaagaaatgcagctatgcccacaaacaatattctcttgagcctggttcaacacaattcagccaattcccaaacatttgagacatgctacacagttgcctaatctcaaatgtaaaaaggagcgcactccaaatatacctagccattgagcaatcaaacaaaaggtgttatattgttacctttgagttacaaaaacaacttagactacccttccaccttctctttgctagattatccttagtgagaattaccccttccttaaggtaccacaagaaaattttgattttaagtggaatcttgagcttccaaatgaaattcttcttaggaaccaccccttcatacatgagcaacttgtacatagattttactgtggaaaggccatctttattgtttttccaaaagaagcgatctttctaatctgtcaaaacagtattaacaaccttcgacactagcttaataccttcgacactagctcataccaggcttcaagtttcttcccagtattgatcttctgaaagacacatttaacgggattctactcattaccttggccactacctcatttttatttctaactagattgtaaaggttaggatacttcttctcaaaggattatttaaggatgtccgcactatttaaggaataaggatgcacattatggatttgctccaacggtgccattgacatgtggacaagcatactaaatatggggaatgtagttgacaatgtaggcattagaatagctttaaaatgaaaaaaaaaacctcttagataatccctccaatccacccttcagcatgaagaaattcaacaatcttcaatccagcaagcatcttgctcaagtgagccttcgtttctctcttttgagattccaccccttgtttcgctttctgcttgagtttgttttgtacaaaactgcataaaaagaagcaaagtcagagggggtatacaaccaactcccaggtacaggaaaagaaggaaacaaagacaacttattcgattcagccttggatccattcagttgcgttgccctctcttgattttccttctgcgtcatttctgtgttgcagactgcaccggaatattaaaaagaagctaagtcacatgcaatgcaatctcactccaagccagatgtttgatgaaaacaaaacaacgaacacacagaaaatagggaaaccctgtattttattaatcacgattcattaacatgaatgtttacaaatacatgagggctcccacaggagttcgccttttgccttcgcgaggaatacttaatggaaaggtatgctgactggagattgcgtgtagtccgctgattcccggcgcctagcaatgaggcggccg

SEQ ID NO: 40704 - DNA, 1501 bp, Oryza sativa
ttcggcgtcacggagaccgtgcacgcacgcacgcacggacggacgctgtccgctgtggctgaagcgacaagcatcaaggctctataaagtgaagtaatagtgccctagatatataggcctagggctgatttcatatttggtgaatggtgaaacaaattccatgctgatacgatcgaacattgaagtcgtgcggattatctaagcggaaaatgacccttgattttgacaataataattaagcagaagattgcatatagcctagtggctacagtgacctgagtagtaccccaaggttctgagttcaaattttctatggagcgaatttattgtttgcagaactaaattccctatttcaatggatgcatatattcggttggatatagaggccgggtaaaaaatacccttctaaaaaaagaagcagaagactgcattttggccttgattttgtagtagctagaccgtggacaaccgaaggcgacgcggcgtcggtatcccattccagaccaccatctaggtggaataagttcactttaggtctcttaatttttcgcttggtctgattttcgattttgaaaaaaaaaatagctagaccgtggacaactgaaggcgacgcggcgtcggtatcccattccagagcaccatctgggtggaataagttcactttaggtctcttaatttttcgcttggtctgatttttgattttgaaaaaaaagccagttacaatggatccaggagttgaatctggagtgtaattgttgagtagtctaaacctaactttgcctctctagttcattttataaaaatgctccaccgagcttcgcgagctccgctcttgttttagctagagctacaaatgtttggttggttcagctccaggacatgtggagctggaacccacaaattggtcagcccacaattgctgaggccggcccaacatatcggcacagttcacgggaatctggctcaggcccagatcgtcgttactgggctggtagtttgtggtctgtccatagcgcgatatcagcccaacattcgcgacgtgggaatccagttccgaccaatatttccgcacgtaggccgcattaccgttccggcccatttcgtcgatcgccacgggaactcgccgtgccgcccgctaccgacgccgcggcgctctcctcgcggagagttatcagaacctgttccggttaatttccataatcaccaagaacaacggatggttttattctcaccgccataaaaaaaatcgtggctgcattggacggccagacgatccaaccacggcagcatctccatcttaggcctcgttcggcagcgccaggaacggcccggaacggcctcagttccggccggaacgaagcggcccgtttccaaatctggtctggcccggaagcgtcgttcgtttcggccggcccggattggaaacgggcccggtttggcctgcctccccctgttcctggcccggatccattccccacctctgaccctccggttccaatcc

SEQ ID NO: 40705 - DNA, 1501 bp, Oryza sativa
cttggccatgtgggacactcgctgcaaacgtgtgaaagcgagagtagaactacatcaagtagaataactcgtcattggagaatataatattttgaagatattttagtcaccctcataacattttatcaccaatgtcatatgaggagacatagtggaagcaatgcacatctaatttactgccccagccattttgcatagcactctaacttagagctgttgatcggtgttcctgcatagtccgtgataagtgatctattcaactcaagctcagcaatggcagagatgttgtgtaggaaattatgcatctggatttgcagagtggtgcttcaagggattgaatttgttgcacaataaattttggaacaaatctcttgcagatttaaaacacacgttgacatcgtgtttgccgctgtcgagctcaagttgtcaattggcattgttttgtaggctcactgaaggcaatcgagcctatggaatcagcttcggaatttatcattgaggggtcaaaaaattgccccctgcgcttgcttgtggtggaacacttgatgatttattttggtgactatcatcatgttggttagttaattgagtcttattgcttagattagcaagctctcatcttggtttgagaaattttgacgcattagcccaagggcttacacatgagaaacaagacccctgctgtctcatggagtatgattaacaataatagaggtagtcccaacctctatatgtatatttctataggacatcagggctgtccaagaaaatattattagagcgaaccggtattaaatgttgatatgcccctggcattcgacggcctctggatttgtcacctcaacttgaggtttgacagcgttgaagataatcgtttgacgaaacagcatgttgttcagcaaactaggagaacatataaataaacaaagatctgaagtgtttgttccctcactagggtgaccggtgctgaatttaaaatgtttttttattgcatagtcacatttggaaactttctatgtaactggcatgtgcagctcacatttttttaggccaatgttcaagcatcaggagagatgacccgaaccgtatgataaataaacaagagatataacgaatatctctcttaaaagtaatgagaatcatgtgaaaagaactcacacgcatagtagtcctttgattaatattttgttatctgagaagagtttttgcagcctcgactattttcaatcagatttcttcttcaaaggcatgcaagcagcgcatgagcgacactgcctggcttgctcaattgcaaggcttagctttgtatttgatgttaactcatgaatgagtctggaattactccgttgatatcttagttagccagtctcaccgcagaacatagccggtagaggagaaaagtgtagggatactcatgaatggtacaatgagtaccaagtagatttggatcagtagatcgacacatcacttgaaacaggttgcattgcttcattacataact

SEQ ID NO: 40706 - DNA, 1501 bp, Oryza sativa
gcgatcctttgagggaaccgagccggtcagggagctggttccggttttttctactatgatcccagtagatcttttttttttcggggatgatcccagtagatcttattatatacttcttctgttttatactatataagtcttattatatacttcttctgttttatactatgtaagtcatttgcttttttttcctaacttcaaactttttaagtttgaccaactttataaaaaaatatattatcattttcaatacaaaacaaacatattatcaaattatatttaatattgaatttaatgaaactaattttgtattgtagatactattttttttaaacttggtcaaatctaaagaactttgattaagaaaaaaagtaaaacgacttataatatgaaacgaagggagtattgaaaagaaaagtttggtcaggtcgttatccgtcatacatggcacatttgcggcccagcatatacatacataaatctgtttccaacacacagcatattctctactctctacttatactatactactattgtaatggcaaaatctaaaccgagaagcctcttagtttagtgtaaactagcgaccaaccggttgtgagaataagtactactacacgtgcatgctttttttcctcttagacatgcatgtctttttcttccttcttataaagttttctcaaattacttatccaatctacaatccgattacaccattgtattcgttacaattaaatcttcacaacaagatcttacatgattatattacgatgaaaaatatttatatttgcaaattacttttattatatacgtaagttacttttatcatatatataagttacttttaaatttgactaaattacttcttagatatataaaagtaaattcaataaagtctaaaagtaatttacatatattataaagtatctttaaacaaaactaaagtaactttgtcacaacattagaagtaaattcgttgtagggataaaaatatgactttatctagaaattaaatttaatcagcacagatcaacacacgtaagtttaacaatttttaaaagtaacttcaatgttaattggaagtaatttttgcatggttcagaagtaactctctataaatcttcaatgttaattagaagtaacttttggatcaatgaaaaaaggcatgcattaaagttactttttttttcgttataagttacttctataatatatctaaattacttttaggctttattgaatttacttttatatgtctaagaagtaatttagtgaaatctaaaagtaatttagatatattataaaagtaatttattatttttcatcaaaatataatcatgtgagattctgttataaagatttaatttttacgaacatgatggtgtaatcggatcgtagatcggatgagtagtttaagagaaaattttatttaaagtataggtggatagagtctctcatagatagagtggtagttggtttagacaaaccagctaccattagt

SEQ ID NO: 40707 - DNA, 597 bp, Oryza sativa
ggcctgggttggcttgggaacagttgggacccagggtcggttgcccagttcggtctgaatcatcgtaggccctgggttaaggcaaattcgtgagggttcacgaccttgattaataatactgtgtagctctaggatcgtctttttaaaatggctttgggcaactaagtgacttttaaatgctgtttactgcaaaacttaacccttattattaaccccttgtaccccctgcattaatcatgcatctgccggtgtgacttgctgagtactgtgggtgtactcattcttgctcaatctttccccccttcagtaagagaagcttgggagaagaagtcttaggtggagtcctggcttataccccagttgagcgcctgtgaagatggagccgtaggcccgcaagtccgctgctgtttatttttgtttgtcaggcctgaggtgcctttgtaataatgtaaatattatcgatataataaagatgtgtcttttatatcatgtttgtgtggtgtaccccggcttttcctgggacggggattaatacattagcgttcgggaaaaggcaattttctcggtcgcgacaggcaggaggccctctagggggca

SEQ ID NO: 40708 - DNA, 1501 bp, Oryza sativa
tcaaggaaaataatccaaccaaccgagtggtttcgataattgtagtcaaccaagcgacttgatattaatatgtagcatatgcggtgtgaatcctcgaataatataatccaagtgatatactgactgctttgtaaaacaagatgcgtacaacctaaagttgactacatcattgaaaaatcacatagcaaaaatagctataaagaaccttgtatgctgtgaataaagaattttccaaagtattgggcatacgtcatgcgtacactgctttaacagatgtgcttaagtccctaaaagacacatggtttcaccacacctgaaaatatatggcatatgtggtgtaacatccgagtaaataaactcataaaggatttaccaaccgcctggaaaatgaccacaatatataatcagcctaagccataatattggtcaataaaagtgcacacttacgtggcaaaaagcaacgatattgtatccaatcaattgcttaaaaacccaaacatcaccttgacttatataaaaaagtcagcggggcagctatataaagctttactatttaacaccttttaagatgcattgtaccaactcctaaaaagttgagtaactgcgatataaaaggattttaaggtattgggcacttgatcacgcgtactttggcctaagcaaaaagtgcctaagtccctaaaagaacgtgacaggccacacctgaaaatatgggctgcagacatattaggcataggccaaaaaatatgccttcgacaccctttaaaggatgacgcatgtaacatgcttccgagtaataaatcttccaggtgatatagaccaagtgtagctcatatgaatagcttctgatctgagtgattatcccttatgggatactcccaaatagatataataagtgaatcccgactggcacaagtattcggttgataacccttacggggaataataaatagtccagtctttgagcgtagaaaataggcccatggtcatgaattcatgttgcatgtatccggaacaagtccaaattgatggtatgatacttgtgtttgagctagtaagcccctgagcatatagcttgtccttctgtcgtagtcataattgtccattgatggtagctgacgtagttggcatatagacaagacgaccaatatagaaataatattgtccatcagaggtggcaaaaatattggtggtagtgaagatagtgatatcagtcaaaagtgatgaagttgcacagccgtggaggcgaagaaaccagtcggcagcagtcaggtcagccatcagtgaagatgaaggcgcccaacgataaagttatgtagccgtggcagtgaaataatcagtcgataacagataaggcgctcggtgaagaaaacaaagacgcccatcagtagaggcataataagccaaccgtgaaagcgaagacaccatgggcggtggcagaggcaagccagtggtgaaaacatagatgctcatcaatggcaatggcgaaatccatcaatca

SEQ ID NO: 40709 - DNA, 1501 bp, Oryza sativa
gctcgctggaaatttgagtgtgtaaaccccacaaatgagggttttctatgtaacataacaatgtatgctgattaattgattggattagcgagatagggtttagtttggcttggtcgttaccatgccattgtattcattttgtcagcgcttgtgtacgcgtttctcatcgcgaattttgctgtgtagtttgtaactagtgaccttttaccattatctaaccttgtccgtttctattactgacttcgaatcgaatcaaaatggatgccattttggatacttgctttcggtaggctttttctttttagatatccattttgcgttcatatatttgtattcaatgtgcgcgttgcaggtctcaatgattgtataattacactatcacgtcacatcaattgcatgccttagcatccatgtgcactatagtaattaggagaggacgttgaaaatctcgatcctaatcgtgataatgacggtgtctgcgtacggcaccaaccttccctaacaaggtcccctgtccagatgtatacatgtgcaaatcaccagccccagctatttttggcactagatacggagtatttatgaacaagtcttaaaatcgtggattatttggcctccacggaggcacccaccgaaacagacaaaaaattgcttgcaggttgcaagtgcatactcggacaatagaaaacgatgaaaatggagcatggaaaagatggcccacaagcgtctcctgatggtcagctcgttcaaaaaagaggaaaaataaatttgtggagtaattttttaaataaagatttatttatattaaaaatatctattactccctccatttctaaatatttgacaccgttgactttttagcacatgtttgaccgttcgtcttattaaaaaaaacttttgtgaaatatgtaaaactatgtgtatacatataagtatatttaataatgaatcaaatgatataaaaagagttaataattacttaaatttttttaataagacgaacatctaaatatatttaaaaaagtcaacggcgtcaaatatttagaaacagagggaggatatactaaaagttcattaacttcctacaaacgctcctatgtcgtcacatgacactctacaaacgctactaagctgccacgtggcaaaaaacatctaacccttgattttcatttaaattgatgggtgcatccttttcgaccattagattagacgtagaaaaaaataagtaatccactcatcctaatctacctccaatttgggccccactcaatgtgtacggatgcacgtatatacgtaacaactctgtacgctcctatttccattcttctcttttcattctattatctatttatctctcctattttgcttcttctaatagaaagcaaaatttatgtaaaaacatttaggcaactattacatttaaatcataaaagtattctaatatgcttatgctgttagactatttatatagtaacaaaatcatacgtatatgttttgatcacac

SEQ ID NO: 40710 - DNA, 174 bp, Oryza sativa
gggtgggtgccccgtgatccgcctggggatctggttactcccactcggcgcctcagggtcggcggcgtcgagatctcggcctccgtggccgcggcggtgggggattttgggattatttgggactgccattttgtgcttacttgtttcggcggctctggttttttgcagagaagg

SEQ ID NO: 40711 - DNA, 1501 bp, Oryza sativa
tatccgctcaagaccatcggtctgctctgttttttagtgccgaattttaaaaaccgagtgtcggttttaataaagtaaattaatggtgttagtttttgttaaaaaaaggcacttatagtctattaaaagtgccagtttttgtattttcaacctgcagatatgagaaatggtctataagtgctggttttatcacttgtggcacctaatgtcgatctctatatatctttttatagtagtgtgatcaaaacatatacgtatgattttgttactatataaatagtctaacagcataagcatattagaatacttttatgatttaaatgtaatagttgcctaaatgtttttacataaattttgctttctattagaagaagcaaaataggagagataaatagataatagaatgaaaagagaagaatggaaataggagcgtacagagttgttacgtatatacgtgcatccgtacacattgagtggggcccaaattggaggtagattaggatgagtggattacttatttttttctacgtctaatctaatggtcgaaaaggatgcacccatcaatttaaatgaaaatcaagggttagatgttttttgccacgtggcagcttagtagcgtttgtagagtgtcatgtgacgacataggagcgtttgtaggaagttaatgaacttttagtatatcctccctctgtttctaaatatttgacgccgttgacttttttaaatatatttagatgttcgtcttattaaaaaaatttaagtaattattaactctttttatatcatttgattcattattaaatatacttatatgtatacacatagttttacatatttcacaaaagttttttttaataagacgaacggtcaaacatgtgctaaaaagtcaacggtgtcaaatatttagaaatggagggagtaatagatatttttaatataaataaatctttatttaaaaaattactccacaaatttatttttcctcttttttgaacgagctgaccatcaggagacgcttgtgggccatcttttccatgctccattttcatcgttttctattgtccgagtatgcacttgcaacctgcaagcaattttttgtctgtttcggtgggtgcctccgtggaggccaaataatccacgattttaagacttgttcataaatactccgtatctagtgccaaaaatagctggggctggtgatttgcacatgtatacatctggacaggggaccttgttagggaaggttggtgccgtacgcagacaccgtcattatcacgattaggatcgagattttcaacgtcctctcctaattactatagtgcacatggatgctaaggcatgcaattgatgtgacgtgatagtgtaattatacaatcattgagacctgcaacgcgcacattgaatacaaatatatgaacgcaaaatggatatctaaaaagaaaaagcctaccgaaagcaagtatccaaaatggcatccattttgattcgattcgaagtcagt

SEQ ID NO: 40712 - DNA, 1501 bp, Oryza sativa
gttcttgatgtgtattttgtgattgtgttcttgatggggatgagtagctttgatggttcccagtggctgggaagaatattcttgatgttcatgttcaagtgttcttggatgttcttcgatgtgttctgggcagggtgaagggaagctactcgatccttttttttggaattcctgaagcctcaaaggtcaaggttttggaactagcacatttgattttcatcatctgtgccgcttcctaggtatcgcttgggaactcggcataggtgccggatttcccaaccagcacctatccaggtttctgtggtagtgtaagtttatgttgttagataaatttacagttaaaaacccatatttactataagtatgtcagtattatggataatcttatacgaaatcgcaacaccctataattatctttcagaaaaaattcacctcctaaaatcgatcatagataataataaattattttatagcgatgtgtggtgtgtgcacatacacatgcattattcttgtaggcataaaattgatgaggctcatcgcatttcaccctcttcgtatacgtgacactgacctaaggtttatctagcatcgtattaataacgagttttttttgaaccgtcgtataatcttttttatattttctttccaaacagaagactcataaccactggtggagaaaccatctttcgtcggtcggccgatatccacaatagtcctggttgcaataaaaaccggggctaaagatgatctttagtcccggttggtgttaccaaccgggactaaagatcaaatatgcccgactaaagatcaaatatgtccgttaccctttttaaccgcttatccaaatcaaatctgtaggcttggtaggcccccttggatacttaccccaagtcattacacccatcgggacttaagtcccacccctatatatatgtcttcttcctcctccagctgcccgagcaagcttcaaaatttcttcaaaaaagagggtcatgccaaaatttctagtgaatttattttggtgattatatacaaatcggaggtgcttaaaaggttagcaacttcatcctccaatgttttttttgtcatattacatttggagctatgttttgcacacttttatgtctccaaaatttagttgtaagttgatgagagagaaaatttgtgtggggaagaaagaatatatagaaatttagtttatttgctaaagaaggttttataaaatagttgagaaggaaaatacagtgaaagttaatcttaaataatagaaaacaaactaaaatgaaaattaaaataagtacaacacattaatattagtttaaaactttagaaatagtaaataagaattatttggtgtaatattttataatttttgtatgaataatgatatgtcattattgtatgactgttgaaagagtttgtaattatttataattattgtatgactatcattattgtaagaataattatttgtgtacgattttttttcatgtcatgtaga

SEQ ID NO: 40713 - DNA, 1501 bp, Oryza sativa
gtggtacttgagcgtgctgcctttcaaagaaaccttcaagtggttcgtcaaaagctagactggcggttgttgcctttgatccaaagaggacacatctgaaactctcagtccaaacaaaagtctctttggctttttaatccaacacagtttaattggttttcttttccatcaacaggttggttattaactcgaggttagaacatagttcctctggaatgagaccctaggtctcctttgacagtaaacaattatacgcatgatcccatatcagcatcttgcaaaataatcctcatagaacttgtttttatcacacatgtctcccttattacatgaatacaaggcactaccttaaacaaaaagggaagatgcttaacatcggtacattgtttctactatgggttaggattaacatgaggcctcacaggtacggcgtttgctccagtgaccacaaggcgagtgacttgtcttcttcttgcataatggccggagtgatggcgcaggttacgcttcggctgtggacaatctctggagaaatgacctggttctttgcagttgtaacaaatcaacgtcttctttactgagctgtccatctggggacgatcattttggcttggagttggaattggtgattggaaatccttgctaacattggcatcagtggtaccatagttgctatcaccattggagtctttctcagtgtcaacattgctaaggttgtcattctgggttccaacattgatactatcgttgacatcttggtgaatgctactgacattgcacgctttattcgagtggtcactaatggggcaagaaccatggttgttggtggtatcatcatcattagtattgctagtgttggtgtctgcattgcgtccatcttcttggggcaggaactcttgatgcacaacagaagatccggtgatctgaagtggctcagtgcgctgtctttggttaccacctagaaatactgggatgttgacaatccttctcttgcagttcgtcatccgattatgctcattttcaagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcctagtgtgatcattcctgcgggaacatgtgatctcttgaatacagatgaaaactcgttccaggtgatggtatgtccttctggccgtgatgcttcgtagctatcccaccactctgaagcctgtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttt

SEQ ID NO: 40714 - DNA, 329 bp, Oryza sativa
acactcaccaaattcaagtccaaactcaacttcattcgagagaaacaaaaataacaaatttcagttgaatagtgtcctgttactattcacccgaaatttgttctttttttactcccaaataaagttgagtttgaacttgagatttggtgagaatgtatttcatatctacacctatctctagtaatttttcatgaatttacaaaacttttaggtatgattttcaagagtttaacacttagctcatttttaccggatttgtcctccatggtcatatttaaatttctctcaggttttcatcagcagacataggacatcttgagatacatata

SEQ ID NO: 40715 - DNA, 416 bp, Oryza sativa
aacccaaaagactagtctgatgggtgaggaccgcccccaccttttaagtcgtgctcccccaccatcaattaccgatgtgggactaaacccaacaatctcccccgtcacacatcgggcccaataatctcccccgtcacatcaacccatgtgaccccgaagacttcttacctggcctctccaccatgtgacccatggaaattattccgggtttcaaaccttgggctctgataccacatgttataaaatttagtcgatatagcggaacgacgactaaccttcccgatcgcttcagtcgttgatcacccaagacatgccagatgacgacacaggaacacacgatatttgttaacgaggttcagccgaagcctacatccccggggctctgattatggacgctcctccccaaccaacatagc

SEQ ID NO: 40716 - DNA, 555 bp, Oryza sativa
gagggggatgagaggtggaggagcacgagccaaagataggctgtgggagcaggaggcagccgcgctccgtgacaggcgagcgagctggagaggagaggtgccaggggcaatctcgctattttgaaaaaaatctcaccttttttgacctagaaattataaaatattgcatctggtttcctgtagctaatcacacaaattttgtaatgtccatcagccgtatcactttttgcgatatctcacaaccaattacaagttttttaattgtcctgtagcaaatttttcctaaaaataccatgcaaaacatgtggcttttgtgcctttcctggcacagaaagctctaatccaaatataggaagaatagattaattatacgacatgcttctatagtttataaacagtatgtttttcataaaaaacattatagtaaatttctttaaaaaattaaattcgttttaaactttataatagattaatttttcgattgtaccctagattacaaaatcattcagctattaaaaacaaggaaagagtacgaattaccccccgaactatcgc

SEQ ID NO: 40717 - DNA, 1501 bp, Oryza sativa
gtctagataagatgccatcatcataattaagcatcagttctgtattacttacaaaaaaatggtacgaagttgcatgtgaataagttcagaatatcattgttgtatttttagttgagactatgacaatcttcaaaaaagaaaaaaaaaagactatgggctgtaatattcattaatcaatattacagtttaggcataaagattttcagcgtcaagttttgtccccaggccactgaggccagcagatggggccctttttcgtcaaggaaatccagttctacagaatttcaggtggagagatcaaggagcctcattatttgaaatcataaagatattccaagcgattcagtagtataatgcagaagcttctttagggaaacaccaatcaaactgccaaaaaaaataaaaataaataaatcacaaatcatgtattcatgttccagctgaaacctctctaaggctgtgtttgaggagaatgagatagagaagattgggaagatacgcaaaacgaggtgagcccttagcgtgtgattaattgattattaactattttaaacttaaaaaatagattaatatgattttttaaagcaactttcctatagaaaatttttacaaaaaacaaaaggtttagtagttcgggaagtgtgcgcgcggaatatgaaacaaactcactccctttattctccaaacgaacgcagcctaagaaaagtacttaataagtcgttcacatgttctgatcaagcacatatcaaactaaagactgattttgccagtccacctactgcgcttaaaaagttggttttgttgctaactgttcagctgaaaataggatgataaatgattgctggtaaccatatcaagcatttcccaagaaaccaatcatgccatgtcaaacagacacagaaaaggtctcatcatgtgcttcccctctatcatctggaagtcgtttggcatagtaattgggacatggaatagactggcctagctgcttaccatcttcttcatagggaagacctacatgctgaccatgccctacacaagtttcagacaagcctccctctgcggcgcacatccaagctctctacatgcttgcgaaacagcgaaaggcaatcaccaactcacaagatccgatcttacggtggccggacattgatggacacatgaagaacacgatgcgtccttgccagctaggggtccattccaattggctctggtgacactgacagtgacaccaaaacgcccttctgctttagcaagtagccacaaatccacgatgttttgccatctgagtgaggtacattagttcctccatcttccaccatggttggaaatctacccattctatggaggcatcattctattctataataattcttctaaatcagttcaaatccaacctcgaaaacatcataagaactagaatagggctagtaataatttagatcccagagaaggcaagcacgattgcacgaatacaagtaggtaattaagcaacagaggagca

SEQ ID NO: 40718 - DNA, 1501 bp, Oryza sativa
ataatctaaacagaaaatctgcagaaggcaactatggatggtttaggagccaaatgaagtgtggacaagtcctaccctaatatacttattttcctttctatgtctcaatgacattgccatagtggcatggactgtcaacaaagacagcaaacaatataaaaaacatatactaaaatggacagccactaaccacaacatttactttcattgaagacggtagttaatagttattgtgtagtactgcacaggagaattaaagaaggaatgcatccctcaggacagctgattaaaaaatttgatagaaaaggcaaagattagctgatgtgcaatatcaaagtgtaaagtgcaaaccttcaaaatcagataggaggacatatgctaaggcagagcttgaaatgtagtattcaaaaggaatttcagctggattgaaaacgagtcaagccagatgccaatatcatctaatacgaactggcccttaattacttcagtacatctgcttgtcctagtcttatactttataataggaactacttagactaaaacttactcaaatgcatcaatctaaaaagtttcctacacaaaaaacatacttctacaagaactgatcagagctaacttttgttttttttttttttgaaaccttgcacacaaattcatcagattcttctccaacagtcagagtcagaataatattcagttaattgtgctaatagaatcaggtggacatcacatcaacaaggcattagaactgcaaaccaaaaactgtgcaacagaatgaatgctagattgcatcaattaaaagcataacaagaaaggaaacagaacttgacattgtagatgatattatgattgataagagtcgtgctgcatgtaccctgtatctatcgctgccgcattccacgcatcaccacatattaaacatcagttgtacacatgctagattcaatcacaacaaaaccaaatcaggaaaacaatttttttctctggtactgaacagaaatccaccaagtcacccattgtctctgagaagaaccatactagctctgcaatatgaatttgaagacagtaaactaaagcggtatatattacacgaccactaggaagaatatgcgtaacaatacagaacaaattcaattttgtttcaaatataccaagatactaattaattatatccacaattcaataggcaccacattaaccagtcaccccccaaaatggggaaaaaaaaactaaccaaaaaacatccatccatccatccatcacaaagctactcatagctaccaatatttccactcactacaactactaactatatgatccaagtgttcttccaatcccaaacaaatttcttcttagcatttctcgatttggcaccaaccaaagaaaaatcaaaaagagaaaaaaaaacaaagagattaaaagcagcattaagcattactgttttttttcttttacttggggtttcttgcctgattttcttggctgatgtgctgtgctgcat

SEQ ID NO: 40719 - DNA, 1501 bp, Oryza sativa
gtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaaagtatcagtcttttgaattgattcaaggttggcacccggccaacaactttcaaacggccacccgggccaacaactttcaaacggccacccgggcctagctgatcccatcagctgcagattttccaaacatcgatcccatttccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgagagacctccaagctttcatgacaaggcatttcgaaagctgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagtcaggggtgtcccattccacccatgtggtcgtacttgtcttatgttcggatgaaattccaaggaaacggtccttaagtgcaagagcgggaaaccgtacacccggtacgttccccggtccgcggttttagaaattcatttagttcgcaagcaccgacccaggtgtcgggttttccaagtcttctgtaaaacccaagttttacccaagaagttactcagattttaagtttgaaggcgaccgtcgatactcgcacagagtgcacgaatatcgaggcgcagctagatggttacaagggaacatgatataacaattaacaatggaaggatcagatgcaacaagttgggtaggcccaccggtctgccttgcagacggtgcaaacagattaagtgcaatcctatcaatgcataatattttgcgagcaatataattaagttcaaatataggctcaatatgttcaaaggtggcttgccttgctcgagatcttgagcttgatcctcgaaatcctcgcactgcgggtcttcgggctccgaaactacacgcaaaacgggacgactcaacaaacggcgaaaataaagccctattaatgacctctaagcgtgccattagatagatctcgagatttgaggaattttggaagttgaacggagtcaaacggatttacggttgggaagatatcgaatttctaagatttttggatttttggtctaaaggaaaaaggatttaattaaatcctttttgaaaaagaaaagaaaagaaaagggaaagggggagggaaattagacttctctcgggcggctagggcgcggcccgagagaaagggcggctcggccgagcttaa

SEQ ID NO: 40720 - DNA, 1006 bp, Oryza sativa
ccctccccccacccccccccccctcctcccgcagaccgtgtcctgctcctagcgcacgcaaggtcggcacccacggctgccatgattcgccctccatgacgggtacctcattgatcttgacggcgaacccatccgctgcccgacgcccatcgcccgttgcaacgtccaggccacgctcgccagggagaactccaacatcatcggcacctgctcctctgcccggtcagcgagatgttcaccagcgtggtggcgaccacccctgtgctcggcgccggcggcgacaacactaccgatggattcacctgctccggcattagctgctgtgatgcccatcgccatcggctgcccctcctacctcgtgcagttccttagcctggactagaactaggagctcagcggcaagctacccatcgccgtgcgcatcgccgagcggggctggttcgagggcgtcgctgccaagctcctcaacagcagctcagacgccgccactcgccggtcccggtggttctagagcagtaggcggttacgggagctcagggcgcgcgaggcggaggcggtcgcgtgcgaagcggcggccgcgctatgtgatagggccagtgagctggagaggagcggcgccaagggcaatctcgccatcttaaaaattttatcacctcttttgacccaaaaattataaaatattgtatctggtgtcctacaactaattatacaattttggtagtatccatcagctatgttacgtttttatgatgtcttagccaattacaagttttttgagtgtcatgtagcaaattttgctgaatttttattatcaaagaaaaacatgttgctcccatccaaagataatgaatcaaaaaacatgcttgaaattaattgcatgtattcccatcgaaaaaaaaagtaactgaatataaagattgtctccactctcctaattaactgaaaaacatgttgctcccatccaaaggccttgttaggctagttcctttccataggtattggagga

SEQ ID NO: 40721 - DNA, 1501 bp, Oryza sativa
ttaattagtgctgatgttagtgactaccgatcgatctgccatttccatcatatggtatatgcgacgcacgcacgtcagcatgcgtgtacacccaacacggcctgtcgctcatctacaaaatgatcatcttacgtcgtcatgtcgatccggccccaatgcagctcatatccatatgatgtccaatcaaaatccaaattagttattctctgttttttcagacaattagcaagagatagctaaactatctgctcctagctaggtagctaggtttacgtgtttgattccatagagataattaagataagattgatgaagaagttgagtacagaaggtgactgtttaaaggggccaatccaaaccagttgaactatgtctagctaggatttcaccagtttcagaggacatgttctgttcctatataccagagatagcaatagtcagtcactcactgtgcaaaagtagagatgagaagagaatgtttaggcctgttgatctattgttaaatcaatcgatgtcattcagcacctaatgactttgattagaaaatgtcattcagtaccaaagccaaacatattaaagctagctaaaacggcaggcagagatcacgacatgcacagatcaatcaatgcatgccgttgcatcgatcaaagctataccagcttgcatgtacatttggattccatttcgagtcaattaattagtcgcaaaaagcctgtaattagtggagacacacgccaagagcaaataacggagatggcagtatagcagattagcagtactgtctcgttgacaacacatgcattaagcaaaggcatttgcactatagttaattgacaagtaaattaattgcagctccggccacgtaagacagcagagctagagagaataatatgtgattcattacttaagcaagcacttccggacacgtcctggccttatccattacattgcattatgtgaaaattttaatacctcacaagaattcttaggagaaatcaagaaggaaaagaagaagaagaagaagacgacgaagaagaagaaatcgtgtcacgctctcgatcgatcgatggtcgatcgaaccacaactagcttacaatggactgccgaggatgacggactgctgctgcatgtgcttaggctagtagtgcccgttcgccgccggcggcgtctcgacgtcgtagacatggccgccgttgccgtgcttgctgccgtggccgttgggcaccgccgtcaatggcagctcgccgccgcccttgttgctgcccgccgccgccgcgccggcgtctgtctgctcgactttgtcggcgcccttgccccagatcagcgcgtacagccctatcacgatgatcaccgcgccgatcacgctgcaataattaattaacaaacaaacaaacaaatcaattaattaattaaccaatcgaccgttaattaattattcactctaatcatgattaattactatatatagtataatggggtcgtgtacgaggtagagtagtac

SEQ ID NO: 40722 - DNA, 1501 bp, Oryza sativa
tatccgtcgatgtccccatctacacggaaggagatcttctgcagtagtgaagctagctgctgctgcgttggggttggctcactgacgtattcacatagtattattgtactcctatcctatctacggttttctctgtttgtaggatgctggtgagttggtgattgcgtttagacgagggctgtgcttaattgttagctctgccagcttgatgggtttttgttactcgctccatcggcctgtttagttcgtgaaaaataaaaaattttgtgccacatgagatatttaaccggatgtcggaaagggttttcagacacgaataaaaaaactaattttataactcgtctggaaactacgagataatcttgagcctaattaatccgtcattagcacatgtgggttatcgtagcattaatagataatcatgaactaattaggctcaaaagatttatctcacgatttcccccctaactgtgcaattagtttttttaatctatatttaatgctccatacatgtgtccaaagattcgatctgatgtttttgaaaaaaaatttggggaactaaaccagacctaaaatacactaagttttcattcgacacattctcagttacctcttcgaaatatataaggcataggtctggactaattggggctacaataaaatcaagtggtagtaaacttatataagtagtttagtgctaatagtctcattttaccaatactaggttgctaatatttggacaaagtttaaactagaaaagttgctatattttgagacggagtgagtattattctcaacactaggtgaaatctattatggaaatgtgaagttttatggagtcacaaattttgcgacttgtgccgccaatattgattgagatatattcagaaattctataaattattaagttatgatattggagttcaagactattgtatatgcctgattttaccgtgtacaatataaatgtatttttcacgaaagataaattgacactcaatgtttataaattcttgtatatcgtccaaacgtgtatcaataaatcttgcagaaaaaagataaagattaaatacagacacgtaaaacgagaaagccattaatacatgattaaataagctttaattatttcaaacttaaaaaatagaataatataaaattttcgtacaaaatagtgaaaattaattatgctaaaaaatcaagataaaatatgtatcccaataaaaaaatggaatctacgtcgcaagatctcacaaccccagcaccaaccttttggatcccaatcaatgccacaaaagaaaaaaaaaaccctagaatatccacacaattgaatgattgattgcagctcaagcttcaatccgcacaataaacagattttacatttctaaacctctaaaaaagaaaatgcaatattagattgttcataccctcccataaataatcctcctgtacaacataattgcaccctctcttctcttcagcacactcccactgtgggagtccc

SEQ ID NO: 40723 - DNA, 169 bp, Oryza sativa
  unsure (1)..(169): unsure at all n locations
ggctagcgtcgcgttacaccttcctaagaacaactaaacccaaaanaaaccgcattgccgccgctccccggcgccgcctcctgcccactcttcaccattgctcctcctcctcctccgacgccgccgccgctcacctctgatactccgacgtgtgatcgttcgatggaga

SEQ ID NO: 40724 - DNA, 1501 bp, Oryza sativa
ccggctgtacagatctaactccaaaccagaagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgcgcctcaataccaccacggtacctcggaaaggagctgtgacagtacccctcgcacaacacaactcaaagcagtgcaccgttcctggatcataatcacccccttataaacaaggcatggactccccagcgacccccgtgggcttatctccgccacttctcagtctggtgctccgcaatgaaccatgctatacaaaatgtaaagccgttgcccacgctggcttgtggttggcacggttaatgtttcacaacagtagctcgcgaactggtccttaattgccatgagcacgaccttcaaaaccatgtgctcacaacccaccattaatcatattttaattaccaattaattatcataacacgattaaccatcgtgagctaccattaaatataactataaataataatgtaatatatatggttcatcccattagtgagctaatgtttctaaacatggctaagcaattatatctaacatctagtggaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaacataggatcaacatgctcaaaggattgtgtttaggatctgtgtgacttgccttgcaataatcggtgttcaattaatcttctgaacactcccgacgcactcacgaaccttcgcaacgacggaaacgacaagctaacatgcaaaacaaagaaaaagactaataaaaaccaaataaacaatacatataaagtaaaaaaacatgtagatcataattttagatgaattatgagacttgaacggcctcattctaacttcatatgaatttattatgaattttactagattaaatctaattaaagcccatttaaaaagaattaaataaatttaattcaatttatggataattttaatatgtagatctttattttacacaacttttgcaacttgaaccacattaaaccgagttacaatgaattagatatgaatttttaaagattaaaccggattaaagcatttatatggattttaattgaattatgacgcaataatgaattatttttgaaaaggaaaatgaggattattgcgtcatcaaaggcggtccacggtaaaccgggtgcacaggacggtctaaggaaacgaacgcccgagatcgattctatccaaaacgggcggccgagatcaaaacggtccacagcgggtctacggggacagcgacga

SEQ ID NO: 40725 - DNA, 1501 bp, Oryza sativa
agtgtgggtaaaggtggagtttggaaggggaaaatgaaaaagattgggatgacacgtaaaacgagaagagttatagttaggttgtgattaattgagtgttaattattttagatttacaaatatattaatatgcacttttaaagtaaaatctttttgcaataaaccatcgtttaggagagagaaagtgtgcgcgtgaaaaacgagtaatttttctcccaatctactcaaaatgaacgtaactaggaatgcagcctaaacgaaattagagtgtgtcttctaaaattgcatttcgggaaaattttgaatacacacggccgcaaatcacatgattttgttacacttgaaaaaaaattcggttcttccttaaggtatggatggaaggacataaatatgcaaaatcatcgtcatatagatcctccagtgtgtcattttaaacattgatatggtcagtgagatagttgttggattactcattaaacatgggtaaaaagaattctaaaactaactatatagcaaagattatttttgaaaaacaaatttagccttctcataattgaaaaggtggtgagcatttgaaaagcataactgaacgaatgtaaccttgggatatttgaaatgtattcttgaaatatgtacaatgcttgtggatgtatgggctacactggtggagaaaccatctttcgtcggtcggccgaattccacagtagtcccgattgcaataaaaacctggaagggtaacgggtatatttgatctttagtcctggttggtaataccaaccgggactaaagatctttagtcctggttcaaatgctgtcagggcttgtcaggccccccgggatctttagtcccggttcataacaccaactgggactaaagtcacacccctatatatatatatatatatatatatatatatatatatatatatatatgtcttcttcctcctccagctgcccgagcaagcttcaaaatttcttcaaaaaagaggggaggtcatgccaaaatttctagtgaatttattttggtgattatatacaaatcggaggtgcctacaaggttagcaacttcatcctccaatgtttttttgtcatattacatttggagctatgttttgcacacttttttgtctccaaaatttagttgtaagttgatgagagagaaaatttgtgtggggaagaaagaatatatagaaatttagtttatttgctaaagaaggttttataaaatagttgagaaggaaaatatagtgaaagttaatattaaataatagaaaacaaactaaaatgaaaattaaaagaagtacaacacattaatattagtttaaaactttagaaatagtaaataagaattatttggtgtaatattttataatttttgtatgaataatgatattaatgatatgtcattattgtatgactgttgaaagagtttgtattatcttatgactgtcattattgtacgaataattatttgtgttcgattttttttatctcatgtaga

SEQ ID NO: 40726 - DNA, 640 bp, Oryza sativa
aaacaaacaaagaaacaaaagatggcaagtactgaaacaatatagtaaccttttgccgagaggaatcgttctcatagactcttcgtagactcgtcggagactcatcgtccgaagagatcaccaaagccttcaacacctcctccttctccttcatcgaaacctctatacaactatcatcgtcatccatctcttctcccccatacctaatcaccttgccgtcatactccagtacaaagtcctcattctcgtggacacgcacgttctctaagaataagcggtactcctcttcgatgtcggcgttgacatcgtacactgcgggtactgtagatgagcccttctccttgcctttcttgatcttggttttactcttgtgtcctaacccaccctggtaggacacagtggagtccatcgggttgccgcttgcagtagaggcggaggtggcagaagcatggtggttcggcttcggcatcactggggaagggatcttgggtagagggaatttgtgcctgtaacaccccaggaatcacaacaatcctgagatgccactaaacatccaaacaaccatgccaaaaaaagaaaaaagaaatttcagtagcatctcctttaaaacaaagaaaactcgcagaagtatcaacttaga

SEQ ID NO: 40727 - DNA, 1225 bp, Oryza sativa
acttagaagttttttccccgatcgatctctctctcggcttctccttcgccgccactgcctggggcatccccgcgccgacgccgccgtcgtatctcgccgtcgtctcacgtgcgtcgttgtcgccacctccgccgcggccgcatctctggggtgagagccgccgccgcctccctctctctctctccgacctcgatctctctctttctccccaaaccgccgccagccgtctcgttgccgccgcctctgacgtcgtcgcggccaaacacgactccgccgcgccgacgatgccgaccccgacctcgatgcggccgccaccggcaacgatgtcgcgccagcagtgcggacgaagccgcgccacgacgccgggccgcgccacgccgccgcggcggcacgacgcccggacgccacgacgccgccgcggcatgtcacaaccgggccgccacaccaccgcgcgccacgccgatgccacgccgccgcctcgccaagctgcagccgcgccgccgctccgctgccgccacgtgaacgaacgaacgatcgtgaacgagaacgaacgaacaaacatgaacgagaacgtgaacgaacgaacgaacgtgaacgaacgaacgtgaacgagaacgtgaacgtgaacgtgaacgaacgaacgaacgtgaacgagaacatgaacgaacgtgaacgaacgaaacgtacgtgaacgaacgaacgtaggtgaatgaaacgtgaacttaacgacaacgcgaacgtgaacgatcgtgaacgaaatgtgaacttaacgacaacgtgaacgtgaaatacaatatatgttactttgcgtttatcctaatacatctttttgtatgttgtagaaaaaacgacgtcgtcgtcgtccctcaagccggagtggtcgctagccctcgaaggaattcgcgtaggcaagtgatgtaaatatatgattgttagatttttaatgcaattaagactattagatttaatatacgacacttagacttagcaacataattagagttttaatacaagattatttgagttttagtataagattattatagttttaatataagattattagatttgtaattagacttagcatataagattgtgtagggttctaatatacgacagttagacttagcatatatgactatttgagttttaatataagattattagagttctaatacaagattatttgagttttaatataagattattagatttataattagac

SEQ ID NO: 40728 - DNA, 721 bp, Oryza sativa
ctaggatcccccccattcggttttaggttgctatattctgggatggagggagtaagaaataaaagtgtgtcagttaatgggtggggtcatcagcatggaaacaagggatccccatatctcagctcgttgacaaactcttctttcttctctctttggatgttgtttgtgtcccccatttgggtccagagcatgcttgatgagtttcctttggagaactctaatgctttgtgtatacggttagtttttcttctgtatgttgagttgcatgaagtaaccactttacctgatagttcaaggtgagagaagtgctgctggtcattctttatgttgtagcgagcttaagcgctgacgaagaatgattgcaatttcaacacttttccctgatcacatgaaaattcacacaaagcttcaaaagcagaatgccaaaaagatttttacaaatgcaagtttatgtggacacacatgctgagccgttggatgctttgttaagatctgtgctttactgaaaagaggaataatacaatattatgccttgttaaattttgcgttgtacgcacaaatctcaaaacaacgatgacgatagaaggtgcaggttgtactttcagtcgcatttgtaactagacttttttttagcaagtcaaattggttttgtttatggatggctaacattatgtatccagttacctttatattcttctagttcaaggataagtgccgggga

SEQ ID NO: 40729 - DNA, 1501 bp, Oryza sativa
ccatcggccgccggcgtgcccgccacgtcggccctcctcccttgccggccttgatccttgagaggagaaagtgagaggagagagagagagaggaggatgaagggggaggaggggaaagagagagagggggtgctgacgtggcatcctaacatgtggggcccacgtgggtcccacgctgacttagccgccacttcggacaaaactggggtcaaaaccaccgaaggacgtaaagtgaaaggttttgtaagatgagggatatcatatatcgggttttgcggttggatgacgattttgtaattcgatgacaaattgagggaccttggtgtactttttccgtgtgtaaatgggctgagatttaaggcccatatatgggccggatcgtggcttccacgaagcccatacttgtaaatgggctgacatttaaggcccattataacaaggcctttgggtcaagttcggcccagatcagtgcacaagccgtcgacttccgccgccggcggcttcgtcgacggcggcgacatcgatcgccgtcgccggcggacagatgatcccccctcacgacaccggtacgtcaccctgctacaccatctcaaatctttctcctgctttgattcatctcatccgtgtgggtttttctagtagatctcgaatgacggcattccccgttagtttttttttttttttttactttgctcggatgaaatttgctcgttttgtttcctgttcttgcgattgcaagtcattagttgatgggatagtgaaatccctgacgcgcattggtcgtgtagggagctggatctgttccatgcgttgctgattggatagaggggattagagtttacgatttagggctttcctctgcaaaaactccttgccgcagcacaggaagcaggtctcctccaaccgctccacaggcggactgctcgtttcaatatggccttatatgcagatgacgctgtagtgttccttagaccagataaacaggaactccaaaaggtccaaatgataattcaaaatttcggcctcgcgataggcatggtgaccaatttatcgaaaagcgaagtctatgccattagatgtgacaccctcgacttacaggatattctctaccccttcccggcacagatgaaacacttcccttgtacctatctaggacttccactccacatcaggaaactcagaaaatcagatgttcaacctctcatcgataggttctcagctaggctcccaacatggaaaggaaagttactaaacaagactggccggacggttctgataaagtctaccctctccgccctcccgacctatcacctcactgttttcccccttagaaaatgggctgaaaaaaagatcgacaaaatttgtaggggcttcctctggacagggtcagaacagacacaggggggacactgcctagttaactggaagagagtctgtagaccataaaaacatgagaggccttggtataacaaacctcgaactttttggtcgctctttaaga

SEQ ID NO: 40730 - DNA, 1501 bp, Oryza sativa
ctgacggcgtcgccgaggcggtacgcgtcgacggcgacgtagccgacgacctcgccggcggagtggcgccgccgcgcgcgcgccgacagccggagctgcttccggaacacggccgccatcagcgccgaccggacgcgcatccccgtccgccgcgagctgaagaaccagtgccgtgcggccagcgattgggcgagcttgatcgccagcagcgagccgaccagcgccaccgccgccgatgcgccggcggcggcgaggtcccggcgctcctcctcctctgccttgtggctgctgtaccggacgacacggcgatggccagcgtcttgacgagcgcgtagaagccggtgagcatgatctccccgaggaagcacctgagcagcacgccgacgaggcggccgccaccgccgccgtccttgccatggccgtggaggctccatgcctcggcgaacctctccgacgcgcgcgccgcgccgtcctcggaggcgatgagcgggacgtcggcgaggtcgagcgccttggagcggccgaggcggagcagcgggttcagccacgagaaggacagccggctgagcacgccggcgccgtacagctccgagtaccggcgaggcgcctccttgccgagcagaggctccgacaggtcgccgccgccggcgccgccgttctcgccgctccggccggccattgccgagcccagttgttgccaatgacgcgcgcgacgtggcgccgcgcggttttttatggcggaatttgcttgatgaagctcagagaacgtactcctctccatcgctttcacctcagattttgggtcggatcatgcgtaaaagagataatctgtaaaatggcaaatcacatgcataatcaaagtggtaatctctataacatcaaataatcatttttttcctctaggagactgatagctggtaattagtccctccattcaaaagtattaagaatatttcatgttttgttttttccaaaatatatgtgtaaaaccaaagcgtgtttgattgttattttgtgatgaactattggtatatgagattattggttttgatatttggagattattaccgaagtgattttggatataattagaatttttaggtgatgaatagggattactgctgacacagtgtattcggtcagaccgggttgtggtagttggtcaaaccggcggtatatgtgcggtcaaaccagccagcacgtagtctgactggctgatgttgtgtcggttttggtttatggtcaattgtttggatatacgtggataattcatgtttatgacttctagatggatactatgtgtatgtaatactattgcttcttaacaatgagtcaagttggtgagaacttgtgctcggatatggtttcttggttgatgcatgtgtaggtgattcttaatgcttcggaagagtgttgtcggtgatggatcgggagtcgacttgggagaagatgacgtccagatgatcaagatatcatgcgggatgcttaggctaaagatcaa

SEQ ID NO: 40731 - DNA, 1501 bp, Oryza sativa
  unsure (1)..(1501): unsure at all n locations
aaaaggaagtatatattatatatagtctacttatatacaaggacctaattaattaaaggaaacgtaataagaaatctaactgaacgatgcttacaaaatccagcaactcataatagagacgtcgagggcgtccagctggtatagttcgtagatacccttgaaattnnnnnnnnnnnnnnnnnnnnnnnnnnngaagtctgtgtccctaatcctcgctccgatcatctctctaccggtggcgctcatctccatgtacagttgatggaacttgtacatttgtatgggtagggactgcagctgctcaggcttgacaagcggtttaccgagttctcatgatttcacttccccctttcaaaggtgtgcctcgtaccaattgatccgtagttagcccgatgcaataataaattcttctatccaaaatcttcaccggtcaccaacggctcgatctcctggtttggttgctctccaagctgagggactggtttggactttccagaagatgctttcttgagtgttcgctcatagtccgatagctttatggcctccttggcaggtgcagacatacccctgaagaagttcctaacacttgggtctataggaatcttcttttctggacttcgaggcttcaattgtctcctgacttctgatgccacataagcgtcaagctcctcttgcatgcaatcataccccaggtccttgttcttggcggcgtcaactttcgccttcttcgttgcccttgtgggggcaggcggtgaagcttgggggggccttgacttggaaggtgccggacgaggagcttgcggaggagtcggtgtaggagcctgaggagtctaattataaatctaataatcttatattaaaactcaaataatcttgtattagaactctaataatcttatattaaaactcaaatagtcatatatgctaagtctaactgtcgtatattagaaccctacacaatcttatatgctaagtctaattacaaatctaataatcttatattaaaactataataatcttatactaaaactcaaataatcttgtattaaaactctaattatgttgctaagtctaagtgtcgtatattaaatctaatagtcttaattgcattaaaaatctaacaatcatatatttacatcacttgcctacgcgaattccttcgagggctagcgaccactccggcttgagggacgacgacgacgtcgttttttctacaacatacaaaaagatgtattaggataaacgcaaagtaacatatattgtatttcacgttcacgttgtcgttaagttcacatttcgttcacgatcgttcacgttcgcgttgtcgttaagttcacgtttcattcacctacgttcgttcgttcacgtacgtttcgttcgttcacgttcgttcatgttctcgttcacgttcgttcgttcgttcacgttcacgttcacgttctcgttcacgttcgttcgttcacgttcgttcgttcgttcacgttctcgttcatgtttgttc

SEQ ID NO: 40732 - DNA, 1501 bp, Oryza sativa
atcaatcggacaaatttatgcgtcctaaaggatccttaaataggtgcaacaaacttgtaaattgcacattccatacaacttgcttaagtataaaccaaggccaaaacagtccagcaatcaataagtggagtcaaactaatttgtgacctcgtgctgttagatcgggccctggcgtattgctgtgtagctgtcctgtggcaatcttgctgatcaatcagatgccaaaacatgtttgagacctctaggcgtgtaggctctaatttacacgatcgattcatgatagtacaattgaatagattggtgcatggagatttctagtgagagattgatcgagaaacttgcagttcaaattgcaatagggtatttctatgagaaaatgatgttgcatttactgcattagggtgttccaaattttcttttgaaatgcaatttggttctaatggtgtgatctcaatagtttataaatcctatttcggatgcattttttttcagaaatatttatatatatgttacctatatatgaaatttacgtcccgacaatggcgatgatttcagcagcaagttgcctctcgccgacctcttgtttctttcgtctcaaacagagggaagtggaatggaataagcacagcagaaacctcgacgccgaatataaccacacatatgggattatctggaaaaagaaaaatgaaaaaccatgataaaactgtgctagagtggaagtgaacattgcatccattttagcgccaatgcaccatgtcagaccattcaattgtggtttgatttttgcaaactactgatgagttgcagtagagcaaataatttataaattgttgcgtgtatttgtacttagcataatttgcccttataaaaaacaatcaaagttattccctccatcccatactataaaacacgcacgtattttaatattcaactattaaacatttgacgaacaattagtataatataatttgaatttatttgctaaaaataatatcatcgaattggtatttgaatttattttcatatattataattttgatgctataaaccttatagtatataattataagtttaaaaattagtttcatacaccgtgctaaatttaaccttataagacgttttgatattgaccaaagtcaaactggtttaagtttgatcaattttgtaaaaaaaagtagtaaaattttcaacccaagacaaagttattatgaaaatatattcaattattgatttgaaactaatttagtattataaatattactatattagtttataaacttagccaaacttaaaataatttaactttgatcaaagttaaaacgtgttactggacggagggagtgaaaagttgctgcttgtcggcttcctagtaaaccgcgccccacacatcacctccctccctatataggcatagctagcttagctcacccccaacatcgcacgcacgcacgcgctagagaaactaaagagagagaggtcgatcagaaatcaatggaggcgc

SEQ ID NO: 40733 - DNA, 1501 bp, Oryza sativa
cgccgcaattcgccgccgacaagctccctccggcgaatccgagccgttggctcgtctcccctcgtcctgtgcagccacccggtgtgctcgctttcgccggtatcgccgtggttcgctccgccgctcaccgctgtcgtccgccgtccgttccggctggcatcgtcgtctacctcccgccggcccgcgtggcagccacgtaggcgccacgtcggcgctagctcggccaagaccgggtcgagccgaccccgatcaggcccttcccgtgcgcgcggtccaccgcgagccgtgaggctgcacgtgggcccgccacatccgcgtcctccgcgaaccgcgcgcgtgcaccgcgtccctcccccaaaccctagcacgcgccgcgtgcgtgttccgcacggtgaaccgtgtcaccgacaagcgggtcccactcgggaccacgcgaggtgagcccggtccaccggctccctctctcctcccctcccgcgcgcgcgctctgagccgccttcttgggccggccggcccattaagctcggccgagccgccctttctctcgggccgcgccctagccgcccgagagaagtctaatttccctccccctttcccttttcttttcttttctttttcaaaaaggatttaattaaatcctttttcctttagaccaaaaatccaaaaatcttagaaattcgatatcttcccaaccgtaaatccgtttgactccgttcaacttccaaaattcctcaaatctcgagatctatctaatggcacgcttagaggtcattaatagggctttattttcgccgtttgttgagtcgtcccgttttgcgtgtagtttcggagcccgaagacccgcagtgcgaggatttcgaggatcaagctcaagatctcgagcaaggcaagccacctttgaacatattgagcctatatttgaacttaattatattgctcgcaaaatattatgcattgataggattgcacttaatctgtttgcaccgtctgcaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacagaagacttggaaaacccgacacctgggtcggtgcttgcgaactaaatgaatttctaaaaccgcggaccggggaacgtaccgggtgtacggtttcccgctcttgcacttaaggaccgtttccttggaatttcatccgaacataagacaagtacgaccacatgggtggaatgggacacccctgactgagtaactagcttatcaggggagccttgatgccgagagacatgtggattcgccggggtggtgtcggggaggacccctgggcttcctggcacagtatggtctgggacctaacctgttgttggtctgggacccctctcgtcggcata

SEQ ID NO: 40734 - DNA, 1501 bp, Oryza sativa
tagttcccaagtcacgcctgtgatgtttggtccaagtcttggcttccacttcccttttgcaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacaattattgatttaatgagactaatttggtgttgtaaatattactatatttatctataaacttaatcaatcttaaagtagtttgaccttgaccaaattcaaaatgagtaattataatatgaaacagaggaagtagtaagtaagacctgatacataaaggccaagctgagcataagtgtatggttaaaccaaaatttgtggcttaaattatcatgaatatattgtccattctccttgtaatgttacacggttacacccatatataaatatatatgcctttatattacactgtcgcacatctcccagaagtgatagcatagtgtaactctttatataaacgaaatgaagataacaattatatatggtttttctgagaatcttcagttaattaattagcactccaagttaaactgaagataagagtagctagcagcaaccaactagctagtcagcattgatgccacatcttatcagtcgaataacccattgacagtattctccctactggtctctagtctctacacatccatgtacaatgcatgcatgcatgcacatcgattgttgtcggtacacaagcactagctctgctagacaggggttaacacaagtagtaaaagcctaggagctgcagatcagagaagttccagctgactcccacaaaccttgacttggacggctctgatcatgcatcctcttctcctcaggtagccaaaaagagacatgacaaagttgcaaaacccatcggcagtatgtgctcactgcattttcccggcaaagcagagagaaaattaaaaagacgacgcagacatatagccctttctttctctctctcctttagccggaagtggaatattaaacaagctggaaacatacaagccagcactgctcgcaacaacaacattcagaagagagagaagtatagagagagagaggggagcatgagtcagatccatgatccatcaatggcaccacacagtccacacttgggcatctgggcgagacgagacgactaatccaacttcgatagcaacggttgctgctagctgctgtgctgaacagtgcagcgtcgtgcagctatatgcctatatatatccctcaaaactcattgcctctcctcatcacagccacaacacctagctagctgcagcttgtgtgcgagctactcctgcagctagctactagctacagccaaagattaccagcaacagaaattaactgtgtgagacgtcgatcagatcgttcgagagaa

SEQ ID NO: 40735 - DNA, 1501 bp, Oryza sativa
gatgcgaagctggtttataagaatttagaaaatataagtttgtcaattcctactctccagtttcgtaaaaaaaccatttaaaggtaggctatatctagatttgaacgcatgagtttctttttgtgggacaaagatagcttctactatctcattgtctagattctaagttaaatgcatgtttacttgcttgtcattttaccctaccaaattttaataggatagtaaactaaacacaaccttaccattatcactccaccaaaatttgataattctagatgtttcctctcataaaaacatcatcaatatttgacaaggcaccaaatatatctaacgctattctttttcgataatgctaaaatataccaaaatttaacattactctatccatttcatattataagactttctactattgcccacatttatatagatgttaacctataagtcttataacctgaaatggagggagtatcaaactttaataaggctaaaaatgacaaccaaagagaacaaccactgtgtgagaatctgcagccgctgaaactcaaccttactccatccatctaaaaaacaagctagtactggatatatctctattcgttgtattataatgtgtcatatttagtcctaaattcgtttttttacggagggagtatttcatttgtcttcaccatggaagaaccggtcccacttaccatagacccaccacagtagtacactacagtagtgagtagtactgtcagaccctgtttagatgggactaaaacttttaagtccctattacatcggatgtttggacactaattataaatgttaaacatagtctattaataaaacccatacataatcttaaactaattcgcgagacgaatctgttgagcctaattaatccatgattagcctatgtgatactacaataaacattctctaattatggattaattaggcttaaaaaatttgtcagataaattagctttcatttatgtacgtaagtagtctatatttaatactctaaattagtgtttaaatacagagactaagagcacccgcaatggtaaagtagggtgctctctataaaacatgtacatctcagcaatagactagattaatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctaaagtttaagtccctaaatccaaataccacccgacaaagcccacctcacgggcacccctaaacagaagtaaataatttcaaaatagtccctcaagccgtcgccttcctcacgctctctcccactccgccactgctccagctccccctccccgcaaggcggcggagatcccaaggtcgtcgggggatggcggcggtgg

SEQ ID NO: 40736 - DNA, 1501 bp, Oryza sativa
ttcatttatttttctaaaaaaaacttttatataaaaagtattttgtataaatcgcatcatttaatactttagaagatgtggttacgatgaatgggggaatcatagctagggagtagcttagccgagccgtacaaacaaccagcgtgagagaacgagcaacctggcaccaacggcgatcgaaccgcggccgcacgtacggcgaaaatgtcagcggcgcggcccgcatgggccaccacggcgtgggcgcgagccgcgaggttggcttgccgagaggcgcaaggaggcgctggccttggcgacgacgatgacgacgaggacgccgtggcgcactcaaccgcgcaggcgatcgaggtcaagcaccacccgcccacgcccacgcgcgcgcacgcacagtacagtagtcgcgcacacatcgcccatgtgtgcggtggtcggagccgtcacgcaagcgatctcgcgggcacgcacatgcggcgcggggcacacaggtttgccgtcgcggcaagcggaagaaggtcgcgccggggcagggtcaggtgaaggtcaggtcggccgctgctgtcgcggtagcccgcccggccccgacagagcacggcgcttgccgatacacttccgctactcccgatggggacgccatgctttgtccttggtgtcaccacactgtccctccttggtgcgagatagggtaggagtactacaatacgggagtcgcgtgcttgctcggattctcgaacgtactagggctacagtatctttttacacgcatccggtgccagcgaggagggctcggtgcatctcacaccgttggatccgatacgatcgtactgcctgccaggctgccactggccagtgcatcgtctacatacaacggctgtgtacgggctccatctcaaaatacaacaatataagattagatgagacatttcctagtcctatagctcgtccatatttatggtactaagaattatctcatctgattttatattcttatattttaggatggagggagtagtagttcttcagaatgtgtttgttttagctttctccagaagccgggtaatcaatatttagcctgttataaaaaagaaaactagttcttgttcgctttgctctgcgttctgcactgggccgttggctagtagggccgcaacttccactacaacaattaggcccaggatacgcccatcagctcagagcctgagaagtgagaaccaagttagcagttggcagttgattggcacgtcggtcaaacgaggcaaccaatcgccgagtcatactagacatgcaagaatgcaagattgcagctacgccaatgcggcccacgtagtcgcaatctccactattccctccctggctgaagactccaaaaccgccgccgcctcctcctcctgggacctgggctcctggcttgccgctcgaccatccgcgctctttacctgctattaattcgctctccgccctctgcattgcaccatctcgcgatcggtaatgacgacgacga

SEQ ID NO: 40737 - DNA, 1501 bp, Oryza sativa
ctctattagtgggggtaataagccagtgatcccagtctagttattaatgcccttaatggtacgataaggaaaaaaaatatctttaaggtttagccaaacgttccagtatgttctgctcgtatatctttagcccgcaaggtaggagaagaaattattacgtgtatgtgttcattccagtctgccaagtacctacggtgtgctgttgtgcaattacaagatcgctaaaacaagaagggaaaaaaaagaatcgatcccaatgttcagaaagaaaacgtcatgccaaggtaaaaagtagatgacgccacgcgcatactcgaagtaaaagtatatatatgtggtggattgcgcatacttgaagtaaaagtatatatatgtggtggattaccgataatctcgattaagtccagtattaaaatggacaagtagagagctaaccctaattagattctgaattttctttttcccctctcgatcgataccaaaaggagagacgagagggacacatgtcgtctgcagtactgcgttatctcaattgagacgagagaggcgtggaggagtgaaaaggcgaattcttattcagaagtgtttccgatacgcgtcttacgcggcgggcccacgctgccgccctcccatcatcttcacagccgagagagagagagaggccatctcccccttcccggaaacgcattcttgccggggacaaaagcctcacgtcccgtcaccttcaccttcgccaccgttcacaccccccgcgacgccaccgccacctttatatccttctccccgccacatcctcgctcctcgtctccgccgcgagcttcacctgaatccgatccgatcacccttagcaacccagatgttcctcaccgacaagtaccacgcgcttctccctttccacgccagcggcggcggcgtgaaggatcaccggcggaggccgggcaaggcggtgcccggggcggcgggtggtggtcccgggtccgcccggttcggcgccgcgctgtccgcgaggctcgggagtttgctgccgctgccggcgtcgccgttggctgcgttggcgcggctcgcggatctcctcgcgcttgccctcgctgacgctgttcccgcgttggctggtgagggggacgcggccgccgtcgccgcgcacctcgacgccggggtcgcgctgctcgacgcctgcaacgggatcaccgcgcgcctcgaccggctccgccgccgccgcctgctgtcccggttcgcgctccacctcctctcgtcgtcgtcaccaccgctgccttcctcggtccgccgcgcgcgcgccgcgctcgccgaccgtgacgagcgggccccggcgtcgcctcccccgccgctcccttctctcccgttcgaccagccccgcgaccgcgtctccggcgccgcgaccgtcctcctcgccgtcgacgccgtctcctcgctcgcagcggcggccgcgtccgccgtcctctgcggcgacgccctccaccagatcgccttccccctggtctcc

SEQ ID NO: 40738 - DNA, 1501 bp, Oryza sativa
tcgttttgtgtcttgcgttggcggtgtgagtaagatagatgaagatgagcaagattgacaggggatgtaaatttcttttttcaccattgtccctttgctgcatgctttctttcttctgttcttttgctgtaactttaaggtgatttggtccataattacagtgcagcttttggacgtactacctactactagtaccatttggtctcagttttttttacttctgccgttcgttttgggatacgcaccaatctgcagttctctctcttcagaggtggtgtagccgtgtaccagcaactcagcaaggaggtttcaggtacctttgcctcagccactggcaacaaggggcctgccaaataattttgattctgatccagtatgaggttctaattttgcttttgcacatgcaactatgcaaggatagttgtaccttgtgctgcaaaaagaggatgggcaacacatctcacggaaaatataattttatttatttcagacaatattatgatatgttttcttctgtccatagcgaagtaccggcattcagctagtattacacataaaaatgtaattaactcatctacactattgttaaagggaacatcaacattgcaagcttagttgctatgctaagttaaagagaattactagtttttttaggtatcaatagcataactcttgctattattcttgaaagggaagagctaatactaacgtagacaaagtgaaaaccaagttcagacatctttcatgcaaaatgtaccgatctaaaagtctaaacactgctccttttgggatcagggcatggtataattccccagttcctcctcacttcatccaaatcttcatgaaaatgcttctcatagtacacagacataagatctgtgcacttaagacctgcttttgaagcccatgggaaataatgctgaaaaaacagtgtcctttgtttctcattgaacctcgcagagcccccaacgactgaaagcatgcacattggaaggaacatctgttcaaactcaatgaccttaagggcagtctctccaatcaggttcgtaggaaggccgaacagcacatgccaaaagtcatggacttcacgggcgcgggtcgcaacatacgcaagctcatctgtatccatgaaacggacaggtgggcggtcatccggtgagaagttccttgatcccatgaactgagcatatgctgcaccaaatgtgttctgaggcatgtcccaggcatgagaaacttgtgtggatataactcgaggacgctccaggagaacatcctgtaggaatagtatcttagttaagtcaattgggaaagaagtccacagtgttgagtacacattttcagctggcatgtgttgctattgcatggcagtgatgtaacaagaaggaaaaaatcatcaaagtatagcaattgcaggtttaaatttattgaatgggtaagtctagactgcagccaaacaaggaagatattttggagagttaaatgcataaataacaaatgaaca

SEQ ID NO: 40739 - DNA, 1501 bp, Oryza sativa
taataaaattaatttttatataaaatttttatatatttttttagcgatttaaaagctaataataaaaaacaaaactatgttaaaaatatcttaaatttaatttcaaaatcaagtttaaaattttaatttttagcttttgctttgattaattaggtcaaccaataaggctcgtatagatatcgtgggttcgtgactcatcttttggaccgtacatacacatcgccagatcatggtaaggtattaatttgtcatgctgctgatctgtatcatatatccataagtcaagaacaaattaaatgaaaagtttcaagcttttgtacgttccgggtatatggaaacgggagtcttgtttttaccagttttaaaaaagtttaatactgcacatcagtagtttggaggtaccatcttctgtatcgtttgttaatctacagtgccagaaagacagaggtcctagatcatgtgatgcacatttgatgcaaatctatggggttgaagggggagtagtaaaaaaaaacatgctactgccaactactgccatctgttcatatatgatgaaaagtattttgattcgttctcttgtctcatctctgggttctccgaggtttggctgggatgctggatcgaagaaaatgaattatcttcaatctttctttttactgcggcatgaactagcatatgatgaggtatctccttcgccttataaaacactaatttagtatcgagtttaacacagtactccctccatattaaaataagtgcagttttatactattcatctccaacgtttaaccgttcattttatttaaaatttttttataattactatttttattgttattagatgataaaacataaatagtacttttaagtgtggctaaattttttaaaaaaaatcataaatttttcaaataaaacggacggttaaacgttggatacggatttctacggctgcacttattttgagacggaggtagtagtaagtttagattcacattattaatgtgttataatcgatacgtttgttttttctatctacttctgggactaaggaaggatacattccgtgtatccagattgcgcctgcaactgatcgtggccgtccccatcaaacgaagctgctgccaatttatatggataaatttctttttatttaaatggaagaccactgatttctttataaatgcaattggaaattagtactatatactgtactccatatattactactaaatccattcctccttatttgacatagttgaccagcgtaaatttcactcgctgttgccctatccttagccgttgatctcgatccaacgggcaggaatcaaggtgactgagattcggagaataagtcatctggtcaatagcaaactggttttatatcaccgcagcctcctcactcgctctttcctcgcctccactccaaccaccccgcgatagctggagtcaccggcgttcacacaggcgacagctcgtgctccggcgatcgacgcggcggcca

SEQ ID NO: 40740 - DNA, 191 bp, Oryza sativa
  unsure (1)..(191): unsure at all n locations
cctcctgttattcattcgttnggtttatttaacgttgcgttagtcgcccactgcattantaatttacttcttttctcatgttttcctaatatatcatcttntncanncnnnnnncnnaagcgttgaatgcatgacgcacgcccnncancaccggcccgtggctcgccggatctagactcgagcggtgacaa

SEQ ID NO: 40741 - DNA, 1501 bp, Oryza sativa
ttttaaatttgcatgattgactcagtggttatatacctctacacttgttctttatggataagaacagagtatctacacttgttctttttttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgcttgttatgtgaatttccaccctgctgttgctgtttatgtgaatctccccttgctgttgctgcccctgtggcatatatacccctactgctgttatatgaccctgctactgctcttttccttatggataagaacagatgaactacacttgttctattttattgataagaacagatgaactacacttgttctattttattttctatttcctcttttttctgcacttgctcttttcttctggattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatgattgattcagtggttatatacctctacacttgttctttttttatgcataagaacagatttcctgcacttgctctgttccttatgattttctctttttatccctttatgcaaatgattgtaattgatgcatatttctcagcaaaactgaggccatatctttcatagtataccccgtattacattggatctaatgctatttagtctaatggtaggaaatttataatctttttcgcgaaagttaaacca

SEQ ID NO: 40742 - DNA, 623 bp, Oryza sativa
  unsure (1)..(623): unsure at all n locations
ctcttgctcttttacacttttatcttgatgttggtttgagtccccgtctctattttcatgtctatactattgctctatattcgttattgtatttatgttataaatatttaaataataaatggtatagttgttgacnactctgcaanacnncanncaaaangagaaccacanaagcggaaaggggggcncaaaaccagggaccnganagncngaananaacaccgacccggaacaagggacaaacacganaggggcacccaagaacaaacggggcggagggagccnaggcacagaagcaacggcagggagcanagggagaaacacagccaagcaacgctccggaccccccggcacgacgcataacagcgacatagaagcaatctcaaacaggcatttgttcccttttatgtcgaacgttgaattgtgagacgtagggcatgtgtaaatttttcacctaatcgtaaacattcagcgcgggttgtcagtgacattataggaaagtgtatagacatgggaatggtgaagccctgcatactttccttgaacaaggcattctactaatcatgtaccacacatctgacttaatatctttgtatgataggaatttggtacattaccaaaaa

SEQ ID NO: 40743 - DNA, 181 bp, Oryza sativa
agggcttcaaatttaaaatctcctcgaaatgtaacttatatgtttgggctttggcttttacgtgttcctaaagacataaaaaatcatcttttgatgggcgcagtagctctttgttggtccattttggctaagcaggaatgagttgttgtttgatacaaaatggtgtcttctcctttgcagg

SEQ ID NO: 40744 - DNA, 467 bp, Oryza sativa
ggatagtataggtttgtagccacaatttattattattactaatcacattcagcacggtactaaaagttcaatgtaaaacctcatcttcatctaacaaaagctttatgagtaaactttaattcttgtttttttttcttatttgactaatcaagttgtgacctcccataggtggcttgcttatatctctagtgcacttccccttttaagcttaatttaagacagtaagatatggtgttggacaaacgtcatcttcatcccatctgtctgtgaccaagttgattgtgcataggtggacaatccactatggaaaatcattgtattagtaaaggaatataaagttttctgttattataccagatggcggaaacctttgtgtactagaaaaaccttttagttttcttgctggtagtattttcatagatattttaatgctgaactcatccttatttatattttttgtttacagg

SEQ ID NO: 40745 - DNA, 1501 bp, Oryza sativa
cgcttccccccccccccccccccaaaaaaaaattgctcttgcggcgccgcggattcttcgtctccaccaccgccctcgacgtcagatcaggtataaaatccgtacgcggggttcaatcttctggctggttgtttcgatctggttcctgcctttgatcgagttttgagggtgagggtttgttttggttttcgcttgcgcggttgcaggtggtgcggtcgatttgaatccatggcggcgacggtggcggaggcgctcgcggtgacggacgaactggccttgccgcttcgcgcggtgggggatctggcggccgccgcgggggtctcgcgggaggaggtggtggtcatcacgcagtgcgcctcgcttggtgagcttctcctcgtctccttgcttccctttttcctgctatcatatgagactccgatatcgattaggatttttcgtgtttagattcaataatatggaactgtgcctaaccctgttacgagcgtttgttctttgctggttaggatcagttccaactcaacaaatcgcaacagttcaatcgatttcaatcgattcatggtagagttcttcgaaaaacagtttggagctcaccattcctttagtttccgacgactccccttatgatgcttcatatgctaattcctatatagattcatttcaccatatatgggaccaaataggttatgagacagtgctattggttgacgaaggaaagaaaagagtttcatattctcacatcaatcatgaggagaaaattttggagatcatctccctatatgttttgtattgattatctagattcattagtggcaatattcaattctcacccatgactactactccaaaattggagtatgttccaaaatttggaccctacaaccgacacactgttttgctctgctatatgttcagtttcgatttctgttatgctttagtataccttatccttgtagtatacattttggtttgtcataagctcgttttgaacattccatgttggcatggttcaggtgggaagttaccttttgatgatgcatcagttggttctgttcttgctgtcattaagaaagtggaaaacttgggcgatctgttcataactgaaataagcagggttcttaaagctggaggcatggtgcttatacagagttccccctctgatcaggatgtatgtactgttttgccaatatactttattttgtaatgcttaatttgcactccctgatcttctgatcttctcttcatcagcccaataactctattcagcgcaagctactgttaggaggatttgttgacgtgcaagcttctgctgcaagttcccaggatagcgagcattctgttactgtgagtgatctagtgccacaatatgtgttaatgcttctgtgccgtcatactttctagtgctaactgaatcacatgcagattaaggcaaagaaggtctcttggagcttgggctcttccttccccctcaagaaagccacaaagggtcttccaaagattc

SEQ ID NO: 40746 - DNA, 1501 bp, Oryza sativa
tgccgtcgaccatctccttctcgaactcgaccaccccccacgacagcatcgtcaccgcgtacgccatcgggagcccgaacttcacgtggtcgccggagtcgtagtacccgcccaccaaatccacctgcaaattcatccatccttcgattcaattcgcgccgcattactcaacccgatcgagcatttacccggccttgccttttacatccaactggatatacacggccattgcaatagagaactttgtcccgtggacaacacaatctaaaatttacttctataaagatttaaactcaggactttaaagtactactctaacgactgtaaccactatcgagcatttggttgattgaaccggaggcggcggagatgtatgtattaccccctgggagaagccgtcggtgagggcggagtcgccgcgccaccggacgaggcggtcgtcggggagcttgccggagcgctgcgcctcgaagaacaggaggcacttgtcgaacgcgccggcgtagtcgaacgccgacgcctccaccgacgcggccgccgcgaggaggagaaccagcgacgccgccgccggtatcagcaggaaggtggttgccggcgtcttgttcatcgtcgccgccattgctcgacctcggtagtggaatactggattgagggagaggcccgcacggcggaggagttttataaggtcgccatgatcgacgacgtggaggacggtggcgcgcggccgtggcatcgtgggcgcacgcgatgtgcctcgcacgtagcgaggaggagagatacgacgacgacgacgacgaggtgagcttttggcggggtttgagccatgcacgtcgtggagccgaaactgcagaaatggttgcaactcaagcgtgtaatagtttaattggtaatataataatagttgaagattagttttttttttaaggtaatggagttgaagattggatgcttgtagttttaagggaagattagaaaaaaaatgaaaggctgggtgcctgggtctgatgatcattgtctttttttttttttgagaatttgatgatcattgtgtcaactaccaattgtgtcggcttggatcgacatgaagtccactccagttacactgcgtgatcttgtgttgcaaatgattttccaatcaattttatcacgtttgtgccattgatctggatatttgtggaaggtcaacccagatattatgcatatatattcaaggtgagctgagccaaacatctctgtaccttcctgctgttcaagagctttcacagcaccatctgcactcgatctccagtgcatcagaaccgaagtaccttccttgctctcctgtgaatcctgctgtatgagtttcggtttcctttatctcctgagacaggcagaactccgtgcatgttcttaggaaaatgtgtcattttcaaaaaagaaaaagaaaaatgttgtgtcctatagccaactgttggcttgaaatcatctataatcaacttaatagccaactcatacaatagtt

SEQ ID NO: 40747 - DNA, 1501 bp, Oryza sativa
ctttatgatcaccatgactacaaactgaagaaggtttgagccattcacaacaggtgcaggcgtgcagcttcagaaataaatcagttagattggatcgtgttgaatgcgccggttaaatgtgaaactccaggtgatctgatctgaagtgatctacttgtgtcgtttaattagcgtgcctaattccaatgggctattagctatgtaagtgcaaaggttagccatgtcgatacatgtatatgtgcacttggaccatccgcacacgcctgaaacctatcaacagattgccgatttctgataggagagggacaagtctgctacactgcctaacttccaagataagattcataaaataaaaccgacgattgcatgcagatcaagttggattcttttcaatttttaataagtttgaaattttcattgcttcgcaaacctgaaaggctgcaaggtgccaactgccaaggtgtccattttcaggtgagtgtctacccaatgacactggggaacagcctaagttccttgactgatcagatgccaactccatgatccagagattaattaattgataattatactattacaacactgtaaagaacgctgcaaagaaagaaagaaaaagattccggcaaaaagtacacggcctgcgaaatagtgaagtcgagcctaacaccacgagacgtgtaagtgtgcaactgaagaagttgcatgatacatagtcgcccgaaaaagaagtgaaatgaactatgacaaatatcgatatttggagagggttaggtactggttcactcgcagttgtagtaggctatctcaagaggattcgatcgtgtcaacaagacatttgcacgtcgcgttgtagcgttggtaaccagctacttcagaggcagtttttttcctctcccttttgaccaactccttgtcatgcacttgtgaactgccgtgcaggtcacatgcctgcgaaaaagagctccactagagactaaagactacagaggctggtcgccactcaccaatgcctgtttttatgtgaaagcaatgagcataaaccttaagatttggcaatggaattgcatgaagaagtcatttgaatcattctttcggtgcatggggcctaatcgtcatcttcttccgtttcttttgagtgatcagattattgttcaccgtagtatcatcataagcaccacgaactaatcgatcatggccaattgacgacgacgagcaacattacgccgggagttcctttccaacccaaaaaaagcttttacgaatttcggcttttcgtaatgcccatttttttccgaacggtcaaacaggttacttgacgttatattaatagaaggagattaagctcattgagctctagcataaatccttgatgagaattgaggccggcttaagtggatcccagcatagtagtactagtactagaacaggaggagaaacagtaacattggaaagggaagatccatggagtacgggttaagcaagggtccgtgccttttttatg

SEQ ID NO: 40748 - DNA, 1501 bp, Oryza sativa
tctgaaagcgattgtggttggccgctgttgatcggtgcaatctcccgacgtctcgaggaggaagaagaagaacacgtcgggttagttcgatttctcttcatttttttgttcatttttttctgcgcttttccgcggcgatgtggtagagtgggggagtaggggtttgatgcttccagaggagtcggagaggcgatttttatgggatttttttttgttggcggcggtgcgtgccctcgcgttcagccagggtagccacctcccgccgccgtctgtcttccctgaggtcgccgcctcgttgcttcgagtcctactttgatttggaagccgatgagttcgtggttttcctggaagtaattgaattgttttttttgtatgcgaatctgggtgttagatttggtgaagtgcaatgttttgctggtgtttggtgattttgatgataagatagatgattccactgaagcaatgggggtgtagcaaatgagtggcggcggcgaggatgaatgaaccaatgtttttcccttgattagatgactccaccgccaacctagtgtagcttgctcgctgcagccaggtgccgccattgctcaagctgcttaaggagggcactgacgatgccctggaggctaccacacgcctgccctggctgcttggcttcaatcttcaagggtcaatcgaacctccatcagaggagaacggtagattcagattgaggaagagcacactatttcagtggtattttgagagaaccaaaggctttctattggtatatatcacaatgtgcaagttcaagtgatatatacccctttttatattaaactatttattagttattttctctcttcgttcatctcatacattggagtattggacacaactagtcttaaagttgttgcagctgtatttgctgtctttattggtttgcacttcttagttccaattcagcagtccgtattcagtaatgctataggtttcccttctataacaagtgcaaaatgtctttatctcatttcaggttctctgttctttgggggactcctacagatgtaattggttctgtaagttggggacctaatcaggtgaacacttgattgtgataggcttgtcaccattgttagatatgcagcaggttactgacacaacaggggctgattttgtttggccaatctacatgtggattctctaccgcagagtgtattttcatgctgtatcattctagtggccattataggttaataactttatatttctatctaaggtggttgtttcaaacactggcattcagtaatgtgtttttacattcctgaaaatgttctgaaaattttcgttattgttatgctgacattgtgctacaaatataattccaacatgagtattgatattgattggagtcgttactctctgaagatagataatgttcttttatacaaaagtatgcaaactttcttgcttgtgtcattgaacttgattttctattacaatggatgttgatttcagggttaag

SEQ ID NO: 40749 - DNA, 1501 bp, Oryza sativa
gttcgtcgtcctgttgattgaatctttcatctaagaagaattcagacacagccacgggttgcgaaatggcccggatagactctgatgatttgatgggctgcgcgggcccaaaaccatgaaggtcgccatcccttgggcctagtggtagggctttgtctcgcgcggcccagctcgtcggtcgctgttggtctgctacgccaccgatcaaagaagttcacaagcacagttggtttgcagtagcgtactctcgatctgttctaaaataaacaaatctattactcttaatattataaataatatataatatatcttaatactataaatctgttctatcaaatattatgtttttgtttattttaatatgaagaaaagtaggaaactaggaatgtacgtaggggcttttcaactgaagttgaccgaagcatatgtgcataataatttgttgggattattgtattgagaggcattgagcgtttccatccagggcctatagctgtgaagaagaataaaatttgagcatacgattccgctcccgttttgtaaaccgccaacatgcccatggttttggacctttttttgtgccaaccttgcaatcttcaactacaaataaacttggatggaccagttctcaatacgaatgaacaaaacatagtactagtaaattacggcctgtttatagttccctaacaaaaattttgcaccctattgcattgagcgtttgaacacctttataaagtattaaatatagaaaaaaaattaattatacagattgcgactaatttgcgagacgaatcttttaagtctaatcgctccatgatttgataatgtagtgctacagtaaacatttactaataatatattaattagggttaataaattcatctcgctatttactgacggattctgtaattcgtttttttattagtgcttgaacactacatgtgacaccctatataatacccgatgtgacatgctaaaactttacacctctcatctaaacaccccctacagctgctaggcaagtgaaatatctctatgttctggaaccgtacttgtttccatgtcattggccaggaaaacaagaaactgcgtcagaattgagacctggaaacattattggctcctaattaacgcaattgacactgggccacagatcaaagccatacttgtactgagcttggacgaaaatattcttcgtctttccagatgattaaagagccttctggagagagaagcaccatcatggctgcctatctggcgaacggccgatcggccatgtaaaggagaaaaggcagtttgcacaaggaataaaggcaacctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatgg

SEQ ID NO: 40750 - DNA, 475 bp, Oryza sativa
tttgctgcaatgaaaatcaaatgggcatgggaacagcaagaagttagaactgaattttgctgatatgttgctactgtttttttttaaagccagcgggcaatagtgcaataggcaaatatataccaactaacatctcatagatggagtaggatctataaagaatagaaaaaacaactccgcaacagtctggaagcaagtggacaggacttttaaaggaaaatatataaccagctaacatccaatggacagaaccaagcatatatgtactctgaagccaatatgttgaacctagaggcaatgtactttgaggcatgcatatctaaaggatggcaagaacatccaagggatcggttggttgcaaattatgagaactttttcctgatgttttatcaagaatatcacaaataggcatagtagcatactaatattgacagactaactagtaaactaaggatatagttggttaaggttgata

SEQ ID NO: 40751 - DNA, 373 bp, Oryza sativa
attcctgcagcccagtattccatcctgaaccttcctgtgactgatgtgaaaaacaaaaccaaaggagcacatcaagtatagctgacaactcaaacttctgaatatacaaggactgggaatgcagatgtttaagcgtcgaatacttctgaaacttggcaattcagacagataaggtaacagagaacatgttgcatagtcgtaaaaatggacatcattcctcaaattcagcttcggtcatcaaactgaccattttaaaatgccaatctagcagacagcaagcgatatgccttgtgtccctagtttttaccaagcaatccttgttctgagagggcattccattactccagtggcttgaatttcttccctccatagg

SEQ ID NO: 40752 - DNA, 257 bp, Oryza sativa
gatgatgtgactgaaaagttgtatgtatgacaggttgatgtgactgaaaatgactgaagtttggatccaaactttggatctaaacacagcctaagaagaagacagaaattcgttctctctttttctttatataaaagctgtaccaagatcagctgctggcactggtaaagattcatgcctccatttcagtacgaagcttccatgtctcgagattgactattggaagacctggctaactttttttctttttcttcaga

SEQ ID NO: 40753 - DNA, 228 bp, Oryza sativa
cccatccataatcttggactaattcacgagacgaatctattgagcctaattaatccatgattagcctatgtgatgctacagtaaacattctttaattatagattaattaggcttaaaaaaaggggctgctatataacgggatcccgttttcgaacgggatgatcccgagtaggtatcaggtctgatacctatcaggtatcagacaattctacacaacaggatgatccc

SEQ ID NO: 40754 - DNA, 465 bp, Oryza sativa
agtatgacttataagctccaacccgagggaatactaacggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaatactggtatataaaagctgctatggaatagagagcattctcatgagccttgaaatttggtggggattgatagatttaattggataattgatccatttaaatcaattaaatcaaataaattccaaggctcattatgctaggaattcatgtgtattcatttttttatgggatatcaatgggatgaagagttttgagaattaatccatttgattagggaattggtaacttatatcaattagttctaattgatggatggttgatggttgtgtagtggaggatggttcatgg

SEQ ID NO: 40755 - DNA, 417 bp, Oryza sativa
gcacatgttgagtactgttgttggactctggaccaaactattcattcagtcttcctgccggacaaccgaccggattgagaaattttacagtctctaagcataaatataatatatctcggtacattttaaaaatcataccaccaaactctaatatcgggtagaattcaccaacaggagataaatattatacgattaattatatcattttttatgtgtcaagtagggaccctccgcgtcctcccaataccaatgtcactgctatcctatcattgtttgaaccatgtttttgaacaagactttgccttcaaagtcaagatatagattttttaaaaaaatatcatgtttaaaagtaactttaataatagaaacagacgacaacaaaataaatgttaataacatattttttaatcagaagaa

SEQ ID NO: 40756 - DNA, 1501 bp, Oryza sativa
ttgcaattgattttatttgaactcttttctaaaaacaactaagcgagtgcttctcaaacgacacggatgagacagtgcgtctcgtccggtcgaagtatgtgcaatgtatcagtctttagaattaaaacaaggttggcacccggccaacagcttttcaaacggccacccgggccaacaacttttcaaacggccacccgggcctacaacttttcaaacagccacccgggcctagctgatcccatcagctgcagatttttcaaacatcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttgccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaaacggtccttaagtgcgagagcgggaaaccgtacacccggtacgttccccggtccgcggttttggaaattcatttagttcgcaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaagtccgccaatctgtcttgcagacgggacaaaagattaagtgcgatcctatcaatgcataatatttttcaagcaacataattaaatttcaaatataggctcaagatgttcaaaggtggcttgccttgctagagatctggagcttgatcctcgaaatcctcgcactgcgggtcttcgggctccggaactacacgcgaaacggaacaactcaacaaacggcgaaaataaagccctattaatgacctctaagcgtgccattagatagatctcgagatttgaggaattttggaagttgaacggagtcaaacagatttacggttgggaagatattgaatttctaagattattggatttttggtctaaaggaaaaggatttaattaaatcctttttggaaaagaaaagaaaagaaaagaaaagaaaagagggatggaaatcagacttttcctcgggcggctagggcgctgcccaaggtaaatggagcggctcggccgagcttaa

SEQ ID NO: 40757 - DNA, 1501 bp, Oryza sativa
ttttctattttaaaattttgaatggattagattctctttgaagtcattggctctggatttatggaagtgatgtgaatcgtgggaatcaatgtagaaatcctcatattgtggtataaaatttaaataatagaaatatatatattttagaacagaggaagtaatacattagtaattcttctatcactcacattccttgcaaacacatagccattctttacaaaagaataaaagatgatcgatggacaaccctacatggcacgttacatgtatgaaagaactagcacacaatatcatactactccacaacattacagatcaaataaaggaccacgacctgatggactatctggactgccaccacgccggccttgttgcggcactacatatcgatatgacataaaacaagaacaaaaacatcgacatttctacccaacataatttatatatactatcagacataagcatcatcatttcgacccaacataatgtgtatatggattctctactgtacatgtacatgtagtagtagtcactaaacgttaggacctaggtccacatgctcgtgactatagctaccactgcatgagcactattgtagataatccccgtcaatcccgatcgtgtactaacccgtgcagactgcagaaagctatgtcgcgccgcggcaccctgcgccgatctcaatcttttgtcttgggtggtgaaaaacagctgcagattgctctgagcatgctcttcttcactctgttgggatgacgctgcatcgtcggctactgttagaagagctctgataccgattactgaatatgatgaacccaaaactaaactggaaattaattaatgcttcagatggccaaagaaactaagcgagagaacaagagttggatgattgatgcctccaggcagcatctccaatgtcgtcctctttataggcctcgctattgtaacacgaccagaagctttccaaacacgatgtatataaactaggaaaagtacatgaagaaccatgcatagaaaattaacttcagtgacaataatatatgtagaataggtcgcaccaaccatcactccccggtggtggaaaggataaaattggattaatattttaaaattccaaatatcgattttatatattaaaataactttacaaagtctaatagttttataatattaggataatatgataatattttctgagacaaatttacatatattatttctcttatttttaaactaaatatttgaaaattttgttgatgatcgaaaatttagaaatttgacataatcttgtcttaacgttaaggctctcgtttgaaacgtatgaccgaaaaacgcaagaatcgaaatttcatgtttttcaattcaatcctataagaaaatgcaccacaagaaagattgatccaaataaaagttttctaagaaatattatctttttacttatttttctatggaattgaccatgtcttttagttattttcttatgaaattgatcataggaatg

SEQ ID NO: 40758 - DNA, 1501 bp, Oryza sativa
gaggaggaggaggaggcagcacgaagtggtcgtcgacgtagtaggagtggtagttgtctagggccatggccttactctcctttgccctgttacgtcctttcgtgtgtgtttatgtgtgtgagagagctagctattatggctgtgcagctgaatgctgatgaggctggggcttaaataggaggcaactttcgtggcaacaaaagctgtgtcgaattgggcggatgggaatggacggaattgatcaataggaggagccaggcagccagcaaccggtcaatgggaaaagaacgaataaacaagagcaaaagagcaaaggggaaaaagttgcggttgctggatggatagctccatgcatctaggcctttctcgtgattcgttatgtttgattgccctctccccctttctatcatcatcggagaatgttgccagcagtgcattcaatacattgtgaaattgatcaacagtgtccatccatatactcgccgagatacaaaagatctaaaatagatagatatggatagtacattagtacttaaaagcaatgtagacagtttgttaataatgtggtatagtttagtttgtgtgacatgtatacaaccttagaacaaaaaatattaaacgtactattttttttaattaaactcttactaatattgatgtgctatgtcatatatctagatttcttgtaactgtcatctagttaattcaaaagatttagatcaatgtttataagagctctgttaaaaaaagtttaagtacgtgtaacattgctcttttagggctaattggctaaaacatgaatttttacggaattttcacgtgacttaactcaattatcctacaaaaatctggtaaaatcatttaatccaaaaggaggaggctttctatatgttatattcatgatcataagctatttctatgtattcacaaaacatttcacgccaatgccatcacatgcaatatttgacatttgcagtagaggaattaatgccatcaagtgtgaccgaggggtggtaaagtaaaattgttgggtggggagagtaaaaaggagttgcaagtactacgtgactgttgatgtttttgttcgtatcgctgctgcaccagacggggacagcaccggtagctttagcattctttcatgaaaatctttggacgaggccaagaaaatgtgtttgctatatttctcctttttactgtaccataagttttgagcttctgccattactgccatccttggacaactgcgagcttatcatagctctgtgtacttgttacagaaactcctttgcccaacccaagtgtggggcttcacatatcaccaataatgaccaaaagggtccacacaacaatatcactatttaagatactaccagtacttaaaagctactagtagtattggatgatgtgaaacatcgaatttcagaggatgatatgaaatgtcaataattaatatgaaatttaccatgcatgcatggttggtaaacctaaagaaacagacaga

SEQ ID NO: 40759 - DNA, 1501 bp, Oryza sativa
aaaaaaacatctgcacgtttctcaattttacttggaggaaacatgctgttgctgtatggtcgtcaatattacttcaggtaggatggcagatggcaaattcgcaggcacgcatagatacgaccccgagagctcaagccgctcaaggcgcgttgtcgcgcttcttccgcggggctctcttcccccttgtgacgatgatcgcgtcgccgctccaggtctccacctcctcctccggctccggctgcggctcctcctcttttgcacatccgcgcctgagcaggagacgcttgcgcggcggcaggtggtgctcgtccccgacgccggcgtcggcgcggtgctccgtgcggcgcagcccgcagctcgcgcatatgcgccgcctcatcttgatgggatacttgcgctgtttctccgtgaacgcgccgtcctcctcgccaccggcgaacgtcgtgcacacaggggtcaaaggaagcgagagcgacctattgctcgtgctcaacatcgtcccgctccactgtagattaatctaagttcgatgtggatcgtattgcctctcgatccatgtttttgtaggtctaaaagagctcgggtttttctgggatgaagaatgcttgagcatgcatggggcggcacagcaccatgggaaccgtcttatgattgttgcgtgtgaatcaaagcatgagtttgccctgtgtgcgggcgttttgctttcgtttcctgacgatgaagacaaaccatatgtctcggttcctcgtgcgagaaacgagagccacatcgttcgggttttccggttgctgcccatttggtgccgtgcgtccgtgcgtgcgcctttcgtgtttttaacatctcgcaatggacagtgccagaacgcagcaacagaaagtaagcgtgggacgaggatcaagttaaaccagacattaaaaccgtcgtccgagccacctttagatcttgcttatactagttttaaaagttgagcaacgcatgcttatactggttttaaaagttgagcaacacattatatctagtaattcctccgtcccaaaaaaagccaacctaaaaagggatgtgaccctcctagtactacggattcgtaggactaggaggggtcaggttggctttttttagatagagggagtaccgattaaggaaacgatttaaacccaacctcaaccgaaaaccatcatccgaaccgtcttgagatattgttttcactgattttaggagttgagggacgcgtcatacagtcatatctgatactccctccgtcccataatataacaacctaggaccagataaaatatttcatagtacaatgaatctagacatgcggcctgcccagattcgttgtactatgaaatgtcacatcctatactagattgctatattatgggacggagggagtagaggtttagggcctgttcattttgatgccattttcaaccttaccaaattttggtaaagttgccaaaaatatgtgtacgtttagtttcctgccaaattttggtaa

SEQ ID NO: 40760 - DNA, 1501 bp, Oryza sativa
tgccatgattcatccagatttaatagttcggggtttaaaatatttaagagggtaaatcatacttgtaggggtaaacaaaaaggccctaaaatcaacaatgaaatcaagctttaacattctatgaaatttggcaataattgatatattaatgcttataattcatcaacccattaatacattgacttgtctggttgtagtatgtaaattgaactacatatttcatattttcgttccgtattggaccttagggtggtcatgatcgatctaccaacgttgccgtgataaaattatctatcaaccaattaatgtattgggtctttttgtcaactcaccatattgtagttcatataataacaactatatatataaattgctcaccgggtgtattgacgtgttgtgcaccagatagctgactagctgtgcgcctgcttccgttgtttgttcgaaaggcatatccggcgtgccgcttgcgacagcatcttccatctccacatcggcaacgaccagacgatgggtttgctttggaatcgccatcgcgttgcagcatgcaggccacatgggccaaggctcgaagcccaatcacatcttttcgttctttactttccgagaaggcccaaaataattttagcccgttgcggtctttactctttacgcatctgttctcgtgcgatcgtgcccaatccctcgatcctgtccacccagaatatgtctatttgacttctctaagctcttgctcgtgattaaatagcctccctcaacctaaaactgcatataacatctccctcatttttaaaactagtgtaaatcgacttattcaatggtttggaaaacgatttctgccgatgtggctggttgaccccagggctctgcagttgcgtcgccaccaacggggcgtgtaacatcgattacttatggtctccttggcgggatatgtgctgccgacctcaggagatagatggaaaggagaggagagaggaaaataaagagaggagagtggctgataggtgggtttaaccagctgattcagcgagtcaactataattaacatatcacgtctacaggaaccacttcctaaatcatcgaaagagtttgatttgtatcggtttttcaagatggggaagacattatattcagttttgctgttgagaggcgattcaatcaagaagagagataaagagagtcataatagacttattcctcccccgttttgcgcaccgacttcggcccggcccaacccagccagcacctctgccctcctcgagcctacggctacgaggcggttgctcgccgccccaataaataccccccgcctccccttccgagttccgagcaatcgatcgaaacgcttccccctcattctcgcacagcatcacacacgcggagtccgcgcagggagaccacgcgcgactaggcgctcgactctcggcggttgctccgcggcatcgcgcacccacgccgccacgactcgcgagagtagggtgcggaaccctagcctccgcaa

SEQ ID NO: 40761 - DNA, 1501 bp, Oryza sativa
cttaaaatttgtaagtttctgtttattttaaccatatataagcttattacatataattttacaattttttttgtatgttatcataatttattgttgaatcattggaaagcgataagtgatataatagttatgagaaacattgtctatcatccaagggataataaaagtgaccataatttttaaaacttaagtagaattgtggagcagcctaatctcatctccatttttaaaatcttaagtagaattgtagagcgggaactagctcaactttctgtttttaaggtgaagctcagaccgtttggtagggctataggtatacctctccattaacttattataaagttaaaaacatatttaaaatagtattacaaaatattcatgcatagatttttttttaaaaaaaaaactacgccgttttgtagttcagaaagtggatgtgatagagttcggtggtacgtacgtactcttcgtgacagtaaatataatgatatatcatattccggaagagtgtgaccaatcaccaatggcaacttatggatcatatcatctagctacaactcgtttatatatatacaaatcatcctacagcgatttctcttttggacgcagacgccgacgcaacggcgcatgcaagccagttgccgagttgtcgtccaccagtttctggtcgactgttgtaacccgatcttggtcgcgcgcagctgctagctggtgcacgcgagacggacgcgcgcgcgcgcgcgcccacgtcgtcttcacgggggccgccggtcacgcgaccccgtcgcgattgcgatggaggccggcgacccatcacccgtgcctagctagctaattagctcccgttcatttcgtagggccgctgcacaggtgatccgtcgtactgtcgtggcggagcgcgacgtgacggtgctcttatgattactgccttggccagccggggtcccaaatactatagttcctccgtttcatattatggccccgtttggaagcagatcctctgacttaactgtgactcaactgcacagcagttaagtcagaggatccctttctgctctgtttagttccccaaaaatttttcccaaaaatatcacatcgaattttttggatgtatgtatagagcattaaatatagattaaaagagaaactagttacacagttaagggggaaatcgcgagacgaatcttctgagcctaattagtccatgattagccataagtgctacagtaacccatatgtgctaatgacggattaattaggctcaaaagattcgtctcgcggtttccatgcgagttatgaaattagttttttcatttgtgtccgaaaaccccttccgacattcggtcaaacatccaatgtgacacccaaaaattttcatttcgcaaactaaacatgccctatatcatgtcctccgtttatattacaagatgctttaattttattagttaaatttgaatagattgggtcgaatttatgaaaatatattattccaattttttta

SEQ ID NO: 40762 - DNA, 1501 bp, Oryza sativa
gaaatagaaaatattttccttagccatgagtctaccaatcagtttgaactagcttctagaaaagtagcacaacgctaccagaataatcataacaaagataagctttactgttgctaatggcagtaggccagtagcaagatacgcttttgcagcattgtaaacaacttctaatcttctatgggtgctgggctgacgcaagaacccgcttaactgacactgttgttttgcattgtaaaaaaaataactcctaccataatgagattttctacactattttgtgagaagggaaaacgaattagtgaaataagaacataaaaatagtagcgcactagatgcattttgctcaaacagggtgttttatagtcaccatgcaccacgtaaccttgtcaatttaggttaacaaaacccaaaaacgataaacattttcagcctgaaagactcaagcaaatgccctaactgaaaggggcaaagataaagcaagaaagggacttttgtttgttctagttgagttgttgtttgccctagttgcgttgcccccaagtgttttgccgaagcaagcagcaatatcagttgtcagttcccatgtttttttaacggaaagtagtcgaacgagctcatggccatacgacacgaggcaacgcgcagaaaacgcaagtgcgtgctcatgtcaaacaggtaaacagcgcgttctacctaaagtaaccctcgcatccactgtaatgcgataccagttgctatttctcggtgcaaattatgtgtgcaaattatttatctccacaagcagaacgcaccaaatcgaccgaaaaaccaaaaaacaattcgatgcgaagatcgactttgccatccgtggaaaataaagcagaaaatcaaaggactcaacgcatatgatttttgacttgttcatttaccttgctgccgtcaataccgaactggtgaagcttgatgccgttctgctccagaaaccgcgtgttctcctccgggtacggctccgggcacaggtacctgcaccgatcaaccacgccaaggcgtcgccgccgccgtcagaacacgtaatcgacgagctcgccgccacggtcgccgtggccgagaaagagatcctaggtataggactcacacgatcgagcgtagcttgagggagaggaggaacgcgaagttgtcggcggcggggaacccggagcggaagatgccgtcgttcacctcggcgaagttaagcggcggcaccagcaccgccgcggcgtccacccacggctcaatgctgaagacggcgcccaccgcctcctcgccggcgcgctgctggtgctcgccttcctcctccttctgctgctggctcctctgtctcggcgaaatctccagctgcatatcctcctcttgggcgcgtgttcgtcgcgtttgtgcttagtagaaacggtgttcgcgcgcgctcgtgtcgtgtcgtgtggtgggatgagagactctcggcgagagtgacggttacttatagaggggaggcggaagttggggg

SEQ ID NO: 40763 - DNA, 166 bp, Oryza sativa
gacaaactcactgaccatgtacacaccaatgctggccatggccagttgcctagttgctagctgggatatgcctcgaattaccatcggtttttgcctcttcttactgaaaccagagaactgcaaagttaagttcatcaagaaagtaaatactaataaaaggggcaca

SEQ ID NO: 40764 - DNA, 749 bp, Oryza sativa
gtggtgttacaaaccgggaataaaaatcaacacgtactatataatccctattacttatgctcttctctcgtccacgcaacaaactctatctctttctttctttcttcctctctaactcctgccttatctctttctttcttcctctcttttttcttttggatcgagcgagatcgagggccggccgggcggcgggcggcacggccgacgtggcggcggccggcgcggtggcggcctgcgcggcggtggccggctggcgcagagaggaggcgacagcggccggccgagcggcgcctctgtggtttttttctcttttttttagaatttgtgatttattgcatgattctgtgatgtatttgatttgtgtgcgatgtgaatttgtgatgtatttgcgatgaattttgtagaacttgtgatgtaatttgatttgtgtaattttttttttaggatttgcgatgtatttgatttatgtgtataagtaacttaaagatttgtgatgtggatttgagatgttaatttgatttgggatttggggatatgcataccacttgattggggagaaaataaaaaagaaaaaaaagaaaagaggactatttgtactgctattattccctctttagtcccggttggtaactccaaccgggatctttagtcccggttggtgttaccgggactaaagatcgatctttagtcctggtaacaccaatcgggactaaagatagcgatttttagtcccggattcgtagtccagg

SEQ ID NO: 40765 - DNA, 299 bp, Oryza sativa
tattctttgtgccctaaaatactctctgaaatttcccgtgaattttcggagcttagaaataattttaatagcacaaatttcatttatcaattaaaataaaaagaaaacaaataaaatttcccctctttgtctttgggccgcttttggcccaagatcttttccccctccttggcccactcgcccctctccttcccttctccctctcaggccgacccctcccttctcggcccgatcaatttcccctcgcgcaaagtctaaataaccccctggctctcctccctctctccctccccgacagg

SEQ ID NO: 40766 - DNA, 1501 bp, Oryza sativa
gaattttattaaaccgtaccgcgcggtacgggtaaccgtacccccgcggtacgggcggtaaccgcggtaaccgcgcggttaccggcggtttttcacaccctgctgttgacagcgcagccaaattcaaattccccgagcgattctcaagcgcatgtcgcccacgttcctactaaacccgaaaacgcgacggaatttaaatccccccaaacccaaaaagatcgcgaaagttagtttcgctcccaacccgccgcaccacctcgcgctcgccgccaccgcgcgccgcgccggcgccgccgccgtctcctcccctacaaaatcctccgccgcagatcactctctccacccgcggagcgcctcctttcctcccccaccgccaccgccaccgcctactccttctcccgcttcgatcgaaaccctcgggagctctcgccgcggccgccgcgcgcgagtgcgagcagtatcagatgaagggcggcgcgtggaagcagagcggcgtggccgatcacgttggctacctcggcggcggaggcggggcgctggtcggccgcgcgcgacgggcgaggctgtgcctctacggcctcgcgctcgccttcggcgcgttcgcggcgttcctcgccttcgcgccctcgcttccggcgccgccgccctcctcgccggcggcagcgtggttcgacggcctcctcgcctccgcgtcgccctaccgcgcgcaggtctcgggctacttctcctcgctgttccccgccaactccacctccccggagcctcctggaggagcagcgacgaatcggcgaggatcgagcggtggtggtgggttctccgcgacgggtgggcaagcgggaaccaatggctccagtacagttgttgccggtgagcagggaagaggagttgaagtatcaagcagcaatgcgggaggtgttccgagcggcaactccccatccggcaacgctactgcggcgatgcagagcaacccgccgcccaatgatcaagcgggaggcggtgccgcagccaataactccaccacgggttccgccggcgaggctgcagttccaagccgcagttcagccagaaacggcacgatgaccaaagatggtgcccctgatcggatcaatggcaccgacgtgatcgcgagttcatctggagatgtcaccgcagtgaaagctaatgcaagaaatgctgccgggtctactcaccagctaggtggtgcaagtgcgatcgtagattcaagcaatggaactgctgctccatccatcaataagactgggaatgcagcagtggccacggacggcaatggcgctgcgcctcagagaggaggagccccaggcaagaaccagactgtcccaaatccgccggctgcactcgatcagaacaagagtggaagcagagctgctgcttcaggtggaagcaatagtacaatggatgctacaccacaggggattgctagtaacaccacagaggctgctgtcgatgccggtggtaagaagaagaaaacccattggattga

SEQ ID NO: 40767 - DNA, 1501 bp, Oryza sativa
tcgagcaattacttgcgtcaaaattatcacctggaaagcggaagcaacattccggataaagcctgacgcgacgcaaggctgcctgtccgggacagacaggggaaggatgtcagtgtcaaggcagtacttagccacttaagtactcacagtacattgatcataacctcttctactactgcctccgtcccgaaacaagtgcagccataagtttctgcgtccaactttgattgtccgtcttatttgaaatttttttataattagtatttttattgttatgagatgatacaacatgaatggtactttactcgtgacttatttttttttcaaaaaattttcaaataagacgagcggtcaaagttgggcacgaaaaaccatggctgcatttattttgggagggagggagtaactaacaacatgctctagtctaccaatgtttctaggctcatcaaagcacgctcgccatagcataggattcgtacaaaccgtcttcacattaacgctcacacacacagacacagtgtagggcagcttgtgcatgatcacgagaggcacaaaacgaacacaggagatcaagaagaagaaaaaagaaaatttaaaaaattggccagggcaaaaaaatgatgtgtctgttagatgcttttggatggtagcacgtagaggagatccggatgagctagcagatctcaaagctgcatgtggaggggaagctagctagccactgtagtagagctcgatcgcccagttgcctcttcttgcatggcttctagctggaggcagcaatggaacaactagccagagagagtgcatgagatcgttgcttgggacaaaaaaaccgtgtcagaatggacttggagtgtggggaacctaccttattatcttagcttcatgcatgtgattaatcggtgattatgtcttaatggaaggaaatgcactctgatccgttcgattttgcaggggaattatctgtgccgttgatttcaagggtcaatccctagataggacaatatggtcaggcactggtgggtcgactgggctcgtctgggagtgaacagtaaaaatatagcattaatttagagattgaaagtgtaacattttatagcaaacgtagtagagatagatttgtcttgactccaaaattttcaggaaagcatcattagattgttatgattgtgaggcaacatccagtaaatcattcatttaatttttttttgagcttgccattgtgtgtactacttgttcaaatgacaattcaacttgatgaaataaaattgagacccctatggaacatagaaatggtaaaataagggattttagtaggaataatacacaataaaatactaaaaacacataagaaacatagaaacggtcttttaaatagatggacagacgatgcaaataaaaatagagttagatgagagagaaagactgaaagaaaatttctctagaagtctacatgaaccattccaaatgacttttataggatttcaaaagcttcaaatat

SEQ ID NO: 40768 - DNA, 1501 bp, Oryza sativa
ttccaaaccattcacttaatccgattaattacgcgcattctaatcgcttgcatctaatatagtgattaaagcagtttgggacgtctaggactcgttctaacaagcagaaaaaaaaaaaactcaaaaattagggaaggacctaatatcaaataattagaaggggttaggttttgaacccaggtcgtctagcccaccatcttgtggagctagccgaaagacccctgagtatttctcgttctaacaagcacctcacctctacttgtctctaacaagcagaggtgaggtgcaattaaacaagggttgaataagctaatcccgggcaaataccaccgaattaagtttgtgcaagtggacagaattcaagttctggactcattcagtccttcttcattgaatattcttgtggattctcgcgaacttttacttgcaaagtccgacaatattcagaagccaaggtatgcagtgtacagttcagtcttgcaacacttataaataggagtagcttctctcattcaccaaatgcaccaagcttgacatcccctgattcctgaagaagttaactggaggttacaatagcattctatttttactctgctggttcctttttgctatttagctgtgtatatttctttcatcttcgcgtaattttgtaggagattttcaattggttcctttgtttacaggagcatttcatttggagcattagagcttgtgcagctcggatattcctggagcaagaatggggaagtccaagcgtaacaacgtcaagaagagcatctggcagctcctctgcggctgctcatcacctcagacgagcgattaactgagactgcaacacacgatattaaggagaataaagttgctcatgctgatggacgttgggctcaggggttgatgtgattacaaggtgtcggaaagttattgattgtttcattaaattgtctgtagatttattcgtgttgaatttagttccgttgtagtaaaggaaattcaagtctcttgtaaccagattctgaaataaaaccgtttcaccttgtatcatggctatggcctaaaatatttctggtttcctccaaactgggtaatacggggaaactattttaaactctcgaggggatgtctccttgttgtttgtatgttactcaaatggttatgaaaaaatttgagaaaatatattaatatgtgatatatcacttcacaaacatacaaagtcaaatttaacttctacatatcgtaacgaaaaaataaatttgactatgaatatactttaattatctgtagtttgtttttttacaacttataaaagttgatttaacttgcatgtttgtggagtaatatatcacatgttaatacatcttctcaaaaaaatttcataaccatttgagtgacatgtaaacaacgatgggtcattcactcgagagttcaaaatccactctccgacgatatattactgtattgcttaaattggtactaattggtaggtagactggtaaggcatgat

SEQ ID NO: 40769 - DNA, 1501 bp, Oryza sativa
gcaatcaaacataacgaatcacgagaaaggcctagatgcatggagctatccatccagcaaccgcaactttttcccctttgctcttttgctcttgtttattcgttcttttcccattgaccggttgctggctgcctggctcctcctattgatcaattccgtccattcccatccgcccaattcgacacagcttttgttgccacgaaagttgcctcctatttaagccccagcctcatcagcattcagctgcacagccataatagctagctctctcacacacataaacacacacgaaaggacgtaacagggcaaaggagagtaaggccatggccctagacaactaccactcctactacgtcgacgaccacttcgtgctgcctcctcctcctcctcctcagctggattgggattgggatcagctacagctgcacacacttggaggaggaggaggagacgccgcccaagatggcattcatggcgcctttcttccggccatgcgtaagacacacccactgctactagctaccacctcacacacagtatatacgtagactcatgcatacgcagatacgcttgctttcctcttttgcttgcaagctagctagctagggcatgtttgtgtagtgaactagtgagatagtgtcgttgagcttaggttcgttggtgtgtgtagtaggtttggagtcgccggagtcgtcgtcgtcggaggcgtccagtggctacctgcaagacgccgtcgcgcactggagcgaccgttgcaataagcggcagaggatggcggaggcggcggcgccgcctcgacggccagcggcggcggcggcgaacgaggacctgcactgccttcttcaggtaaatgccatcaacacattcatggacaatgtacccgtcatcgaagatatatgatgcatggttcatcgtagattcattgatgcaagaacttgttgcgttttcaggtagctatagtgggtagctagctcggcgcctagacaatatattcattctttagtagtggttacttattactggagcttttttaaaaaagatgaaagatcatgagatcactgaaacttttttgttgcctgtaaaacttccaagtagcagtagtaattaatctcgagtagaacgaaagtgctaagaacataacagagatcacagcaaagtggaaaggcacaactccattgtcgcaatgtcgcatatatgcagtaacatatacttacgtacaaaagagcagtgcagcgtcgtcgtgtctcctcgcagaaagcaagctgtgcctgattgtcttcttcctcgccttttgctctagctaactcgtagctgctgttgttttgttgcttgctcttgccacacacagagcttctgggattccagcagcagcggcggcgaggggggtctcatgcatgaattgaatatcatgatcccggagagcggcagttttgtctcaggtgattatgaatatcgacacgtccttttcaatcggacagcttttactaccacatctaaacac

SEQ ID NO: 40770 - DNA, 1501 bp, Oryza sativa
cggcggtacggatgaggaggcagtggcggggatgttgagggaggaggcgtcgaaggagaagctagggtttgagagccactgggaccccgccgcgggggcggaggattcctcgggcgccgagagggggaagagaggaaatagagaggaggaggaggaggagcgggcggcggctgtggtgggagcatgcggatcgccttctccgccggcggcgaaggcgggtggcggcggcggaatctccggcgatggctccatggcggttgcgagccgagggggaggagagagagccgagggggacgaagaggtcgggcccacggtgataatggactctggcttgttgggctaactaaattcagcccataagtttattgggcctccatgagtgtgagagatcgacagataattgggggcataagttcacttcagatcccttaatttgtcgccaaatctaaaattcatgtctaagggcctgttcactttgatgccaaaaatactttaccaaattgccaaaattttggcatagttgccaaaattttggtaacttgccaaaattttggcaggatttcttatatagttaccaaaatttggcaggaaactaaacgtacacatatttttggcaactttaccaaaatttggtaaggttgaaaatggcatcaaaatgaacaggccctaaacctctactccctccgtcccataatatagcaatctagtataggatgtgacatttcatagtacaacgaatctgggcaggccgcatgtctagattcattgtactatgaaatattttatctggtcctaggttgttatattatgggacggagggagtatcagatatgactgtatgacgcgtccctcaactcctaaaatcagtgaaaacaatatctcaagacggttcggatgatggttttcggttgaggttgggtttaaatcgtttccttaatcggtactccctctatctaaaaaaagccaacctgacccctcctagtcctacgaatccgtagtactaggagggtcacatccctttttaggttggctttttttgggacggaggaattactagatataatgtgttgctcaacttttaaaaccagtataagcatgcgttgctcaacttttaaaactagtataagcaagatctaaaggtggctcggacgacggttttaatgtctggtttaacttgatcctcgtcccacgcttactttctgttgctgcgttctggcactgtccattgcgagatgttaaaaacacgaaaggcgcacgcacggacgcacggcaccaaatgggcagcaaccggaaaacccgaacgatgtggctctcgtttctcgcacgaggaaccgagacatatggtttgtcttcatcgtcaggaaacgaaagcaaaacgcccgcacacagggcaaactcatgctttgattcacacgcaacaatcataagacggttcccatggtgctgtgccgccccatgcatgctcaagcattcttcatcccagaaaaacccgagctctttt

SEQ ID NO: 40771 - DNA, 295 bp, Oryza sativa
gctgctaatgttgatgcacatccatcaagagcaactgtgttgattgaactattaatttgcgctttgtatgctatttgtagtcttgcgctttattacacacaaatttttttttggggggagccttaaatcgcttcgtcaactatagcagagttggagaggatggccatggaatggactgcaactgcactaatactagtattatattgctattttcttaaaaaaatccttaatattttgtatttctaatatatataaaaatatataagcgtatccccgtatccttgttttttgaaaa

SEQ ID NO: 40772 - DNA, 341 bp, Oryza sativa
agatagacctaaagtgaactttatttctcaaacaagaaggtgcgaataaaggccccccatcttttagcccaataacaacggggtcatcttttttcttatgggccgtgcaaagtttcagcccatgatgcccgtgggcccggtaaactcccgtttccgtgcatgccaagaagcctctccccctataaaaaaaaaacgcccccgacaaagagggggacccaaacgagtcacctctcgcaccaccaccgcgtcagtatacaaacggcggcgaccaaccaaattccggcgagtcgtcgtcgtcgtcgccgtcgtcgagagagagtcaaaccccccacacgcaaaga

SEQ ID NO: 40773 - DNA, 786 bp, Oryza sativa
ccaactggagatcatatggccttaatataatacaacacaataccaaatgacaaaccaaattaaatcacattaattaatctccttcagacacatgactggtttcttagaatattgtcccatgtacccaacacgtgatgttctctcggactgaatcatgtattttgtcgatcggtttcaaattattttaggtttattttaaattaaatgtatctacttttagtcattaaattttaaaaatcggtatatagtttaataacatgtgaattatatgttatagaagtatttctaaaagtgaatcaaaatataaattttatgatactacactatataagttagtagaattaatagtcaaatattaaagtgtttgagacttaggacaaacttaggaaaattaaagtaatgtaaacgctggacacgtacgtctcaactgtctgtcattttctcgtgggctggtcggtcggcgggatcgtgatctacttaattggttctttcttggtaagaagtaattcacttttgctaatcagttctcgttaattaaatcgtgccctcttttcagctacggaaacacgaaagtttagacatcgacacgatctttaaatggcaactttggcccaacgatatgtattgtggtagttgtaggatcgacaacaactaagccaaccagagagggggtgaattgttagtatacctaaaaaccgaaaacttttagcggaaataaaagtttaccctcaaattcgacggattacggtttgaccgaagtttattgccggtctgaccacctgaaga

SEQ ID NO: 40774 - DNA, 481 bp, Oryza sativa
tgctaccacatactagccttttctgcctctttaggaatagggacatactgtagtagccaccatatgaaagattcagtcttactactatcttctatgggcccttggtctttaagaaaaacttctgctaggaaaaggaagaagacatgcccatacatttagtgcgtgtattggtatctaaactaactagctagattttgcatctacctcagcattgcatagaactgctatatggattactacgttttggtaggtgcgctatcttaatctcttttttaagagataatatgaatctctgtttgagcaggtactatctttagtctttctattaattctgaactatttgaaaaacgtgatcagctgaatcaagaaaataagcacagagtagcttatggcctactgaaaccgttatatatcctataaatttgaactctctttattctttcatgtctactttgtgactacgtcctattctacttttagt

SEQ ID NO: 40775 - DNA, 1501 bp, Oryza sativa
tctcgcggtggaaacgttcttttcattgcttttggtggaatgttccagtctcgtataatttgggtgctaatttgtgtggtccacaatgcaatgtagtcccgttgtgatataagtgaaaaaaacgagaagttacgagaaagttaactggataacttcgatgaacacggttgaagttagttacgcttgtttcccaaagggcagtggaaattgatcaaaactacaacagtcgtttattcgtttgtgttacttggtggaggaagttccagcatactgtttatgagaaaaagacaggaaagctcacttgtgggagtgggtagctgaattgtcttgtattgcttcattctagtagcatttattttgttacagaatactgtatatcttgatgagagatatgactaaagttagtaggagtagaaaggaaagctgttcttggaaatctttccaatttaaggtagtagatgtttccagtgtaaaggcacaggatcgatactatactggaacggttcaataattcagggtttgtcatttctccctacatattcatgcagagatgataaaacaaacttactataccatcacgttgttgtttgcaaaacaatctaggttttattcctaggtttagttgcctatcgtaggttgataattttgtgttttgtgcacattcatcataccttatcgactggaaatctggaattgtggctttactttacttctaggttcagtaggctgcaatacatgactccgtccgtacactggaggaaagaaaatgttaaatactgtgttcctgattaattttattttgatctgctattgtccacctggatcatatgatatcaaacagtgaacaatgtggcggttattttatcctttttctgtacatccattggactgcatttgttgtgcaaagtcgtatgaccttaagttgtattgcaattatcttaatttctgaggtgggcaattgtgttaagaattcttgcaaactgcaagttttgttttactcctcacagttttgcttgcatttactaacctcatgatcttaaagtgcaatgtaaatttggattttcatctatattacagttagttagtctgatataattattatatgcagggatttacaatcatatcttgctgaacttactatatttttgtgccctcatacgaagaagtttctcatattgcttgataaccggccatggctgcaagaccaggacacaaaacctgctcacctgtggcaattgatggtcacaaaggtatgctttactgttttacgagccacttgtaagcacacaaacgagtacttatgaatatttgttcattgcttacactttcatgtattgcccttgttacatcgattctggctcgtcttacttgttgacttcttgtcattttttgctccagtcaagactttcaccttttgcaaacactagaactaggagaaagggagatgaaactgggaagaaacttgtattctctaaagatcctagacatggttctcatttgt

SEQ ID NO: 40776 - DNA, 1501 bp, Oryza sativa
aagaacgatgtacgtataggtggctcgatgaacaaaaaaaaatcgaaacatatcaataagttgtgcggccacttaggaattagctagaatcatattaacatttttttgctggttagtacatgctagtgcttggcatgcatatgcacctcgaagaagccccagttctcgcaggcgtcgcggatgacctccattgctgcgcccctctcctcggtctccaggttctccatgttgatcaccgggaaggaggcaacactcgccatctctgtctctctctctcgttcactcgctcgctcgcttaagctgagtgtgtgagtgcgtctgtgtgtctgtgtgtgcactctgaggccggcggcgagcgcccaatttataggcgcgagagcgagaagctagcttgcacagttatctttttcactaggctgactgcctgacccccaggacgtggtgtgcggtatgccttacttcctacatctcaaaataagtgcagccatggttttccgcatctaactttaaccgttcgtcttatttgaaaatttttttaaaaaaattaaaaacataagtcacgagtaaagtactattcatgttttatcatctcataacaacaaaaatactaattataaaaaagtttcaaataagacggacgatcaaagttggacgcggaaacttatggctacacttattatggcacggaggtagtacgagtttacgacaaagtttagtgatttggtccaacggagagtaaagtagtgtggacgtaagcaagctaagctaagctaagctgctaatctgattatctgatctgatcacactgtgtcctgtgcacgccgcaggttgagttcatgccggttacccgacacagtcacaaaaaggttctccacaagatttgctcttactcctaattaatgtctaatgcctttgtgatgtagtagtactatagtgtaatactataatggtagtggtggttactattctatatacctaacctaagtgatcaactctattaagtagagaactacagatcgataagagactgttccttgctttttggatttgatgatgacagaattttgggcatagtacacctggcccagacctgatcaatttgatttgtcaaatgtagacttcacatggctaggtcctatggacacatatcaggttttttaaaaagggtgtggcaatttattatattaaagaagatataacattttaagaaaaaaaatatcaaaccatacattatgcaaaaaaaacatacagtgcttagtttgttaggaaaaaaccgtacattgtgtccggccaataccacctctataaccacctactaaaccgaacaagccaacctcctctaaaggcttccctgcttcacgttgattagtccacgttcaaaacaaaccgaccaacctcatcctatcaaatcagctctctaggcaccaaccgatgcccacatggagcaagagtgtcgtctgtgatggctcgctcttgccgtcagtgtttatggatcgagaaa

SEQ ID NO: 40777 - DNA, 1501 bp, Oryza sativa
agccgtacgtaaaacgagaaatatgattaacatataattaattaagtattaatatataaatttttgatgaataaatttcttggatttttttaaataacttctttatagaaagttttcgtacgaaatataccgtttagcagtttgaaaaacgtgctaacggaaaacgaggagaatctaatcctataagctgaaatgagcgtaccctaaggcctgtgtattgtgtaaataatgctgccttttgccattttggaatttcaaaatccccttttttttaaaaaagtgtttgtaaatacagtaagaaaacacaaactaaccgtgccttgtagactttgtagtggattctgtgctcagacaactttggtcaaaatccatacttacctataatcttctaggacgtctgaatttcttgacatggatctagatctgtcgcgacaatgaaactgatcaagattctaacattgaccttctgatccaatacggattatctggttgggtccaaatgtgtactgtaacttcttttccagattcaaagaggatggcgcttgctgccgtcgaccaagccacctggctgcggacttgcatgtggctcgatcaatcgttcacagcgtcaacgaacgatcaaaccacaatgcaattcgtagcgtgcacaccacgaacaccaagatagaagattgacctgacccgatcgatcgattgattgaccatgtttgctgctgctctttgatgctctgctcccgcttgtggtgttatctccacgagggttgctttcttgtcggtaccaaaccgcagatcagtggtcaaggacgggttaggaaaataagaactgtacaatgaaatggcccatagtccagtgaactgggcagtccttcagacgagtcatgctacgacagcaatacaatatgctgatggttttatgcatttctgctggattttacggttagagagctcagaccaaaagtcacctttcatggaagacaaaattttctaagagtagatgcagcttgtctgactttgtgtaacttataatcgtgctactgatatatgtatcatagtaaagtataatctgtatattagtaatttaattatagactgcacaaagtcatatgatctaagtttcgaaaacaattgcacataagagcgcgtattgaatttgcaggaattggtaaatcttccatatatgtgtctcatgaaactctcacgtgaccttggtccttgtacaagaggtcaagagcatgcggcgttaggctttgagcacggataaaacgccgcacttcgccagagctatcacatgaccaaacctgcgcatttacaagctaagtgtttcaacactaggtgaaatggatcgtcgcatcactctcgcctaaaaatttcctctctcagagccgtgccaacccacatcggtcacgctcatccacgaatttacaacttacaacgggacgcgtactgtcacgtacttgacgtacatagtgcccctctttatcctcccccaacttccgcctcc

SEQ ID NO: 40778 - DNA, 1501 bp, Oryza sativa
tttattaatttcttacattttcccacgtttccacggtttccccattttgatatccttttagtttgcaatgttcctatcatctccatgaattttctcatatttcaaacattttcccctattatccaaatattcagaaaacacaattaattcccacgctactctttggcttttcagcaaatccaatgagttttagatgcttttgtttggtttccaaaacactggaacggtggtttcctgttcgaatcaactgaaatcctggtagttccggttggaattcggtgattttgatcatttttcattgacgggcaaatggaacttgagaatttggcttcttaattttgtttgaaatttgacggttttcgtgaaaaccgttatactgacagggtcaggagcgggacctcgattggaaatataaacccttgcctgtaatacggtacagccgtacagaattcgtgtggtggccacgggctcacgcaccgggtcagtgatagcatccagtggccaatttggccatggagatgatgcattttttacacggagaatgatcccagaaacacgcatgatcttctcttacaagaattttctaacagaacatccatttcaccacacccacttgttcaatgcagcgctgttttgtaacccacataacaaccggacccagcacgtctgaaactaaggttactcatcggttacctaaattaaagtactccctccgtattgtattttaatgtatggtgccgttgactttttttatcaatatttgactattcgttttattcaaattttttgtgataatgtgaaaatatttatgtcatgcttaaaaaacatttgatgatggatcaagtcacaataaaataaacgataattacataaactttgtgaataagacgaatgatcaaacgttagataaaaagtcaacagcgtcatatattaaaatatgaaggtagtagtaatttacagagatgttttagcgacctaaaattctcaagtttgaaattttaatttttggttttcatttatgaggacaattgggactctaaccactcccccggtcgcttcgcgacgcgtccgtcccgacctgccaaattcctcgcacggattaagcaaaccaaactactcggattaaatgcgcaaatcgaaagcacgcgttccattgggagaccggcaaacttcgttttttccttcgagaggaacggagacggagtttgccgtcgtcgtgtgcgtgcctcctcgcgtacgcacatttgcccgcagcgccgcggcgcgcgaggctaccccgaccccgacgtggtctcctcccacccatacacccttccgcttccacgcccacacacagaacccaattcccctccctcctcctccacccgcccctccctcccacacacaccacaccaccaccaccaccacccacccctcgtatgcaattattcacgcccagtcgccgcctccaccgccgccgcctgctcgactcaccaccgcagggcggcctcctcctgccgca

SEQ ID NO: 40779 - DNA, 1501 bp, Oryza sativa
agtatttctcctgtatattcagaaccctgaaatatctaggtgttaaataatttatttacttctgtcacctacatctataattgagtgaaaaaggtgggtattgcaggtactcttctgcagctctgaagttgggcgaacttcatttgttcgacagttagaggcagattttcacattgacacaagcctcgatataatttcccaactatctgtatgtactcttgcatcttcatttcttttttcttggaccaggtgccttctgatagtcatgttctacatgtttatcttcgtttctttgctaccagcggttcattcggtgccaactctttgtttcctcaatagaaggaggacaacttgcgggtaatgtatttaactctccaagccttgagcagttcttctcatgaaaccagagcataatgggggttcgtatctaaacgtggcgactacagcagcacgtgtttcaagctttgaaggtgtcatgtgattctgtgacaccaatctagtagtagaatcctcaggtacataatggaggcatatgcggttggcacatatgttgtgtgctatgttgtgcctgttgttcccatctttctcatagctgtatcttagcctcatagatagcgagaactataagttggatgagtgcagttcatggccatctaatggtgttgtaaaatgtaaattgaatgccacaagtctttttttttttgggtttattagtttctgtagctttcattccatgacgagcgaactagtacctctatcgcaatagaagcaactgtagctgatgattccggtaatccggtttactttcgactgaatgctggatggaaattgctcctcaagctgaggaaattaagttgtgctgtgttttgttattgtgggttaggaactaatccttaacgcaatgaagtggtggattagcatatgactaattaattattagcaaaaacttgataaagtattaatataaaattttaaactttaaagcaacttatagaaatttgttgtaaatgtcgaaaaatctattgtgttgttttctaatgtattatgtcaactctctaacggggtatgtactccatagaatacatatgagggctatattgttttatctttagaaccatagaagtcggtaaagaggaggtgaggattaagatccgctgcatgacatgtgggtccagatctgatctatatctcacaaaggcgtgatgcagttgattgcagaggatcctgatccgaaaataacacaccctaaactgctctcatgttgaatggttccaagccaagctaacatttttgcttacaagctaagctaacccttttgcagtaagcaaattcaggcgccatcaccgtattcgaacgtcgtaggcggcaccgcggccgtcaactccgacgagctggccgcccattgcaattcaaaactaggctgccgggggccaggtcgtcgtggagccatagggtaacacacacgaacgcgtaacatttgcatttgcagatggtgaggaga

SEQ ID NO: 40780 - DNA, 1501 bp, Oryza sativa
tctcggtgggtggcaatccacccctcaccatccggcaaaactgacctagagcgcggtcaaggtagccataccgcacattgcagtgcatcacgcagttccacgccaccccatcccgcgtcgccatttcgtcgaacacctggttggcgtccctcggcgcgccgcactgggagtacatctgcagcagcgcagtgggcacgatgtcgctcgcgaggaagccgagcgtcgcggcctgcgagtgcgcggcggcccccgcgcgacggtcgcgcagttcgccggcggtgcgcaggagggcgcagaggctaggtgcggtggggcggaggcccgacgcgtgcaggcggcggaagaggcggagaccctcgggcgcgtggcgcggggcgcgggagagcgcggagaggacggtgttgtaggagacgacggaggggcgcggcgtggagcggaggagcgcgagggcgtcggggacggcggagaggcgggcgtagagggagagcagctggttggcgaggaaggtggtcagcgcgggcgacgagggcgtggaggagaccacgaggagcgcgtggaccgcgcgcgcgcggcggaggacagcgcggcgaggggagcacgatcggagcagcagcgccgccgcggcgagcgcctcctccagtccgaggcgcgaccagtccggtggcattcgtgatcacgctcgcatgcaacgaaccagtgtacgctcctctctccctcttgaacgctttgctaatggctgagcagtatttacaaaaccacagggttatcgtggttgtcacgtgtggtaaacattttagtttttaaaatcatgatataccacccttaatggtttggtaaaccatggttcaagcctcccaacaattgctcgctcaacggaattcaattttaaataaattatgatgattgtttttatcatagcttatttttcagcactatttatttcatccttaaaataaacctatggtttctagacttggacgtgtcttttagttctttaataaatcaaatataaaaatgttacttatatattaaatttggttgctttggttaattttcttagggcttatcttatcaaataattgaacaaacgatcagagaggaatgtgctatactgatgcaactagcagtaacctctgctaacaacaatatcgttctgtcgtacatgcttgacccagtttcattttagagactgcaaaactgaagacgttcttgttcatcttgtttattagtcacactattgagcctgctggtatggtattaataaaggtttcagttcagttcctctagtcctctactgattggtgagtttaaaatcggatgtttatcatgtttgtgaaatagaaaattgattacacattatctaaaaaaatgaaattgtattacaatctgagtttcactttcatgtttcgacggatatgcctacgcagttaatgtagtacgttactgttttcattcttctagttggattttttttgtttgggaatgattttcttttctgatg

SEQ ID NO: 40781 - DNA, 1501 bp, Oryza sativa
gcagtagctgaaattacagaacatacaataaatctgtagaaaagccggttatgtaactgctagggtgttatcctgagggtttaaacctacaatgcattttttacattgtggtgatcttgcaaccaccttatgaagaaaggaaagaggatgatatgaactattacttgaagggtggcatgagaaggaaattgaactcttggcatttcacgctatgtaaatattatttacagaactaatcatcttaagaaactatcaggatggatcttgatcgatcaaactgaaaccatttaagaacttgactgaaccttaaccttcagcgatatggtcaagccattcgactagctgctgcgatgttggtcttgacttaggagcagcagtcacacaaagcagtgctatctccaggattctgatcaactggctttcattctccttgtcatatatggttggatcaaatacttcagtttccctgtcttccttcttcatctgaagcacccaggacactacatctctgctcccttttggcctgcacatgtccacaggccgccgcccagtgagtagctccagaagaacaattccaaagctgtacacatcacccttgtaagtagccacaggtgactgcccatattcaggtggaatgtagcccaaggttcccactacatctgttgtgacatgcgtctcgtatgcgcatatgagccttgccaacccgaaatcagccaaatgagcttcaaagttctcatccaagaggatattgcttgacttgatatctcggtgcaatatatggggctcacacgacaggtgcaagtatgccagcccccttgccgatccctgtgcaatccgtagcctcttctgccaatccagcagggcaccaccatcagccctctcatgaagccagtaatccaagctgccattctccatgtatgcatagatcagtagtctgtcattgcctatcttgcaatagccttctagcagaacaaggttgtcatgctgggcacgtgatagtgtttccacttcagcttgaaactcccgctcaatctgagagtaatcgcctgaaagccgcttgattgcaactctcctcccatctggtagtgttgacttgtaaacaagtccaaaaccaccacaaccaactatataggcttgatcaaagttgttggttgacttcaatatatcttcaataccaagatccttgttgttctggaaaagcagcaccaagcttgagttcggagactctgagcagtcatcagcattcgctactgcctttggattatgctcctgcattcttgaatgaataatccttgatataaccacagaagcaatacacaagacaaaaataacccccactgcagtaccaagtccaagggccacaagggttgctttgttcttcttacgatgtggtgcttccgtatcaggagaattctttgtgctggaggaattccgaggaaagtgtagtgcgtgattgcctgcaaaatcctcactagtgaacgtggagaattggcctcctgcc

SEQ ID NO: 40782 - DNA, 1501 bp, Oryza sativa
acgacgcgcgtgccgacggtggggaggcagacgagcgggccggcgcaggcgtgccatagctccgagttgaggcacttcttctctgcagcagcagcagcagcagcagatcgagtcatcaaccaaacgagaagggaagtaaagcgaaccgcgaagcgaagcggcggaaacaaacctagccacccaccttcctcgggcggcgcggggggcggcggcggctgcggcggcccgatgctggccgccgacgacgagctcatctcctcctcctccgaccaaaccagagaagcacaaactcttaatctatcccctcacaaatccacccgaaaaccccatccccctcctcaaatcggccgcattctgcaccaccaccaccaacaccaacaccaacaacaagcatcaacaaaccacagagcaaagcaaagcaaaatcaatccaacccccaccccgccggcaagggaccaaccaacctttctcttccgctcacccgagctcggagatcgccaccatggtggggagaaagggtggggttggagagagagagagagagcgcaagaggggtggaaatgattaggtttgtggcatttaagcgagagagagagagagagagaaagagaggggttcgcgtggttcgagtagtgcgagtgcgtgtgtgcgtgtgcgcgacgagggggggcgcagcgcagggggccgtacagtagcgtgagctcccgcacagtgtctgaagagtttttaaaaagttgggaagcgagggggttttgaaaaagccgtattttatgggctcatgtaagcggctgtcgggtcggtgtaaccacggccgtaagagcaagtttaatagtataatagtatagttcactactagctttaattcatctataaccaatttaatagctaattcgtacaataattatttaatatattattaatatatggtctcacatattacatatattgtgtcttgaagttcgtgctgcagctggctacatatctatagcccgcgatcacttatcttattaaaatatgtttatatctggctaatagtctgctattatatatgctctaatggtgatgagagagatccatccaccatcccggcatatgcagctctccatcgcacgcagcgcagactggtgttcccgtggggcaccactgttgtatcactggagtactactaccgttccttgtaacctgtagcccgtgttggtttgtgaactcctccccgtctgtgttacagctagtactgctcctcctacgtgtttgtccagtcccgtcctccagattctaccggtatcatgaagtattgatttcattatttgggttaacaatatggtcttatggtgctaattttgttatatgttcccttcgtcctaaataaaatcaacttctatagtttaaattttgtcccataaaaaatcaacttctaccatcctacctaaccttggcacataaaacgaaaagttttctcccttaaaaaccctttacctacctttcaacattactatttttt

SEQ ID NO: 40783 - DNA, 1501 bp, Oryza sativa
ccagtctagtgtgtattcagaaattcagacatcagggacgtataatatgaatagacatgtgtagtactgacttagaccaccgtcatttctaatgccctagcaaacaaagaagctatataccagttgctttcgatgtacatcatgtacatgttgaaacttgcagctacaagctatcggagaattcatcagtgggttgggtaaagaagcaaatattgtttaaagctaagtaaaattatttttgtaaacataaagtgctttcaataagattttgtgctagcttttacgtcccacccttttgtgattagtctactcgatgaccggcatgattacattgctatttccaaatgacaagctagctagcgctatcttttcttgattagtctactcgattagcggcagcatcacttgcaaatgataagctatctgcacgcaacacttcattcatggtaagtgtgcatgatgcatgtatatgctttgaaggttagtataagttgtgcagattaaaattatgtgcaatcaaacactaatctccaaaaattccgtgttagtggtcaaacatttttaggtttttccataaatctcctaacatatatatacaaaatttaatctggtatttagcatacttcccatgagatataaacagcaatataaaatttaagaagtcaaatgtttttactttttagtaggcagaaacagaatgtagaaaatgatgtattagaatgattatttgatctcaagttgtacatcagtgataatgaatagaaaatgaatttaacatttaggagtagcagaagaaaaatatcctaactggtcaataattgaagtatatatgttacactaattataaatcaccgaggaattaaataatagatagggttgaaaacacagctcctttgtcttgtcaactttacctcccaaaaagcaacgtcactaattaactgatcagttaccaaccctgtacttttatcatagacaaaaaccagccaaaaacactaccacaccaccggccgctagctccaattggcatcaaaagtctaacatgattaaagataaggtacacatatatctactaacaaagcattacggagcacataatggaaaattaaaagttaaaaaaaccgctgttaatattatacgcataaacaaagtcatcagccgcctcactggccaagccaatggcatctctagttgcctctcaactttggtcacatgctttgaattccaactcatcatcgacccttatgttgcaatgtgatgcagtgtgcaccctcatcatgcatgcaaagccaacaagacaaggagaagaaaaaaaaaagcatgcgtgtgttagtgatatgttactactatataaacccctagcatagagtgccaaaggccattgccgcagcagcagcagcacaaatcaagtgatccgtagttgctgcttcttcgaattctcctctcaattcaacctgcctcgatctcgctctcgctctcgctctctacccgagtgcaccattaa

SEQ ID NO: 40784 - DNA, 285 bp, Oryza sativa
gtagccgatctggactccagccgattcctgctctgtttccgaactcgatctccgcctccgacttcgctttgatcaaatcttctttcctgacacaaatgttaccaaatttggtcgttaacacatgccccccaagtccgggatatttgataatgttctggatttgccatgtaccggctccgagcaagtttcgcactccgccgcttttgactgttattccagcactttaaatactaaccgttaccccgagaaatctcacgccgtgacttccgttttcaccgctcaagc

SEQ ID NO: 40785 - DNA, 808 bp, Oryza sativa
ccacactctccaattttcatccccttccctaactctctttctccataatcttcccaccctctcctacaccattttgtctctctctttctccacaatctttccgagaaacaccctctccataatcttcccaccctctcctacaccattgtgtctctctctttcttcacaatcttcccgagaaactttgtctctctctttctccacaatcttcccgagaaactggctttgtcattttgtctctctttctccacaatcttcctgagaaactagctagagcattattgcttgcgtatgcataaactaggagtttgagacatcagggatcagggatttgatgtacacgccaatagagccaataggtacctcctcttctctgggttgttcttcactacgaagagttggacccgggttgttcttcactatgaagagttggatccgttgataaagtcgacccgtagataaagtccatcatcttctcttctgggttgttcttcactataaagagttagtccatcctcttctctaggttgttctgtactcttctctggcttgttatgtactgtgaagtcctcctcttatctgggttgttctgtactgtgaactcctcctcttctctgggttgttcttcactgtgaagaattggaccgtacataaagtcttgatacgttgttcttcactgcaaaaagttggagcctcataaaggtatgtatggcaaccttttacatggataatatcgggcaacaacatttaggaaaattaggcgtcaggtgcccattttgtttctctctttctcttacacccttttagg

SEQ ID NO: 40786 - DNA, 857 bp, Oryza sativa
ttattgttgttcggtcggatgggggccttggtaaatctgtccataacattttttaaagttaaataaaaatgttgttcgaggcatctgtatataattcacggtggaataagaagcaaagcatgcaaggcttatggagccttaaagttagcaaacgcctttggttatttcttttctcgttgaagattagttattaatgaggctgggttgtgctttcttaaaagcagggctccaggccttttctcttaaaaaggaaaagaaaaagattgtctccttaacggcaccttgcttgcttacagtccgaggtactattctaaatagcttgcgaggaacaaaagatctactgggcatgcagcttgccggaaaaaaaattaagatagagattaaagattttctcttagtcacttcggtgatcaagttttaaatcgtttagatttccttccaagcaactcattggccaaagatatatagtttttcgtacattgatatcaatgctccaaaaattttatatcgtggtacaaattttaaatacaaaaaatacaaaatactattatgcatgagaatgacacgtggagcatagccgagcctccatatcaataaccggtactccctccatcacattttaaatgcaattgtgggtttccgtgtccgacgtttaaaataagacgaagggagtatagcacattcgatggctttttttcttccgatggtacgtaccaaagagattggcccctatatatatagtagtagattgctatcagctgacacagtcgtgtagtgtgtagcctgctagggtaattgaaagaaattacaccatggatgaatcaacatctgctttggatggtgatgagaagaggagg

SEQ ID NO: 40787 - DNA, 1501 bp, Oryza sativa
aagatctagtatagaagccttatctttgttactgttaccgagtcctttattattatcgctctttttttttcgcaagatgtataaagtcctaaacagttactgttactattactgaagttattatctatctttggatatgagttctcccaagtacagcatcacgtgttgttacagctctatcgtttgttttttagggtgtgtttagtttacgaaaaaaaaattggtatcacatcgaacgtttgatcgacgttgaaaggggttttcggatacgaatgaaaaaactaatttcataactcgcttggaaaccgcgagacgaatttattaagtctaattaatccgtcattagcacatgttggttactgtagcatttatgactaatcatggactaattaggctcaaaagattcgtctcacgatttccatgtaaactgtgcaattagttttttaatctatatttaacgcccgatgcatgtgtccaaagattcgatgtaatatttttagagaaaaaaattgggaactaaattattaataaacgttacagctgacaaatgggattgtagcttttgactgagttgacaggaacagcttcctccatatggagaaccctgtcctgaaatatcaggagaaccatctcgtatttggctcatcccaataatccttctttctataaaactaatacctattaaacacctaaaacttaacatcaaaatatactacctctgtttcaatttataagactttctagcattccccacattcatataataaatctatatatatatatatatatatatatatatagattctactcattaaacacgcaaaacttataacatataaacatatagtaattatatttacaattatttcattataaaactaaatatatacatgctaaaccatcatccttcaatcattttcataatatttcagttcaaatcatttcatcgtttcttcaatatctaacgtatatattctgcagcaaagcgcgagagatcatccagtgcatgttatgcttgtgctttgaacgatagtttcagcgcaactaattgcattggtactctgtttcatggtgtggaataaaactgccatgtttagtttccttcctattcccaattttccatcacatcatatcacatcaaaaaaaaacttttctacacatataaacttcaaactttttttctaaactctcaactttctttgaacttttattttttttcaggaactaaacacacccctgctagcatgagtttccaaaatataaatatcaggagaatcctatttccaacaaagatattacgtacactctaggagggttggacgagccctcctattttcggaaaaagatacagtagtacacagtaccgtggataggtgggacgaatcgcttccacaaaactacaaaagtgccccgtctcaacgagaaacccgcgcgcgccccgacaaaaattcgcggtggcctaccagcgatttcgcttcactgcagtccgtctaccgaatgg

SEQ ID NO: 40788 - DNA, 1501 bp, Oryza sativa
gccgagtgcttcaatcatctttgtcatggtctcccgagtacttttaccaaatctgaagactgtggagggctggaaaataaagtcaggtgcaccgactagatgcacctaataggtgcagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatggccacaacatataatcagcctaagccataatattggtcaataaaaatgcacacttacgtggcgaaaagcaatgatattgtatccaatcaaatgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacgccctttaaaggatgacgcatataacatgctcccgagtaataaatcttccgggtaatatagaccaagcgtagctcatatgaatagcttctgatctgagtggttatcccttatgggatactctaaaatagatgtaacaattgaatcccgactggcgcaagtattcaattgataacccttacggggaataataaatagtccagtctttgagcatataaaatagacccatgatcatgaattcatgttgcatgtatccggagcaagtccaaattgaagatataatacttgtatttaagctagtaagcccctgagcacgtagtcacaattgttcattgatggtagctgacgcagttggcatagagacaagacaaccaatatagagagaatattgcccaccagaggtggcaaaaatattggtggtagcgaagatagtgataccaatcaaaagtaatgaagtcgcatagccatggaggcgaagaaaccagtcggcggcagacagatcaactaacaatgaagatgaaggagcccagcgataaagttgtgtagccatggcagcaaaataatcagtcggtgacagacgaggtagatcaaaggtgatgacaaaatccaccaatca

SEQ ID NO: 40789 - DNA, 1501 bp, Oryza sativa
tacttaatacttaattaatcatgtgctaatgagatttctcgttttgcgtcaaaaatctatctgccaaacggatgatcaaacggggccttaatcaagatttcaataaatgtggggttttatgaaatatttagaccataatacatgtggttgtgtgccacacatcataatatatgtggttttctgcaactttgatcataaaatgtgagattttctgagttagctaaatttccatgttgccctttttaatggtctcaataattttgttgttgcttgttgagtactatctgatattgtttctgacaagagcttcctcagtatatgggttacacatttttcagtcttgatatttgcttctatgggacattatgtcaaagttatctcggtaaatgttcagttttaactaacggcataaggaccccggacttcagagcaacctgtctcaatcaagccgttcataccatgcaaggtgcctgaaatctgaatcaatacttcctttgttggtgaagcatagcactttagagtttgatttattaattcattttcttttgtttcagaactttagacagctgatactccatcaatctgaagtttgaatatctcaagtttctctgattcggcaatcatccagatccatcattaatctcttaatatgcatagttaacttcgtctgctgctcatttttcaccatcaaattcctagccagtgcttcgtaaagatagtaagatggacagtgaagttcagggcatattgcttcttattaaaagcttgttttagtgtgatatggcaaatgaactaccctgaattctggtttcatgaatagattttacacaattatttttcttctagcctgcatatagtagttgtagcttcattaggcggttaaaagaaattttagaagcttgaactctgggtccttcacgtttatgatttgttcagatttagttattgcagtatatctctttttaaacttcgttagctaacgcctgtctaaattgcactgttcagtgtaccagttcagggttctgccgaaatcattctagggccgtgtttagttccaaaataattcttcaaacttcaacttttccatcatatcaaaactttcctacacacaaacttccaacttttctatcacatcattctaatttcaaccaaattttcaattttgatgtgaactaaacacatgcaagtcttacagtagcttctgggtgtattatagaaaactgtattgtttgatactagcacaatagctcaagtaaagtaacggctgtgcgaaagtgcgaaaccaaaaatccagtccacgctgcaaaacaggtcaatgccacctactagtacttatttttcccatgcaaccaccgtgattcaagaataggcagacaacccacgctgcgaccggcaaggttgtactagaatttaggctactcaacattcatcatgactactcgccgttgtttgtgcggtgccctgcaggaaatgagcctcctttcccatttctgcctctgcc

SEQ ID NO: 40790 - DNA, 1501 bp, Oryza sativa
ctacgctgccgcggccacagcccacaggagaaagccgagcgctcctcgtctgaccgttcgtcaccgtctcggttaccgcgcacgcttggccccacctgtcaggcacacaccagttaccgatggctggacgctgtccatggcagtatgtaccaccggccgaggcaactggggtttctggctctgtggaccaggttcacgcctcttttggcttcaactgtggtgaggtacaggacaggtgggtcccggatcccccaaagcgcaacgacgcctcgtgaactaaacccacggaaaccaaaccagattaccagaaccgcttcttcttcttttgcttcctccggtatcattccagttttgctacctcctcacttcactcctctcatctcatcacatctcatctcaatcttttgcgccattccatcggagctagcacccagcaactcacgagcaagcaaatcaggtaataaagcagcatcctcattctctctctctctctctctcttgtgctttgttgtttgattgcatcttcttttgggggcggagaatcatacgcattccacgggccctttgattccagggctcggatccggctgttgtgcatggccaagctgggggcttgtgttcgtcgtgtgtgattgggctgcttgggttgtttgctgcaaaatctgtcactcgttttgtttgggttcttggcaatgtagctgctggttttctatgactggtctcaagttccgagtttaatgcaatgcgggagggatttgtgaaattacagcaatttcttaagctttttttccttcttggtaggcggtacatgccgtggttaacattcttgttagctgcaggctgcggctgatcggtgaggcgagcactaagagtatttttgacgtgtttaccggaatgtatttccgctattgctccgaaatggttggggttttcagtgttatctgtgagaaaagattagtcttttcttttatattttctaaaaaaaaggatcagtattttattgctcgcgtgaactgcatttgcatcagttctgctttttatttaaaaaatcgttgttagtcctgctctgccaaactaaagttttagttgctttgtacagagtattggtccaaattgcattgagcattttcagcacaaattgatactgataaactgctgcgacctacttctgcaggtttagatagcaaggaggccgcagagaagtggagaggactcacgaatcacgatccatttctatcttgagggaattggggatagcaaaagtcagtgaaaaggtactttttagttctgacccatttcttacatcgtcacttttattaagtgtgtgcttcagattcctagtggtaggaatgacccaacaaagaccatttccaactaggttatgcactgctttagttttagcattatgtgtggtgtagcttgagagcatgtgggccaattgggatgcatttgctgttgttaattttacctatccgtttgtcttatctgctttgcaacattg

SEQ ID NO: 40791 - DNA, 1501 bp, Oryza sativa
aatttgtatcatgacattttcttaaaaaaaaaagatggacattatactccactgttcttggttctcccagcgtaagcaaaagctcatattaatactgagcaagtgaacagttactaccacttagttcatcgcttcatagtaaattcatttttctcccatttatccaaaaataagtttatttttaaatagttattacattggagtctatgaaaacagagaataattacattgaaaatagataaataaagaatagttacaatataatttgataaagagtgtgttgagttcacgtcaaaattagaaatttgattgaaattggaacgatgtgacggaaaagttgaaagtttgtgtttgtaagaaagttttgatgtaatggaaaaattgaaagtttgaagaaataattgggaactaaaccaggccaaaatacatatattgtagtctttttattactatgtattaatatgtgtgaaatgatcggggaaaaataatcctctactgtctccacagttctaccaccaccagcagcagcatcggatccatccatccacgcattgatgttgcagcgcagacccgtcgttactcgtagcttagtggtaacagtaacccgtccaccaattgctccacccgttgcagtcgccatcgacttgactctgacctgcccctttctctttctcttattcttcaagagtgtgtttaggtacttccaaagttactagtttggattaaaattgatacgatgtgactaaaaagttatgtatgatagattaacgtgatggaaaaagttggaagtttggatctaaacacggcccaagagagggtgtttagatcaaggtgtaaagtttaacgtgtcatataaggtattatataaggtgttatatggggagttcatacactacaaagaaaaccaattacataattcgtcagtaaaccatgagataaatttattaaacataattaatccatcattagtaaaattgtcaaaacatgaaacaagtagacttaaaatattcgtctcgtaaattagtcgcattctgtacaactagttattttttaacctatatttaatattttatacgggtgttgacatgaagcaagtagacttaaaatattcgtctcataaattagtcgtattttatacaactagttattttttaacctatatttaatattttatactggtgttgaaacgtttcgatgtaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 40792 - DNA, 1501 bp, Oryza sativa
atgttgcagcgcagacccgtcgttactcgtagcttagtggtaacagtaacccgtccaccaattgctccacccgttgcagtcgccatcgacttgactctgacctgcccctttctctttctcttattcttcaagagtgtgtttaggtacttccaaagttactagtttggattaaaattgatacgatgtgactaaaaagttatgtatgatagattaacgtgatggaaaaagttggaagtttggatctaaacacggcccaagagagggtgtttagatcaaggtgtaaagtttaacgtgtcatataaggtattatataaggtgttatatggggagttcatacactacaaagaaaaccaattacataattcgtcagtaaaccatgagataaatttattaaacataattaatccatcattagtaaaattgtcaaaacatgaaacaagtagacttaaaatattcgtctcgtaaattagtcgcattctgtacaactagttattttttaacctatatttaatattttatacgggtgttgacatgaagcaagtagacttaaaatattcgtctcataaattagtcgtattttatacaactagttattttttaacctatatttaatattttatactggtgttgaaacgtttcgatgtaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaacaccccctcagtctatctctcttcaaagtccaagcagcccacgaagtacccggcatttattttcctcacccattttctccactaaaatacgcgccgcttattaaatttcccccgcctttgctttgcgtcaccatatcaaatgcgcaactagcactggtgcggcctaccagtgagcgagtctgcgagtgagagaaaagaggacacgagaaagctttagagagagagagagaggaaattgattttttttaagtttgcgatgaatgaataaacaaatctggtgaagaggttgggaggaagaagaacggctgctgatgagagccgcattggagtcaaaaccaaccgtctctttctctcctctgactttcccccactctcctcctcttcttcttcttcctcctgtgatgccatcctcctctttcggc

SEQ ID NO: 40793 - DNA, 206 bp, Oryza sativa
aaatatatttcatattttttttataaaaaatacacggtttagcagtttgaaaaattggatcgtgaaaacttcggattagaagagcggttaaaataacaaacccttagtagtattaaaatgaaatttactcgaaactaaaattgaaaaccagcttttctccctccctctctcttttccttctctgtttttccttcttccgctgcagc

SEQ ID NO: 40794 - DNA, 576 bp, Oryza sativa
ttaaaattttgaggatatggccccaactggcaagaaagataggccaaatagtagagaaacccagaaagcatcattgcacaagaagatagtattttgaacttttgaagtaccggaattacaaaactattccaaatattgagcatcaaagcttcattgcactgaggttgcttctaggtcaggaagatatatttacaaaccaagaactccgacataataataaatagtaaaggccaaactacacatcggatgattttttagattaatactccctcagtttcataatgtaaaactttatagcattgtccacattcatataaatgttaatgaatctaggcacacatatatatctagattcattaacatctatatgaatgtgggcaatgctagaaagtcttacattataaaacggagggagtagctcaaaactccagagaagttctagtacattaggaaatagaataaaaggggaatatcaaatttgatttgagcaacaaataaattccccaaaagaagattttggactagacatatggcatgcctttctgttactatatcccaagtatttccagaaaaaca

SEQ ID NO: 40795 - DNA, 644 bp, Oryza sativa
ttcctgcagcccaaattactacgcataataattacgtgcatgaagatgcgttttccgtagaaattttgtgtgtgctgtgtgcaagtgtggtttcgtaggcgtactattttacccgatttcaagttaaacggtgtaaaatgtttatagaattagagttgatttttcaatatattgatgtgcaaagttggtgtattctatgctctgacttgtaagccttttacaagtttggcgaaaagttgatttttcatactccaataatataggagtatttgagagtcagagagtggaaggataataaaactaactttctccttattccaaaattcaatactccctccatccctaaatattaaacgccgttgacttttttaaatatgtttggccgttcgtcttattaaaaaaatttgtgaaatatgcaaaactatatatatacataaaaatatatttaacaatgaatcaaatgatagaaaaaaattaataattacttaatttttttaaataacacgaaaggtcaaatatgtttaaaaaagtcaacggcgtcaattatttagagacggagggagtatatttgagagccagaactttggagcaagtactatcactacttgtttgtagctaattaccaatattattgcaaacgctgg

SEQ ID NO: 40796 - DNA, 324 bp, Oryza sativa
acattcactaaaattataagaatgaaatttgttctgtgaatgtaatacattattagtttgttttgtgaatataatttgatatttagcacacctattttctttcgcacctcagtatttgtttgcttcatggctacttgcctactctcatgttagcaaattcttttacatttattcttcatccttctttttagtgattggacattattaacatattccttcaagcttagtgaaatgaatagttttgattttttaggataattttacattgatttttttgaattgacattttacactgacttacatttactatacttcatttgtaga

SEQ ID NO: 40797 - DNA, 775 bp, Oryza sativa
tgcggtgagcattcctgggttatttttggaggtcaagtctgtgtgttctatacttcctcctaacttttgctttcttgttttcagaacttttaaacgttgatctttttaatatttttaattttcaagtttttcaactaatagtaattcgtcgtttcataggttttccaaccctcagcttcaaacacagccaagtatttgatgatcaattcagtattactagacatattcgtgaattttggatgcaacagaaccaattttcactgccattgggacacaaatcatttataatcacattctcaagccttgttcgaagaagcttaagattctaagaatttactggttggtaaccagtttctaagaatatattctacaactacagattttcagaatctagatgacaatttggtctatttggaggaactggagattttgtgaaaagcattgctagaagcttccctaaacatgcctcagttgcaaagctctacaagccaatttgtactgcaccaaatgctaatgctgccaaccgtacaagtgttaccgttttggacagttaccatttttagcaacttataaaatttaggttttctattttttttcaacatcatattgtcgctgaatagttaaattgataagtatagtcaattcctgactgactgagaattgtgcccaaagaaacgctaccgttttcgactgttttcaccctatatacactgttgcaatcaggagagcacaaatataactctttgcaggcgaccaatggcctctctacaacaga

SEQ ID NO: 40798 - DNA, 1501 bp, Oryza sativa
aattattatgaacttagaatcaatcatcatttctcgctgggaatgacctatgagctcttttgagcatttgagcaggacctaaattattattattattttccttgaacaggaggaaaaatatattgtttatttgctaatagagatacttcactgaatgcctatatctatatggttaggacaaaaatacttgcaaaattattacttcttccattctaaaataaacaaagacgagtcttgatatattatagtacaataaatctagataataataaaagggatcacttatacatttatcaacaattttttttttcaaaaatttaacaaatataactatagtataattgtgatgtaattatattatagcttacgtgtaactataatgtaacttgtatgtagctttttaaaatctctacgtaacatgatatttcagtgaaacggagatcgtgggaatgaatcctctcacatgtatgcacactgtgatttttttccttcctcacttgcacaaatcttgaaacaaatctaacaattcaacatgtgaaagttacgtacaaattacatgcaagttacagtgtaattgcatgcaagtctcgatataattatattataattatactgtaattacatccgtcaaatttttaggaaaaaaattgttgataaatatataacaaaaattgtaataataaaatattgaacagagatactatcgatagcctatccagatttatttgggggagtacctatacatatttcgaaagatttttatgatcgtatcacacatatttttaatctttgcattaaaattcgatagatataataaaaagcaaaaagcaattaagaaacaccataatggacactaaattaccatatcctcaagaaaaagaccaaatccaatacaaaatttaaaatttacatgcaaagattcaaaaattacattgtaacttacaaaagttacagtgtaagtttcataaattacactgtaacttacaagaaaatgcactgtaaatttgagtgagaaaatcgagtgtgagataagaaaaaatctttcgagtgagatatagcaaaattgtttggttattttgaagtccgagggagtactgtaaacatatcgttatgggctgggccttgggttaagacaaatcggatccgacaggtccaccgacccgacccactacaaatatccccaacccgaacgccgtaaaaaaaacaaaaataaaaaaaccctaaaatttccccaccgaaagcccaagccaagccacacaggcgcggcgcctgcctcaccttccctcgccccggtcgatcgatcgaagccgacgaagcagcgggaaaacgagtcttcccccctcaaaagcgagcggaggaaggaaaccatcgaccgtttgccgcgccccgatttgaaccctcgccgcctcgcctcgcctcgcggccgtggaggcggagcgaaaccctagggaggcgatggctgcctcggtggaggcggcggcggcggcggtggtggccccgc

SEQ ID NO: 40799 - DNA, 1501 bp, Oryza sativa
aatggtttcagtttgatcgatcaagatccatcctgatagtttcttaagatgattagttctgtaaataatatttacatagcgtgaaatgccaagagttcaatttccttctcatgccacccttcaagtaatagttcatatcatcctctttcctttcttcataaggtggttgcaagatcaccacaatgtaaaaaatgcattgtaggtttaaaccctcaggataacaccctagcagttacataaccggcttttctacagatttattgtatgttctgtaatttcagctactgctatggtatgaatgaacttttgtggggcatttgttttcagtgatttgctccagctagtgctatcttatatgtccattttccatttttcacatctgatccttctcactgcatgtaaaatatgagaaatcaaggtcttatgcagcgctgcagaatgcgagcaccgccatatcagagtcagatacagatggtatggccagttacattgttctggaattcattcagcctatactggtaaattgctgtatggttttatcttttatgatcttgtagtagctccattgtcttcatttggctgatggtttgaccttgccagcattcagtactggcactgcagtgctttggcaggggtgatttcttccacgttgcatgctgttctctcatatttgttcgaaagatttaggttgggaactctttttcgtgtaggtaaaacaggatacttattagaacaggaataaataagtattatagctaaaataaatttgaaaaatggattaatttgatttttgaaacaattttcctataggtttttttttaaaaaaaatatttttgaagcgagtagaagtttagaagggaacttgtagtacccaagcctttttttttctttttttaaaaaaagctatgacctattctggataggcctctcctttgctcatgcacaaaattgtcgaccgttctacagtgcagaggaaaaacacggaaggagcagagaacggcgtggtacagcgtaccagatcaaccaccacccgtgaatcgacggcgcgtgcaggggattagccggcgaggccgcccgtcgcgcgcgcggctccatggttaatggtttcttccggcctcgctccctcaagttgaacccgagcacatcacaggcaaaggcaagccctcggcgtaggcggcgtaaagagggggagaggagatagagccggacgaatccgaacggcaaagcccgcgtggctggctggcggcctttcggcctattctcacgcgagcggctcggcccaaaataagcctattcgcattctcttctcttggtattttccactggttgggccaaaaaacgggaactacaagcagatgcagataagctcaacaacagcaacacctgaccaatgctggtcgtacgactacagctgctcgctgtagcctgctgccctgctgtttcgagtatcacacgacacttcttcacttgtgtagtgtacgtatatatggttgcttttttt

SEQ ID NO: 40800 - DNA, 1501 bp, Oryza sativa
tacaaggactgattatataagcatcacaagtggctcccagttaattaagtactactagtcgctaatccgcaggcagctctttaagtggaaaaaaaaagatagtacttgattagtcttgtcatgattatggtatttttgactaattgtgatttccaactcataaaatagaagcatcaagtacataattttttatacctataatatatgtctcttattaacatagaaagtaatgtctcgagatatttatgtactaactcgatggacccgttcctacttttaccatggcttttattagacagactgtaagcactatagtcagcgcatcgagaaagtatgtcccaagatacctaatgctcccctctctgttcaccggagctctacgtatataaaatattgcctacacctggttgaatatattctgttgagcgattaacattctatgtagtaggagtactccctccgtcccacataaaacccattcctatcatgctaaggtgagactagtgaagagtaaaaatgactaaaatacccttttattattgaaaaaaatagtaatgttgaaaggtaggtaaagggtttttaagggagaaaacttttcgttttatgtgccaaggttaggtaggatggtagaagttgattttttatgggacaaaatttaaactatagaagttgattttatttaggacgaagggaacatataacaaaattagcaccataagaccatattgttaacccaaataatgaaatcaatacttcatgataccggtagaatctggaggacgggactggacaaacacgtaggaggagcagtactagctgtaacacagacggggaggagttcacaaaccaacacgggctacaggttacaaggaacggtagtagtactccagtgatacaacagtggtgccccacgggaacaccagtctgcgctgcgtgcgatggagagctgcatatgccgggatggtggatggatctctctcatcaccattagagcatatataatagcagactattagccagatataaacatattttaataagataagtgatcgcgggctatagatatgtagccagctgcagcacgaacttcaagacacaatatatgtaatatgtgagaccatatattaataatatattaaataattattgtacgaattagctattaaattggttatagatgaattaaagctagtagtgaactatactattatactattaaacttgctcttacggccgtggttacaccgacccgacagccgcttacatgagcccataaaatacggctttttcaaaaccccctcgcttcccaactttttaaaaactcttcagacactgtgcgggagctcacgctactgtacggccccctgcgctgcgccccccctcgtcgcgcacacgcacacacgcactcgcactactcgaaccacgcgaacccctctctttctctctctctctctctctcgcttaaatgccacaaacctaatcatttccacccctcttgcgc

SEQ ID NO: 40801 - DNA, 1501 bp, Oryza sativa
taaggaaagcttcactacttcttcaggtggggatcatcctgagtgctaccagaaccattttccaatggatagtgatcctgtgcgagattggaaccaaagttatgaaatgccccctgcagatgatctgccccagaacagtagggaggctgatgaacttttgggtgaatcttcaccaggttttgatgttctcgtggacaatgatgcagatggtgctgcttatttacatgatgaagattttggaggagatatgtatccagtggaagattatgaatatgctccagctgattttgatgttcgtgcacatcatgaaagagagcggttcaatggtatggatgagcaagaccagatgggacatatgtatgatggctacgagagaaaacggcgtagatcatctgagaggagcatggaacggcctttccactcagaaagaaggtttctgcaaagagatagagaccgtgtcgagatggatggatcggatttacgtcatcggctccgtaggagaagaataaatgagtcttcattggcaattagtccagaacgcaatggagagcaacggcggagggatgagcgctacagggaaagggcacatggtcaccgttcacacagggatcatcaccagagctctcgaggaagcactcttagctctcgtctgcaaggcagaataaagcttcctggaagatctcctgacagagttgatactcgctccgagaaagagcgagatagaagaagactccgggacaggctgtctccagttaggcgcacggaatttcagggtaccaggcatagggaggcaggacaacatgaagagcagacccagcggagatcaagtgaacttgctttaggttccaggaatgcagatggccagcatttgacaaaggatgtgcctgactcacacaacttccctcatcgcaaaaactcgagggactccagtaaggccaatggaagtgttgagcctgaagcatcgcttgattttgagggcccaaagccccttagtgtcatcttacagcggaaaagagaggcagcatgggccaatggcacatctgcctgtagccccaaacaagataaatctgccgaggtctcacacaggcaagcttctctggctgaagctgagaaggaaggtgacaacataattagttctgatgaatacaaaagtggatctggcgatgaagaattcagagacgaaggccacatccctgtggagggccatgggcaatcttcatctcatggtgacaaacttgaggctgaagatattattgaggtggatcccgtggaaaatcaagatgctgataattatgaccagagggagggggagtcctactatgagcctatcgaaggccaggactacaaatccgatgacgagaatgcttatgaagatgatgatgaagagtatgatgacgatgatgattttgctcggaaagtaggggttgttttctcttgagctctgtgggccttctcctggttttgttgcatgcagcaaagctgaaaatgcttgccttagtga

SEQ ID NO: 40802 - DNA, 1501 bp, Oryza sativa; identical to SEQ ID NO: 39941

SEQ ID NO: 40803 - DNA, 1501 bp, Oryza sativa
cgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatatttttaaatttttataaatactagaaaaaatgttcgtgctgaagtatattttaattgggtgaagtatattttaattttattattgttatatggattagttaagatgaaatttattgtgggagttcgcttggatatatatttttttagaaaatcatgagctgtggttaggagttcgagatcgtctcaaggtagtatgcgagttttttaaacagacttcttatatgattccttctgtattacaaaaataaataattttaaaaaccgactcaaatatatatatatatatgtatttactccatcgtcacttagagatttgggagggagaccggttgagctgacatgtccacgatggcagaatctcccaagattccacgtggaaccctaaccttccctttccaaaaagaaaacgagagcccttttcctattgacgcacgtgagcgcaccgcttaagccacgctacccacgctacgcctctctatacctaacgctttccccgaactccaagagatcaaaaaaaaaaaatctcaaacggcaaagtcaaaaaaatactactactccgacacgaaaaacaaacagaaaatcgggggaaaaaaatctctg

SEQ ID NO: 40804 - DNA, 1501 bp, Oryza sativa; identical to SEQ ID NO: 40272

SEQ ID NO: 40805 - DNA, 1501 bp, Oryza sativa
ttcatcatgcaatatcccatcccacaccagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgccacggcaaagcttttcgataacctcgcattggcagtacccgctccatgaacttttcatcctcatgcactctaggcgtacacagtttctagcagtgagaggagttctggcgctcccgggaaaggaagtctcacacactcattaagttagtttctctctcacacactcatggcagtcctaccaatggcgacaccgatgtagggcacgcctctcggccctacctcaacggctgtcccacggtagcgcacctgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttgtttagttttatttctcatttcacaaatcatgtcatcaatatcatggcaatgtggcgctcatgtctcgacatgccgcatctcaattaccttcccaaaggtaattgcccaagtatatagcatttgataaatatgagtatgcataattctagaatagcatttctaagcaattgtcataattgactagggactcatacgtaaacatggttatgaaggaataaggggtaaacaataatcaaggcatggcataatcacaagtaggatgttcatcattgcatgcaattttatttgtaaacaaaataatttcgcaattgggatcaacatgttcaaagaatagtgatgacttgcctgctcagaataggccttattcttgatataatcttgatcaaccgttacctcctggaagttgcaaacgttgcctcacgactaaccgatacacaaggtctataatacgcgagaaaaaccaatattcaaacaacaatcaaatatgcacaacaaaatgtactattcatgtttgctaatgaattccaatcatgctaagggctaaagtttcttaatctttctattgtcatcgtggtctatttaggagttaaccaacatagcatttatggtatacacatatatttggctaatcggtggtttagtctatcaaatggctatggaaggattatggctatatatgcatctatctaaatagcactgttacataacagaggttctgttgttagatggatttaggatcaatcaaataatgaatcatttgtattattatttaattgatggaggctttactttaattatgaacaaattttacttgtcacaataaattataaaaggttaataattatcca

SEQ ID NO: 40806 - DNA, 1501 bp, Oryza sativa
agcctcatatttgtaactaaaaatataaacacgtatagatcattccttagcttatttgtgaggaacaataacagacctattataaatagactactaaaaggaagttgatcagtagcatagggaatagcatatagttaacttggttagcatccaatagttactccaacagtaaaatcacttgtcaacccacttagatcacatatactatacaatccatttaaattcatacataaggacaatcttttgtatataggaaactaaggagtctatgacaaacatgaatattagataaatactagttataaatcttgacctcatataattatagttcagctgtaaattaggattgttcattaagggataatctgtaaccataatgtgattaacctaaacaactctaacattcaaagcatggataattattaaccttttataatttattgtgacaagtaaaatttgttcataattaaagtaaagcctccatcaattaaataataatacaaatgattcattatttgattgatcctaaatccatctaacaacagaacctctgttatgtaacagtgctatttagatagatgcatatatagccataatccttccatagccatttgatagactaaaccaccgattagccaaatatatgtgtataccataaatgctatgttggttaactcctaaatagaccacgatgacaatagaaagattaagaaactttagcccttagcatgattggaattcattagcaaacatgaatagtacattttgttgtgcatatttgattgttgtttgaatattggtttttctcgcgtattatagaccttgtgtatcggttagtcgtgaggcaacgtttgcaacttccaggaggtaacggttgatcaagattatatcaagaataaggcctattctgagcaggcaagtcatcactattctttgaacatgttgatcccaattgcgaaattattttgtttacaaataaaattgcatgcaatgatgaacatcctacttgtgattatgccatgccttgattattgtttaccccttattccttcataaccatgtttacgtatgagtccctagtcaattatgacaattgcttagaaatgctattctagaattatgcatactcatatttatcaaatgctatatacttgggcaattacctttgggaaggtaattgagatgcggcatgtcgagacatgagcgccacattgccatgatattgatgacatgatttgtgaaatgagaaataaaactaaacaactgttttcgactggggcggacggaggatttgggtggtatctggaaaaggctagtaccgtccccggtcaattaaggaccgagccatgaagttaagcatgaaacgacccccgtacaaccgcacttctcgtatgggtatagacctagcggattagatagccgagcggaggcagtatccctgcatagatggttcacccctgagtgaggcaggtgcgctaccgtgggacagccgttgaggtag

SEQ ID NO: 40807 - DNA, 307 bp, Oryza sativa
tgtgcgtgcacgcattatgtcaacatgccagattgatgtgatcagtggaggcatggtgctatgagtatatatattggctacatatggtgttttctgcctatgtaagactaattggtgcaatgtccaatttactcacatttagtgcagtatctgtggtttgatcttagtaatacagggaccaaattggttgtatggtcgttcactttgcacaaattggtgtactagataagttcgatagatggcagtccattttccataatagagcatattgctgagctaaaaacaagtcatcttatttcttttcaga

SEQ ID NO: 40808 - DNA, 1121 bp, Oryza sativa
atttatgcatctagatctgcgattacgttaacacatttgaattaattattttattctcattttagataaaatataaaatataacaataactataatttaacatatgaacttcaaatctatcatgcatctaatatctgaagctgtgtcaaattaaccagacctaagtaattaaactgttgcaccagaatgagctctttttaattatccccagaaggaatgattacaaggatcgcggaataaaatgtagttgacctgcaaaaatagcatttaaactatatagatcaaacaactctctcggatattgttgacaacaaaatatttagatttgaccaactttataaaaaaaattaataacatctaaaacactaaattatttttttaaatagcctaatcttaggccctaactcaccctccgtggacgaaccttgcggaggaaaatgtaacgttaaatataatttattaatatgtttgttgaaaatgttgctatatttttgtgcaaacttgataaaaaactgattaggaaaaattaaagcagcttataatacgaaaggaagggagtacgtagaaggcataaggcctggtttagttcccaaatttttttcccaaaacatcacatcaaatctttggatacttgcacggagcattaaatatagattaaaaaaactaattgcacaattaggggggaaatcacgagagaatcttttgagtctaattagttcatgattagccataagtgctacagtaacccacatgtgttaatgactgattaattaggctcaaaagattcgtctccggtttccaggtgagttatgaaattagttttttcattcatgtctgaaatctccttccgacatccagtcaaacatccgatgtgacatctaaaaattttcttttcacgaactaaacaggccctgattaacttgcgtgttgcactatcgatagatgagagcagagaggcagatgtttactagctagggatgggcgcatttgaccttgatgagcagttacactgtatacgcgcccatccctaccaaatcggattccgatttggagttctcctgatcatgacgcattcacgctgaagaaattaaccagctgcaatctaatgacgtaattaaagc

SEQ ID NO: 40809 - DNA, 1501 bp, Oryza sativa
ttggcaattagtccagaacgcaatggagagcaacggcggagggatgagcgctacagggaaagggcacatggtcaccgttcacacagggatcatcaccagagctctcgaggaagcactcttagctctcgtctgcaaggcagaataaagcttcctggaagatctcctgacagagttgatactcgctccgagaaagagcgagatagaagaagactccgggacaggctgtctccagttaggcgcacggaatttcagggtaccaggcatagggaggcaggacaacatgaagagcagacccagcggagatcaagtgaacttgctttaggttccaggaatgcagatggccagcatttgacaaaggatgtgcctgactcacacaacttccctcatcgcaaaaactcgagggactccagtaaggccaatggaagtgttgagcctgaagcatcgcttgattttgagggcccaaagccccttagtgtcatcttacagcggaaaagagaggcagcatgggccaatggcacatctgcctgtagccccaaacaagataaatctgccgaggtctcacacaggcaagcttctctggctgaagctgagaaggaaggtgacaacataattagttctgatgaatacaaaagtggatctggcgatgaagaattcagagacgaaggccacatccctgtggagggccatgggcaatcttcatctcatggtgacaaacttgaggctgaagatattattgaggtggatcccgtggaaaatcaagatgctgataattatgaccagagggagggggagtcctactatgagcctatcgaaggccaggactacaaatccgatgacgagaatgcttatgaagatgatgatgaagagtatgatgacgatgatgattttgctcggaaagtaggggttgttttctcttgagctctgtgggccttctcctggttttgttgcatgcagcaaagctgaaaatgcttgccttagtgaatctatttggataaattcctctggtgctttgtgttttgttcttgaagttcatagtgccaaagcctttatttataaggctgataactgataagtataggtcaggtatgaagcgggggtaggattcataaattaaaagggctttacgtgtaaaaactgctgcactcgttgtgttcagcatatatctgatctatcctgaaactattgtattgtattagtttcctaactaacagacaagatatttctttgataaattttttgcctgatatgggtaatataatcagccccattttggaggggttcttttcttcacgaaagagtaatgtgtgattgtacatatgtggttcctcagttttcctaagattcttaagatggcatcagcctctgaacgagggaaggaactattttatcaggtcaactaatttggccgtctgggactctgtaaaattttgctgcttcattcaaatataatcatcttataatcataacgaactattttatcaggttaacggagtgtgattct

SEQ ID NO: 40810 - DNA, 1501 bp, Oryza sativa
caagtgaacttgctttaggttccaggaatgcagatggccagcatttgacaaaggatgtgcctgactcacacaacttccctcatcgcaaaaactcgagggactccagtaaggccaatggaagtgttgagcctgaagcatcgcttgattttgagggcccaaagccccttagtgtcatcttacagcggaaaagagaggcagcatgggccaatggcacatctgcctgtagccccaaacaagataaatctgccgaggtctcacacaggcaagcttctctggctgaagctgagaaggaaggtgacaacataattagttctgatgaatacaaaagtggatctggcgatgaagaattcagagacgaaggccacatccctgtggagggccatgggcaatcttcatctcatggtgacaaacttgaggctgaagatattattgaggtggatcccgtggaaaatcaagatgctgataattatgaccagagggagggggagtcctactatgagcctatcgaaggccaggactacaaatccgatgacgagaatgcttatgaagatgatgatgaagagtatgatgacgatgatgattttgctcggaaagtaggggttgttttctcttgagctctgtgggccttctcctggttttgttgcatgcagcaaagctgaaaatgcttgccttagtgaatctatttggataaattcctctggtgctttgtgttttgttcttgaagttcatagtgccaaagcctttatttataaggctgataactgataagtataggtcaggtatgaagcgggggtaggattcataaattaaaagggctttacgtgtaaaaactgctgcactcgttgtgttcagcatatatctgatctatcctgaaactattgtattgtattagtttcctaactaacagacaagatatttctttgataaattttttgcctgatatgggtaatataatcagccccattttggaggggttcttttcttcacgaaagagtaatgtgtgattgtacatatgtggttcctcagttttcctaagattcttaagatggcatcagcctctgaacgagggaaggaactattttatcaggtcaactaatttggccgtctgggactctgtaaaattttgctgcttcattcaaatataatcatcttataatcataacgaactattttatcaggttaacggagtgtgattctcaactcacgatcatctctatctctactaattgaaaatgtttttgctagtactttaatatatcatccgtgtatgagtcggtttttaagtttgtttgattttggaaatacacatccgttcagtcgggttttaaattcgtttgcttttaaaaatatcgaaggagtcatataagatatctctttaaaaatctcacatgctaacttgagatgatcaaactcctaattgcaactcatgattttctagaaaaatatatatccaagccgcgaattcctagagtgaatatcatcttaactaataaatcgtata

SEQ ID NO: 40811 - DNA, 923 bp, Oryza sativa
gcgctggcacgcagggcggggtgtggcggtggactggtggttcaccctgaacaccccgcccgtgatcatggttgattcgactgtttgttcaccacgcacacgcagcaaaaataaaaaaataaaataaaatggagccaacgatccagtcaggctagctagggcttccatacctgaatacctgcactgtgtgaagcgaggaatcgcgcgcggtggactccgcggtggtggaggaggaggactgcgagctgttggctccggcggaaggaggggcgcggcggccttcgtcggcgccggcgaagaggtggggattcgattttgttttgggacgaagggtatccgtataaaaagaccttttaccctaacaaaaaaaaaggactcgtctacagttcggattcggaaatatattaagagaattatgtagtgggctcgcaaattcgtgatagattcggagacgaggcccaacaaacttgggagcccatctagtggggagaaggccgcccagcaatacaggggccttctggacatgggccgatctttagctatgttggcttcaaagatcggaataagttcacttagggtccctctatttgtcgcccagtccgattttcgtcccttgaccacgaaaccgggtacaatctgtcccccaacatacgaaaactggacaaaaaaaaggtccctcggcggttttgatagcggttttggctgatatggcgcctacgtggctaatttgacccggccttcatctgacacttcgatccaaaataataataaagtccgtgggacccacatgtcactttcacacaaaataataattaaaaatggtgggacccacatgggccccacatgtcattctcacccctcatcttcttcctcctccctctccatctcccctctctccatctctctcccctcctctctccagc

SEQ ID NO: 40812 - DNA, 778 bp, Oryza sativa
ccaaatcacaaatctctttcaagaacacacacacacaacacccataatcacaccaacgcaggcaagaatcacaggagagaggccctaaaaatccctcctttcccatctccgcatcaagcagaaaccacccaaaaacccaaaaaaaaggggcctttaactgacaagcgtagcaagagcagaatcactcttatcaccttcttgcgaagctggatctcactcacccagggcttgggattaccgagttcttggcgagatctagccggtgtgcaggaaacaaaagcaggagaaattttttgggtttggaggagcgaagcacggctgtgaatgatggtgggagaggagtgaggtggaaaggtggagagacagggtttactacacttttgctgctaaagcaccgggaatttaccactggtaggagtaatagcagctgtcatttagtttttcattttattagtcccaattaagctgcgggtttggatggtgatttttgcggattagcccggttcggtcagtgcctgccttgccggagcggaagctcgccgccgccgccgccgctgctgaccgtcgcagccaccgctgctgattgccacgcgtgcataggcgtcgcggtctccaagttgagatgtgtagggaaataattgcagcagaggtggccaaacgggccgggccaaacgggccgcccggggcacggccgaacctgtagcaggcacggcccggcacggcctgctacagtaacgggccgtgccggcacggcacgagtagccgtgccgtgcttggg

SEQ ID NO: 40813 - DNA, 338 bp, Oryza sativa
aaaaagaaaaagaaaaggaaaaaggattttccctggaagtaacgattgcactttagtgatttttaattggttaaaattatttctagagctctgaaaattccactaaaaatcctgttaatgaatttcgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacaaacctaccccccttaaacggaatctcggccccgagattcggtggagctggtgaagaggtac

SEQ ID NO: 40814 - DNA, 1501 bp, Oryza sativa
tatatatggaggtatatattcaaggatggaagaaaatctcatatatatttggataattttttgctcacataattaatcaagcttaaaccatatatttctattatctaaaatgaatgtaaaaaattaaaagtgaaggacaacaaccggtaaatttacatgcaatgtactttaacactgataatttaattatttaatttgtcatacaaggattgccaaactattgtcgcaataattaattggcgacagcgtataaaaactcgacacagcttgggccagggacatatatgcttggagataaatatagttcaatagttgactaataaaatctatatatctctccgacaaaagagcatgcatatatatatgggcttttatatattatatatgaaaaaaaagcagctgcatcctgaaacttttctccactgtgctcagttattggagatcctaagcttttgaattaattatatttagcatgcaacgtgcagcacgcttgatttctctttgttaggtaaataagcatgagattggtagtgtgtcaatgaagcttaaaagctttggatgatcatcagcaaaaatatgaaaatttctccttaattgatttatataaccaaaagtatacagatgcatgatcggaattcgcatgcagattcagatatttacattctaattaaatttacactccatatatataacacttggcataatttttttccatgaaacatacctcaatcatagctattggttacgattctatagccctttttgtttggacctcctatgagtgctttataagtctaaaagccaaagtctaaacaaactagcaatattttcaattggctttttaaagtcatatataatccataaaccattcttgcacaattgaaccaaaaaactatatttgagaaactatattgacttatatatgtggattagagtataactctacatttgaaataaaatctaaatatccaccggtttataaaaccataaccctataaaagcatcttaaaaatctaagtcaatatgctcaagccgaaaaaaataggggctatatatattccatatgctcacaaatgcctgcagcgcgctagcacgaggcttaattattgaatgatccaggacagcatgagttttcacttttgatcaagagcatcgatgcgaattcgggatcgatatttccacatgggtgcaaaaaaaagatcagactgatattaattgattggaatcaagatgcccaaaacgataagcactctgcacagcaacaaccgaacagatagcacagcatcatatccaatccaaaattcttttcaaaaaaaaaatatccaatccaaaaaagtgcagccacgtcgaccaaacagcagcaaccattacatatttctccattgattgattgctctcactgtacaattggcatctccatggagacactgcagagtcccacaagaacacaactcctagttgtctaggagtataaatggtggccaaggcaagctcacacaag

SEQ ID NO: 40815 - DNA, 1501 bp, Oryza sativa
aacaaaaagggctatagaatcgtaaccaatagctatgattgaggtatgtttcatggaaaaaaattatgccaagtgttatatatatggagtgtaaatttaattagaatgtaaatatctgaatctgcatgcgaattccgatcatgcatctgtatacttttggttatataaatcaattaaggagaaattttcatatttttgctgatgatcatccaaagcttttaagcttcattgacacactaccaatctcatgcttatttacctaacaaagagaaatcaagcgtgctgcacgttgcatgctaaatataattaattcaaaagcttaggatctccaataactgagcacagtggagaaaagtttcaggatgcagctgcttttttttcatatataatatataaaagcccatatatatatgcatgctcttttgtcggagagatatatagattttattagtcaactattgaactatatttatctccaagcatatatgtccctggcccaagctgtgtcgagtttttatacgctgtcgccaattaattattgcgacaatagtttggcaatccttgtatgacaaattaaataattaaattatcagtgttaaagtacattgcatgtaaatttaccggttgttgtccttcacttttaattttttacattcattttagataatagaaatatatggtttaagcttgattaattatgtgagcaaaaaattatccaaatatatatgagattttcttccatccttgaatatatacctccatatatactacttcaaaagaaaaaaaaaataaattgattgaaccgattagaaccagagtcccactccggtgctctttacttattagaaagcaatatgaaccattaatctaatttgattgaaggtttcagatctatttctactaccacatcatttaacggtagagagcaccagggcatataaaagttatatatacctcaattttggacaggaattatatacctctgactaaaaactaaatatttatacatctcccaaagattattgaagtaacacatcaaaaacatatatgtataatgtatgtgaatttgaatcctacactaacttgtgagattagttttgatacatcacttattgaagagcagtctcatcaagtgatgatatgagagatatattcctgtccaaggatgacagagaatctctatatgtaaccagagatttatttaatatattcactgtctgcaagcccactcgacatcaattacaacgaaaaattaaatggcatagtgcacaccagagacaaagctgtacttttccttttgcaagagaaataactgtagcttgtgttggtctatattaaaatgttcggtttctcatatcatgagtggctttaagttttttggatgaactaatattctgttcattaaactaacaatcaaattaacatgcaagtaggacaacacatgtgctaccaccatgtaggaaacaaaactatcaacatatataaaaaaaaccgaagtaga

SEQ ID NO: 40816 - DNA, 901 bp, Oryza sativa
catgccggcgagggggcccgcggcggcgccgccatctccgtcgtcgccatctctctctcacacggtgggggttagagacggtggggcgagcggagaagaagagaaaagaaaggcgcgccggtcatggcggggcggcgcgagggccgccggcgtcggcgacgccgctcggcgcggccacgcgcccgcgagagaagaagagctagggtttccggcggcctgggggtcgggttttggtctcccgatctcccctcccggccgtccgatcgaaaccctagcgatcggacggccgacggcggctcgggccgaaagcggcccaagtggggagcgcgcggcggcggcttctcccgcccaggcccaggttgcggcctgggggagaggagggggcgctcgcccgcgcgcaaggtggccatgggccgaccggcaaaggccggaagaagtccatataaggtcccttcggggccgaaaaatgaataaaagagaacagtagcaatttttattttgtcaattttcatgcaaatttcaatagaattttgaatagttttttgcatgttttacctctgtttaaatttgaaccaacgggagaattttcacagagagagaattacagagattttgctactgttcatatgatttttatatagttttccgctgcaaatagatgtaattgatgaaaattagtgtttctaaaattaaatttcaaaccaacgggagaatttaattttaggaacattaagtatgtgctatgatgttgtaattttctgaccaacgttgttaattacaatattatagttatggttatatgtgttatgtctaattctgcccaacggtgatgtaggcttaatgcataatattttaatgttaattttgttctcaccgcacatgattatttcaggtggctact

SEQ ID NO: 40817 - DNA, 1501 bp, Oryza sativa
agtgacatgcaaagaacgagtggatatccccttgagggattaaaatagtttcccgcaaagaacgtaaacttttttatttcagtcttgaaatttttatttatagcacgtggctcactttgagatataggcttgaatgtttcgggttttcttttctagtccaaaaataaataaaatcatttataacttcggttacccaaaaaaaaattgaataccggtgaaaaggaaatccctagctgagctatttgggagaaggcacaaaagtgaaagttttctctcataaagaactggataagcgaatggtcaattcagttcgagacatcgctattcatcaaaacataaatggaacatcgaattggaacaagaaagtttggattaagtagaagatatacaagaatcatcaacacggtaattgaaaattttggaatatgtatttgaactggaagagaagtggcaagcacaagttatcactgagctgtggaggcacaatgcaactccaagatgatgccaacaactcaaaactcataaggacactggagagggtgccatcgacctcaaggaaaagactaagcttgttgatggggtggtgcggtgaggaaggcaacgcgtgctgaggagcactggcaacggcaacagggcggagaaggtagcggatccggtgcgcatgagagaaagcagatcctgggagaggaggaggtggtggcatctggaagaagaagatggtcgtgatgtggagccttggctgtgggggcatgggcaaagaagaggctggcgtcggtgctgggcggagagcacttaatcggccaacttattttcccttttgcgtgttatgagattattttttttatggtaatgggcataccatgccgaattataatccgagatacaacttctccaagggtgtttttcagtccaactgaaaaatgatataggccagtattttacaccgttttggaccagaaacagacattccaagtaggcctagggttcattcggtttaattactactttactgccttatttaagctttatgctatgctaattgtagctcatgttcgaatgttacttgtccaattccatctaattggttatgtacatgtgccatgtcaaacatttatacatgtttagtggagattaagactaaggagaaaagagctttgtgtccttcattaaataaaggacggttggagataggaggatgattaaggatataagatggaaagtaatttgaatgagagataaattgatgtaacaagtagttcttagaaatccctaaatttataaataaattttaaacgtttggaatgctcatattttggatagaggaaatacttgttttgaatattacttcttacatctatatggtataattaaattaattactttgtaaaggctatggtttttagtttacacattacgacagggaacaactttagtgccggttggagactctcatctatgatgagtccccaactggcacaacaatagggcactgatgagccct

SEQ ID NO: 40818 - DNA, 267 bp, Oryza sativa
gaacatatatacacatgtttaggctttatattatattaataataagaaacatatatacacctcaacgtccttgtttgtaacaagtaagctacgtacaataatccagtcaattaatcaatcaataacaacaaacaatcagcggaaacaacctgtcaatgaaaattaacaccaaaaactaattaactttcatccatccatgcatgtagatctatgtgttgcatgcaatataatccttgatttccttaatctctaacgctttttcgcagt

SEQ ID NO: 40819 - DNA, 1501 bp, Oryza sativa
ctagttgcgcctcggtaatcgtgcactctgtacgagtatcgacggtcgccttcaaacttaaaatctgagaaacatcttgggtaaaacttgggttttacaaaagacttggaaaacccgacacctgggtcggtgcttgcaaactaaatgaatttccaaaatcgcggaccggggaacgtaccgggtgtacggtttcccgctcttgcacttaaggaccgtttccttggaatttcatccgaacataagacaagtgcgaccacatgggtggaatgggacacccctggctgagtaattagctaatcaggggagccttgatgctgagagacaagtggattcgccgaggtggtgtcggggaggacccctgggcttcctggcacagtatggtctgggacctaacctgttgttggtctgggacccctctcgtcagcatatggtgaacctgtgtcggctttcgaaatgccttgtcatgaaagccctaaggtctctagtcgtggccgttctgcacgggctggatgatccgggttagtaattagtaatgtcgtgtgggtaaagtgtaccccctctgcagaggttattaaactgttcgaacagccgtgcccacggtcatgggcggatgtgaggtgattccttgcgtagttttgtttgactactgctttgtgaaatttgctgatgtggtttgggattgatgtttggaaaatctgcggctgatgggatcagccaggcccgggtggccgtttgaaagttgttggccgggtgccaatcctgatcaattcaaaagactgatacattgcacatactccgaccggacgagacgcactgtctcatccgtgtcgtttgagaagcactcacttagttgtttcagaaaagagtttaaataaaattaattgcaaaaacaacagcctttccttgaagcctgcataaaatacttatttcccatggcttgctgagtatccctgtacccacccttgctctatataaataatctcccccagttgctgaagaagatgaagcggaacccgctgacgaggagttcttccaggagcaagtcggccccgatgagttttagggtttcggcctagttcccaagtcgcgcctgtgatgtgtggtccaagtcttggcttccgcttcccttatgtaatgcagttgtgagctcgggatctgtccgcagcccaacatgactgtacccctactctataataaagagacctctgttgctgtgatattctgtcttcctgtgataccagcactgtttcctgggactggtatcgattaacaggttaatttggagcgtcacgggctagtcccgctcggggctagttcggggcgtgacattaatgaatctagatagatatatatgtctagatttattaacatcaatatgaatgtgacaaaagctagaatgacttacattgtgaaatggagggagtataaacttttctataaaagtgtcagggttacgggttaggtataccctttacccttcgatatacgtcgcatatcggta

SEQ ID NO: 40820 - DNA, 615 bp, Oryza sativa
ttcttagttaattaattagtaatcagtgtggtgtgatcatgagttgtcaaggtatcttgtttggtatagctctaactctaacttcagctctagctccagctcgagcttcatctctcctggagtttgagtctagccaaatagtttagctctaatatctaaaataggagtagagctgggtggagttctctcacatgaactaagagaggtggaactgctcgacaactccacttcaaacccaactcctagagttaaatttagaagttggagctctaccaaacagttcatatgggtcatatcagtcgctaatttacacactatgcatgacgcaattaattagcccctgatgcacatggagtaagtaaaataattgttgcaccggacgagctctttttagaattaaatttgaaaatatactgttgatttgtttgtttctcaaaaatattcggaatgcaaatttattagcagaaatataccgtcgatctcgcacaaccattccacgaaagtgacgtggaagtgatgccctgaacggtctcgcgcgaagagagcgcgagaccgcacggtatcgcgtgatcatagcacgataccgtgcggtctcgcacgacgaaaaaacgatac

SEQ ID NO: 40821 - DNA, 184 bp, Oryza sativa
catttttccgtccgaaccaaagtgaaccggcagagatggctatttctgtactagtgattggtcactgctcacactgaccagtgagtcagtgaccatagagggataggtgcagtagctcactcaattgaattcagttgcagctgcaggcctataaattgagctcaccactcactcccatggcagc

SEQ ID NO: 40822 - DNA, 977 bp, Oryza sativa
tagctcgtgaacattcgtatactagacatccccttcactatttatacaaaaatatattgatagtgccgacatatatgaattaaaacatcatcactttaataatagatcacaaaaacattacttggttggttgaaaacaaacaaatacaactagattacgtcacatttaattctagatttgtttttttggatggaggaagtaccaaaaaattgaccgtgcccaccacaggacctgtcgaacaaccaattcgagaggtttaacatgccacaaattgtattaattgcggctgtttgatacgagacttgtaaactttgattgttcaacatggcattaaaattgcgatttcttaccattattgttgcaatttttattaaaagagtactattattttttttaaataaaatcttcatatatggatgtatgcggcgagatggagtcaggtttcttaattaaattcgatgcgcgtgtccacggcctgcaattcaataacagaatctgattcgaattctggaactctcctgatcgagtccagctgacgcactcaaacagacgaaatcaaccagctgcaattatttgatgacgtaattaaatcgaattgagattacgtatatatacttgtatccagaaattaaagcagaagaagttcgaggccgcacttttgttgtgtttgtgtgtgtgcatgatgcatgcatgcacggtcaggtcaagtcttgctctatcagactactgtttgagaacacgctattcctagctggtccatacattttttgttgctaaagcttcaaatggttcatacagctttatgttttaattgacctgcagatcgagtgttatgcacataattatcatgaagacgtcgttttcgtcaggaaaatacactgcattttcctaagcttctgatatgatctcgccttcctctgttcttggaggctaaggtactccaaagttattattagtgtttcttctatcatttcatc

SEQ ID NO: 40823 - DNA, 796 bp, Oryza sativa
ctctatctcccaaccccagagttcgagtatgcgtcaaatggtgtctactcggaggagtagacttcgtccgtgccgtcgagaatgcctgtggagtggtgttgcccgctgctatccaagtaagacttagtttcagtcatccctttaatttccgatgtatttatgtaaaactttttgtttgtaagacgtggatctgtatgtcaatattgtcgtttgtgtaccctggtctggcctgtcctggacaggggttttaatgcacattctggttggaattctattcgggaatttctgggcgtgacaataccctatctatatacacaaagacatgatattactagctagcactaaaaatctctaattaaaagatcttgtccactatgtcaaataggatactcttatgaatcaccggaatatttcaacgggaaatgttctaaagtttcactatcacaagccttagggaattcaaaccgaatacaatgtcttagagtaaagattccgatgaatcgcaacactgtcaacgcaaaaggctattaagtatcattattacacgcgtatagttcaacgcgataacgtctcaaagtatcactattacatgtcttaaggaattgaaatttcggtaacaacttccattgcactactgggtgcaccaagggtacttgcccttccttgccgcttccgaccccgcatcctttgcacgctgcgccctagccaactttcttgcctgatattcggcgcgttcttccttcttgtgtcttgccaacacccttagctccaactcttctctcctctccctctcagt

SEQ ID NO: 40824 - DNA, 836 bp, Oryza sativa
gctagccgtgtaattgcgggggccacctagttgtattaaagcactctacttttcaagccccagatggaacgtactgtttctctaagagaaatcaagtcaaagtcagttagaaatcaagtcaaagtcagttagaagacacgacaacagacctggagtaacgtactactgtactgtactccctccgtctcagaatatagcaacctagaaccggattagacatatcctagtactataaatttagacatgagacatgtccagattcgtagtactagaatacgttccatccggttttagattgctatattttgggagggagtactaaagtcaaagtcaattcaattcttgatcgactcgtcgtgagctttacgtacactaattatttcacacgtgtgccatgccagcttcgttttccagtcgtgttacgttttacaactccacagagttaggaaacaaaattttaatatttgtgacaactgtaaaacaaaattttcataactgtcaatacaaatttgtgatgaatatatcagtagtacataaaccatttctacaaacggtcaaaagcgatctttgcatacggccatcccaaccaaccaaaaggtctgcgaaaatattttttttttcatgtggccaaccgcatgccaaaattccatttttttcacgcggtttcctataccggctgcatacaaaaataaattcggcgagaaaaaataaaaataaaaatagaaaccgggtgaacctaggcccgccaccatcgtcattcggatccgccgcccgccgccatcgtcgttagtgccatcggatccgatggtcccacctccctctgttgtgtcaccagc

SEQ ID NO: 40825 - DNA, 1501 bp, Oryza sativa
tgcaatgcatcctgtgctaatcaaaccctaccaagctattcgagctcgagctcactaggtttgcgaacctcaacctatgcttaagtttggcttgtctgtagcattcgagtcgtgctcaaattaagctgtaacaaatcaaactcaaacagattgacagccctatctgtagctaccacacttgttagaaatgtcctgtcatctttgatgacgggtcacaactaacacccattatagatggattcacttctaatcttctatgactggtatccacatatgcatatatcaaacgtacgggctacttttagatccgtccgttagatattagccatttgaaatcggtaatattgatccatcacaaatgacctgctgtgcgttcacgaatatgtgagtgtttaggaacaaatatggaatttttgtcccgatatgtacttaatttagtctttcacctttgatacatattgataatcaggggtgctattcccttttatttaggataaacaaattagagcacagttgataattggaaatatgaatgaaacattgatcggtattttctttgtcacaattcagcgacaactttattttattatttataacaattggtagcaatatgtgaactatatttagaaaagagcacctgttgtaataaaaaagctaataagcgcgcttctcggatgaatacttcttcggattttacattaaagagcacatgagctgtggttttcaattctcattggatcatcctatatccaggtttctataggctattgtgtgggtgatgctataacgtgaaaaacaatacgggaattcctgatcatagcgcgcggtttccgattttcaatctgaagtttcaattcctatagcgtacgtttctaattgtcccgtactgtttccactagaaattcatcccaatacactataaaaacgattatttttttacaagaagccctttagattgcaaagagaccgtacgtaactggcggcatctgcaaaaactgatcttcattttcgcatatacttcttccgtttcatattataattaaggctttctagcattgtccgtacaaataaatatattaatgaatctagacgtatatatgtgtttagattcattaacatctatatgaatgtaggcaatattacaaattcttataatatgaaatgaagggagtagctctttataagacctgcatgccaaaatcaattttctctttgcatgcgggtctattaaggagcctcatgcaaaaataagcctattttctcatgcggtcctcttaagaggacatatgcgaaaaggggacctcttaagtgatccgcatgaaaaatatcatccctttacatattttttttatctccctccactctcttttccctctcatcatttatttattttttgaactcctctgctctactctcctaattatttactttcctctctctcgaatgctctctctcttctctctctctatccgagtaggagccaacggccgataggggtagg

SEQ ID NO: 40826 - DNA, 1501 bp, Oryza sativa
gctaaccttggacctgcactggagttaagcagatctcctaggccgccgtgttttcacatcaacaagcttttggcacatctagtgggacaaagttttgttattcaaccatgtcgtcactgtctgacattggtaaagaaaatgttatacctgctaaggttgaagatctgtctgaagagcaaaaggcagagatggagcagaagatgcaagaactgaagaaggcatatattaattctttttctatgactcggcaagggaaagttattcaaaagtacaagtgccaaatgccgaagttagaaggagaaggagcatctggtgccaaaggagagcagaaagaagatgataataataaaaaacagttgatgactttataggatcgtcttgatttagctgtgcaccatgctctcatcaaccaatctggaatcttggtcaccacattgtcaaatttgatcaactcagtggttgatgggtcgattgctgagtagaagacaagaggaccagtatatttaccaagtggtgttttttttcccaaatatagagaaatcaagactagtcttgggaaagccgagtgcttcgatcatcttcaccacattctcccaagtgcttttaccaaatcataaggctgtgaaaggctgaaaaaattttatgagataataaagaatatatactcagatacatcgactagatacaccttattaggtgtagccctccgactatatggttagttggacaaactaagtatatagtcaaggaataaataatctaaccaaacaagtggtttttgataattatagtcaaccaagtgacttaatactaatatatagcataggcggtatgaatcctcaaacaacatgatccgagtgatatacctactacttattaaaaagtataatgtgcatagccaaaagccaactgcatctttaaaagtcacatagtaaatgatttaataaaaagcctttatgcagtgagtaaaggaattttctatggttgttcacattgtgcgcatattgccaggacaaatatgtttatgtccctataagacacacaacattgcccccagccaaaaatatatggcatttgtagtgtaaaatccaagtaaaataacactaagaaatgaatttaccaactgcctgaaaatgaccaagatatattattagactacaaccataatattggttttttagaaaaatgcacacataagtggccgaaagcaatgataaactaacatcaatcaattgctttataaaaagcaaacatcgtcttaacaaccatacgtaaagctttacttttgccaccttttaaattgtattgtgccaactactgaaaagttgtgtatcagatatataaaaagatttaaggtatatattagacacttgagcacgcatgtattgccaagagcaaaaatgcttaatccctaaaggtacatgacagaacacaactgaaaatatagtccgtgaactcttgatgggccgtggcccgataattccacggatcgataccctaa

SEQ ID NO: 40827 - DNA, 1501 bp, Oryza sativa
ccataattacgtatgagtccctagtcaattatgacaattgcttagaaatgccattctagaatcatgcatactcatatttatcaaatgctatatgcttggtcaattacctggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggaccgagccataaagttaagcatgaaacgacccccgtacaaccgcacttctcatatgggtatagacctagcggattagatagccgaacggaggcagtatccctgcatagatggttcacccctgagtgaggcaggtgcgctatggtgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgttagaaacatggacgcctagagtgcatgaggatttaagttcatggagcgggtactaccaatgcgaggttatcgaaaagctttgcggtgacgcgtctcatgtgttgggacgagactcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgagggagtcacttcccgagaggagggaaggtggacatcctcagaaaaccatgacgattcaatggcgggaagctatccttgggatcacaatggatggtggatagaaccgtcattgtttaatatgaacactggtattaaaacttgaacagtctatgctaggtcttaggcttgagaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgccggtggcaatggcatgccgctgcttgaattccgctgccttatctatttctgcttttgggatgtattccggaccgctcggtccgatgatttaagactacgcctgcgggcttatgatgtaataattcgtattagacactcgtgtatgtgcacttggtatttcagctatgaattcgtgtgtaccagactacgtgatccagggaaatggtactgtttacacgattgattcc

SEQ ID NO: 40828 - DNA, 1501 bp, Oryza sativa
ggtttagttaggttttatctataatcttgcccccgacctacataaggcaggtaggaggcccctcaagggcataatcatacccaagatcattatatcaaccagttcataccccatgcgttgcagtgggcacactataaaattttctatgtgcataaaattgatgtaaattggtcactgaatcagcatacgaagaaaaggagatttacaatgttgagatagagatgcgcctaaatgttcgtttaaacaagtacaattcaatcaggaaacccaattcaaggtacatggtattctagcgtaccgagctggtcgatttgcttgattgctgtgaagatatgttaggtgtaaaaaacaggattagcctatgattaactgagtaagttcaaaactttataaaaacatcatttgtcatattagcctcttggcaatatgattaacttttttccaagaatttaaggagcgtgtgcagggtgggctggcccaacggaaaaaaaatgatgggaagttggcccaagatatcaacatcgttcatctggaaacatgcagtccaatccaacggctgaaaataaatgatgatgtggcgcaacgtggtgcaaactttatagtaataacttctctagtgggtaccaactatataggaagaagagatacagcacctcatatatacaaatcccttaacatcatgagtatgatattacctctcgataaggtcgtaaacttgtataaatcttttgtcatccaactcacgtactttagttctcatgcgctacacccttttcatattgcggattcctagcatcgacagtaatgttgatccatcacaaaatgacctgctgtgcattactgaatatgtagtattctgtggacccccgtttttataactggaatcaatcgtgtaaacagtaccatttccctggatcacgtagtctggtacacacgaattcatagctgaaataccaagtgcacatacacgagtgtctaatacgaattattacatcataagcccgcaggcgtagtcttaaatcatcggaccgagcggtccggaatacatcccaaaagcagaaatagataaggcagcggaattcaagcagcggcatgccattgccaccggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttctcaagcctaagacctagcatagactgttcaagttttaataccagtgttcatattaaacaatgacggttctatccaccatccattgtgatcccaaggatagcttcccgccattgaatcgtcatggttttctgaggatgtccaccttccctcctctcgggaagtgactc

SEQ ID NO: 40829 - DNA, 174 bp, Oryza sativa
tcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaaaggggt

SEQ ID NO: 40830 - DNA, 562 bp, Oryza sativa
aaggcggaggaaagtggtatcagagccatctcgactgtagggtaagccaagtggataaaacctaaggacatattttataaataaaactatttgcgaaagttcctctttttctccttcccctaatgctatttgcaaaaggtttactcttttcttccttcttcaaatttcaattagtactagttggtcagatttgtgaagaaaaagatatcgtcagttgtttgccgaagctccggaagactgcaggattcgctagcgaagtgtaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacaga

SEQ ID NO: 40831 - DNA, 464 bp, Oryza sativa
cgaaagtgagcataatcggatgaagaactgcaagaagaaggattgtcaccatcccagtatttccaggtggtaaccaaagacagcgcactgagccacttcagatcaccggatcttctgttgtgcatcaagagttcctgccccaagaagatgaacacaatgcagacagcaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatttcgacactgagaaagactccaatggtgatagcaactatggtaccactgatgccaatgttagcaaggattcccaaccaccaattccaactccaagtcaaaatgatcgtccccagatggacagctcagtaaagaagacgttgatt

SEQ ID NO: 40832 - DNA, 1284 bp, Oryza sativa
gagttccggttcgccgccgccgtcgctccggacttcctccccactcggcgtcacctccatcggcttcgccgtgttcccgtcgacctcgtccgcgccttcgcttcgcccgccgaccgccggagctccgtcgtcctcgccgtcccgaaccgcgccgccgccttcttccgcttcggccgccgttcccgtcgtcgccgtcgaccggggtgagccgaagaccgttccgttcgcttcccccttccctcctctctctcgggtgccgctccgccgcgccggtggtcgccggcggtgaccatcggggcgcgggcgcgttcccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgcaaaacgcgtgctcccggtccaccgtggaccgagaggctgacgcgtgggccccactcccgtggacccggtccgcgcgccctctccctcggctgacgcaataaatgcgtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagtcgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgcaatttaattaggtaacattaggtggttttataactttagacttgggaaatattcatatcacctggacactgtggaattgttggattattgtggaattggcttcacaccgccccctctattcaaaatcccctaaaatggttttaggctgggctcggggtgcatggttttgatggtagcacctcggccatataaggaccggt

SEQ ID NO: 40833 - DNA, 772 bp, Oryza sativa
aattttgaacaactgttgtctgtatttgtggcgctaatgtgtagtgtgtgtgaattttgggcagcaaagaggtgagtgggatttgattgactcttgtcaacatgtgcattaatgtcattgtaaactacggaatgtttactctttctttgtgccaatcatttgctggcaagcttgttgtcacgcccagaaatttagcccaaatttccaaactattttgtgtattaaatctctgtccaggaccagccagggtacacaaaacgacaagtaaatatacatatccaaacgtaaataaagcgtaaaatacttacagaagaggcacttagtcctcacactgagatagaatgacagcagcggaaaaggcgatcctagcggggcttcagctctactccacaggcaaaactcaactggggtctgagccttggtcctctaacttcgtcttcagctcagaagcactacacttctgaaaagggggaaccatagcaagactaagtacaaccaccgtactcagcaagccacactaatgatgcagacgtgcaagggcatacaaggacggcttgtggctatttgcataaaggcagttgtaaagcattttattgagcaaaacagtaaaacaatagagtaattaaggtaatattaaatctccactgaacaatgctacaccatgttgaacaggcccaaccattcccacctgaactaataagtgcattgagtcgatttactaggggtgagactaatcacggtgaatctggtcgatctcccataaccgcgggca

SEQ ID NO: 40834 - DNA, 845 bp, Oryza sativa
cgctccccctgagccgctgaccggtggggcccgcttgccggcgccgcgccccctccgtgctggcgtcagccctgggatttattgcgcaataaatgatttaaggtttttcttgtatagtaataaacacagtgaatcttctaaaattcataactaattcatccgagctccgtttaagcccactcaagtctcagtaaatcaagaaaaatgtgtagaatccattaaaaatggttttgttctctgtttcagtagtcttatagcctgtttgcaatgtttgctttgtttgtcgctagattccggttcctccgacgctccggtgtacttcgaaatagtcgccgaggtttctccagcagcagagcaaggcaagtcatgcttgtcatttgaacatgttgatcctatattgcaaatgctctattgttttctttcaaatattgcattgttttataatgttactatgggatgtttacctattgttacagccatgctattttgataccatgctcctttgttagcttgggttataacatgaatagactttggactaggaattgcttagccatgcttagttcaactagttcacaatggggaaaatcacattaatgtttagactgttggttctaatggctttgttggattagtgacaccgctttggtgttggttaattaaaattaaccacatggtgggctgggggtgcatggtttagcaagtcgcacccatggcagttaaggaccggttcgcgggatgccctggaagaacttatcgtacttaccacaagccagcgtgggcaacggctaggcttgtagtgtagctctcctctagtcgacgcatccaggcaagggtgggcgtga

SEQ ID NO: 40835 - DNA, 1501 bp, Oryza sativa
gcggcagcgattggagcggcggtagcggccaggactagcatacgattgaaattttaatgttatggttaatgagattattccatgtatgccacagactaacgactggtattactctctttggttcatattataattcgatttaattatttttccagttaaattgttttatgtttaattaagtttttaataaatatagtagtattttaaaaaaacgaatatgttgttaaaatatattcaaagcaattataatatggagtaaaaggagtactaatttagaaaaaaacgaaggacagaaaagaaaggaaaggaaaagtaaaagcaaacgacgattcagacagacaggctcccttccatgcctccccattgctcctactctcccttgaggccttgacccacccccaggaaaagcaagggaagcatgcccagcaaaatcgaacccacaaaacctcaggaattaccatcgcctagcaaggaatcaacaatccgtggtcaatccatggcagatcaggatgtggccgagccatggggcttgtcggcatggccccccttgacctccctcctcctccgagccatgaggaagcggcgcacctgggcggccctcttcctcgccgtgtacgcctctctgctctgctcgtcgtggcgcctggtggagtccgtgcgcgcctggtactactccgcggccggcggggctggcgccgtcgcggcgtggccggcggctttctacgcgtccgtgatgtacggtgccgtcttcgggctcctgtcgatgggagccgcgttagccgtggcggcgccggccatgctcatcacatggatcaccgtgttggtgctactcgcgttcgccggaaacccgcggaggtcgctggtcgcagaggggcggcgcgccacggccgatatcgcgcggctcgcgctccgcgtcttgctgcgcgagggcaacgcagtcgctgcgctctgcgccgccgccagcttcgcggccctcctcctcggccgccgcgacgacgacccggcggaggggagcggcagctgatgtgacgcttcctgcaaaattgttcaattccatgtttttttctttcagttaatatccgttttggggtttcagtgtttcaccaaccacccctccctcaccatccttttttttttctgtagaggtaaattatggagaaaaaacagattaattaacagtactacataattgctaaattgcaatcacagtgttgatgccgtcttttctttgctttgctttgtgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggca

SEQ ID NO: 40836 - DNA, 1501 bp, Oryza sativa
ccaacaacggcggcataataagtcagccgtgcaggcggaagcaccagtcggcggcagacgaggcgggccggttggtgatgttctgactgatccattcctggagcgtaagagataagcttaaagccatgaatcccttttatgcatgtctggatctggatcctgcagaacaaacatataggatgagtagtatctgatataaatataatactcgagaaaaaatcaagtattttaaaatattgataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactacttaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattacatctcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtcgtattccctcggtggcagcagaagtagccgatgtgggaacgaaacagtccatcaataacaatgaggacaccagtcggcggcgacgaaggcggtcgacggtgaaagcgaagatgcccaccaacgacgacataataggctagccgtgtcggcagagacaccagtcggcggcggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggttggtgaagacgtggacgcccatgaacggtggtgtgaccaaccaaccgtataggcgaggacaccaatcggcggcgacggaggcaggccggtcggtgaagacgttgttgctatcagcggcggtggcaaaggcaagccggcggagtggactcgcggccaattgaccgaatagctgggacgtctcgagtccatgaccagcatagatcacctagcaaagtcgaagattaaatcattcaactcgccgagtgtcgaaacatgaattcggcaataataaaagggggtagcgcacgagatctaaaagtggatggatgcggagacaagggatttagacaggttcaggccctctcgatgagaggtaataccctactcctgtt

SEQ ID NO: 40837 - DNA, 1501 bp, Oryza sativa
cccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgactagatgcacctaataggtgtaacccccgactatgtggttaattgaacaaaccaaacatataatcaaggaataaataatctaaccaaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaacagctataaagaagcttgtatgttgtgaataaagaaatttccatagtattgggcatacgccatgcgcacactgctttaacagatgtgcttaagtccctagaagacacatggttccaccacacctggaaatatatggcatatgtggtataaaatccgagtaaataaactcataaaggattcaccaaccgcctgaaaaatgaccacaatatataatcagcctaagccataatattggtcaataaaaatgcacacttacgtggcgaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtaatatagaccaagcgtagctcatatgaatagcttctgatctgagtgattatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcatcgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcggcagacagatcaactaacaa

SEQ ID NO: 40838 - DNA, 1501 bp, Oryza sativa
ttgggctttctttcaaagccggttcaatataattgatctgttaaaaaaaagcttgttgctgttattgtgactttgaagggaccaggattctgcatccatttgaaagttactgtggagatgccatggatttcgagaagatggctttggggagacgtactattgacaatgagcgaatcatcagtcatgggaagctaatagcttgtcgacggggtacatttggagaggactacatatatttttgatcctgctagggactctaagattatccatgcttttaacaagactgctttggcagcgaagcttaactggggggatgaaattaggagaatcaaaggttccaaaatgaaaaggaaaaggaaattagaagaatcagacgaagtgaagagtaagaacatacggcaaatggaagcagagtaagaacatacggcaaatggaagcatattgatgccttggtaagcatgtacttaaagtgttacttgcttgtatatgtttcgtgtactgggttttgaggtgtgacctggctgaatttaaatgttggtgcaaatctgaccctagaaccctttggaactagaaatttcatacaaatcacatagaaattgcttgttactgtttttacttcctatatgtgatatctagaacatagctggcaacagaatgatattgcttctattgttaacgaaattaagtcatgatacttctccttatgttggtgcaagtttatactactccttgtccaatcgagagcgactggcatccactcactatctaacccatcatatatctctatacataactaatcatctcactctaattagaaataaatacattgctacctttaagtggatgaaacaatcctaaaaattcattaatatatcctaaattatgtgaagacatctatagtatacaagacaatttgttatttaaagttttaaaactcacaaataagatatgctaaatattccaaaaaaataacatatggtatctagagataggaaccaactctattattactacactattttctcataaattcaacactacacggtttcaaacatttttagtttaaaatttatatgttccaagggtagttagcaaaaagatcataaccaatgcccaaacaaattactaacgaaacatgtttaaaatgaagtaaaaaatatttagaaaaatatcaccaacttataaacatttgtaatagaaaatttaagcaatattaaatatacccacgcatgtatgtgggctaccttagtttaatttaattgatatttgtgaggattacatatgggatcatctaagtcaatagaagtgtgccaagatgttaaataatctaaacacactttgtgaagatgttattttctgctactttttaaattccttttttttaattatatgtacgatttgcccatcaaagtataggtttcgcacggccttaaagtgaaggctactcggcctcacggtcatagaatgagaaaggaagaaacatgccgcgcatgtaaccaac

SEQ ID NO: 40839 - DNA, 367 bp, Oryza sativa
ccaaataaacagtacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacctttatatggattttaattgaattatgacgcaataatgaattatttttgaaaaggaaaagaaggattattgcgtcagcgggc

SEQ ID NO: 40840 - DNA, 1501 bp, Oryza sativa
gacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataatcactcagatcagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgcttttcgccacgtaagtgtgcatttttattgaccaatattatggcttaggctgattatatattgtggtcatttttcaggcggttggtgaatcctttatgagtttatttactcggattttataccacatatgccatatatttccaggtgtggtggaaccatgtgtcttctagggacttaagcacatctgttaaagcagtgtgcgcatggcgtatgcccaatactatggaaatttctttattcacaacatacaagcttctttatagctgttttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggttggttagattatttattccttgattatatgtttggtttgttcaattaaccacatagtcgggggttacacctattaggtgcatctagtcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggca

SEQ ID NO: 40841 - DNA, 1322 bp, Oryza sativa
tcccactttatttctgtaaatagatctgtagaaattaaagtcccctaggaaaagccagttctgatgagcatcaatctggatatttttcaaccaggtcacaaaatctgatctttaaggcccattacatggcccatacacacaagtcaaggaccagacttgggaggtaaatctagaagttaattccactgtcacagataaagggttaacttctttgggtgtcccactgaagactcttgaaggccagacaattaaaattccccctgatgcacccatggagggggcaaaagcaaaagagtcaaagcgcttgggggcaaatttcttgatgtcagaaagatcaaagttctcctttttcgtttcttgaagacacaagacctggcaactactctcttcaattttctgtcttaaagacagaagcttattttcaacattcattcctctgatgttccagcacaagacattccaaggtttaaaattactattcattatcacaccattgagagaggggcaaaagaaccaagcctagcacagctaaccgaaaatgaaccaaaagacaatcacaccagtcttgacatatgatgagggatgttaggtcaagatcttccgataggtattgataaacaacgatttgggcggagtcgcgacacaactcgatccggcttctgaacgaacacgctactgagccccgcaatcgtagcaccacgtctcctctggttatcaaccgtgcctaaacccggttgacctcgccgagaaggctaatccctgcatgtgaatcgaagaacacaagcaagaacaagatagattgcaaccaaattgcatatgaatgattaagcactcgaatttggggttccacaaaccgatctagcggcgaaactgttcttgacaggataatccaagcaaaacccaactctaaatgatgacgtctactgaattaatatgattagggatgtcctagggttgccctagggcgcacaccgccttgggctaagcccacgacacaattacaaggcccaaaactcgtgtcagattcggactggatgagatacatggcttgttttgcagattcccggtagctcggtaggaattttgacatgggactaaaaccatctgaaagtagactccataagctttccaacaagtactcatgagcctcgaaattccttatagatcagtggctaggtccgtttgaagttgatgctgtcaggaggcccgaatccgaatccaaaacgtgtagaactttatctcttttcttctatggaccaaaaatgacgtgatgagatggaagtggacttggagaaggtcttgatatggtccccaatcaactt

SEQ ID NO: 40842 - DNA, 1501 bp, Oryza sativa
aacccagaagaggagcccctggaagatgaaggctttggtgtctagctcgtgcctgccgtcaagcgcctgtggtcgtcgccctagtcttccgttgtttctcgtttgtctttgtgtgtgctgggccttcgctgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagcccccttgaccctaggacgagccgtagatcccaagccttagcaatattttcaaaataaaaatcctgtcttatttgtgaaaatcctctagtctctctctgtcctgctgcttcatttatcgtcaaaatctgacctttaaaatgttgcttttctttttgtttttgtttgtagatggccggcagcatcaaccgtggtggtctggacctgactggcttcgttttggagctgcggggcatgtgcgttgtcctggggtatccgcatggagtggactaccagggcaagcagctctcggagcaggagggtgacgatgcagagccccacgctgcttgggaggttactgcagtgatcctcactggctcacccgagaggacttcgttggcagtcaccgcgggtggagattccttctccgccgcttgccagaacgccgcactcctcaccatcggtactcttcaccagcgctacccggacgagttgcagcactcgccctaccgttaccaccctcgtcgcggaggagcccgcgactacgccaccttccgggatgctagctcggaggatgacgctaccatcatgcatctagcgcgcatggtggaggcgtacgacgcggctcgtatcgacttccatcagatggtgcgtcgcgggttggtcgagaacaacatgaagatcctggagctgcgtcaggagaatctgcagctgaagaaggacctagacgcagtggaggcgcagctgcgtcagctcaagatcgcccagggagaggtctgtcgccccaagcgtcgccgcgtctgccgcagccagaagatcaccgctcacaagagtacctccaggcccgagcttgttcgtcagtccctggcgtggacctgtttcgtcgagacccctcgtgccgagcccgcgcccgtggttcctcaggaggatggagcctccggcgttggcagcactgatgctcaccttccgtcctggcctatcgcagctgtagacaagcagttagtaggcttgcgcgtgtgtttttcttgtttgtttttctgctagagtcgtatggggcatggttatgccggtgtgtggtataaatatgtcggagcctgtctttattttatttgcttaagcaacttgaactttaatgaaccaatttaatagcagtaataaattcaagatttatggtagtcgtgggtggttagttttaattgtcagctctctctgtttgctggttctgtgtggggtttttaga

SEQ ID NO: 40843 - DNA, 1501 bp, Oryza sativa
atgatacggaaaggacccacgaaccgaggtgcgagcttccctttcgtctgaaacctgtgtacaccccgcaatggcatgacccgaaggtacacaaaatcgtccactgcgaattcctgattacggcgttggttatctgcataacttttctgccgggactgtgccacctttagattatcccgaatgattctgactttagcttcagcttctctcaggatatcagtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttttaggatctgatttagactctcggtctgtccatctgtctgcaggtgatacgtggtgctgaaatttaatcgggtacccagctcttcttggagcttcttccaaaagtgagaggtgaattggcttcccctatcagatacaattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaagtccatcccaatttcatcccatttccattctggtacttggagaggttggagaagtccggccggtcgttggtgctctgccttgacacgctggcacacatcacacagggccacaaactctgcaatttcccgcttcatactaacccactagtatttctccttcaagtctaagtacatcttcgtactgccagggtggatggaataaggactttcgtgagctacctgaagtatcagctgtttaagttctctgttatctggaacgcatacccgctttccgttccatagggttccgtgttcatcctctgtgaaaccagcagctttatcctgtttcatattcttgaggagtccatgcatgtccggatcattcttctgagcctcgcggatttgatcgagcaaggtaggcttggcttccaacgcagccaagaatccacgaccaactatgcttaggttcaaggcttccatctgttgactaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcttatggtcggtatatatttcacagcgattcccaatgagatagtgccgccagatttttagagcatgaaccactgcggctaattccaagtcatgggtagggtagttgccttcatgcggtcgaagctgacggg

SEQ ID NO: 40844 - DNA, 1501 bp, Oryza sativa
cggctgtacagatctaatctccaaaccaggagctaagcaaattattaccaggtataacatccataattattgtgagaagtgtgagactaatcacgaaaaacattgctcaacccgcccataaccgcgggcacggctattcgaatagttttactctggccagaggtgtaccactgtacccacaagacacagccccacaacatgccaccatgtgcctcagtaccaccacggtacctcggaaaggagctgtgacattacccctcgcataacacaacccaccacagtgcacctttcctggatcataatcaccccctcaaaaccagaggcatggactccccagcgacccctgtgggcttatctccgccacttctcagtctggtgctctgcaatgaaccatgctatacgaaaggtaaagccgttgcccacgctggcttgtggttggcacgattaatgtttcacaatagtagctcgcgaactggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagttatcccaatagtgtgctaatgtttctaagcatggctaagcaattatatctgatatctagttgaaccaatatatataaagttcaactagtccaattataatcacccaaggtatcaaggaataaagtaatcaagaacaaaagggccataacaaagaataggttaattccacccaatgacatttgaaaataaatgcacagttgaaataaatagagaatttaaatataggatcaacatgctcaaaggattgtgtttaggatctgtgtgacttgcattgcaataatcggtcttcaattaatcttcttgaatacttccagcgcactcgcgaaccttcgcaacgacggaaacgacaagctaacacgcaaaacaaagaaaaagactaataaaaaccaaataaacaatacataaaaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttacacaatttttgcaacttgaaccacattaaactgagctaagatgaattagttatgaattttgaaagattaaatcggattaaaacacttatatagattttaattgaattatgacgcaataatgatttatttttgaaaaggaaaagaaggattattgcgtcagcggctagggtttgcggtggaccgggtgcacggcagcggttcacgggaacggacggccgagatcgatcctatccaaaacggacggccgagatcaatcggtccacgaccggctcacgggaacggcgacga

SEQ ID NO: 40845 - DNA, 1501 bp, Oryza sativa
ctcggattcgtttggaaacactcccgcaaacttcgccggcgcatcaatggcggccggatcttccgcggccgagtccccctcatccggccggtctctgcccctcccaacactatacaaacactccccgtgcctccctccaccgtttccgccactcgccggtctctcctccccgtcggattcgagctcgcgccgtccccttctctctccgccgtcgccgccgagctccggtccgccgccgtcgtcgccccggacctcctcccgcttcggcatcgcctccttcggcttcgccacgtcctcgccgacctcgtccactcctccgtttcgcccgccgaccgccggaacaccgccgtcctcgtcaacccgagccgcgccgccgccttcctccgctccggtcgtcgtttccgccgtcctcgtcgacccggggtgagccgtggaccgaccctttcgcttcccccttccctcccctctctcgggcgccgctccgccgcgtcggtggtcgccggcggcgaccatcggggcgcgggcgcgccgcctcccgtcggccgtgccggcgaggtcaccttcgggcgcgccccgtggctgccatgtggggcccggccgtcagccgcccgcgcccgcgggtgcggctgacgcgtgggacccacggcgccggccggcgcaagccgcgtgctcccggtccaccgtggaccgtgaggctgccgcgtgggccccactcccgtggacccggtccgcgcgcccctcccctcggctgacgcaataaatctgattttaaattgaaaatttaaatgaagaaattcgcaaatattcaattaaagagcatataaacgtcaaatgccataacttggccatttgaactcggaattggaccgttcaagtttctaatttttccttaagaagtcaagaacccatttttgtgctttgtttctgcttgttatatggagtttattagagtaaaagccttttcttttccgttggtcgtgtagacgttgcagcttcggaagatccgctcttcgtggaagttgaagccgacgtttgggaaagcgagcaaggcaagtcacatcatctttgaacatattgaatcccggtttgtaaaattatgttgatttaaattattgcattatcgctttatttaaattcccgcgttatcactattttatttagccatgcctacttacctttgttatgaccctattattattgttattgttattattaccttgatcaccctagaataaacaaaaccccaactagtggacactctactcatggtatccctagtatgattttaggtagatgcttcgcttttaactaggcaactttaggtggtttttcaactctagactttgggaatattcatatcacctggacactttgaaatggtttggttattgtggaattggcttcacaccgctccttctattcaaaatccccaaaaatggttttaggctgggctcggggtgcatggttttgatagtagcacctcggccatataaggaccggt

SEQ ID NO: 40846 - DNA, 322 bp, Oryza sativa
ccgcctcgcccgtgccctagcgccgccgccgccgcggattccgccgcattccgccgcccccgcgcgcaataaagagggggagatcactccccgtgattccctctctctttccccccccacttttccctctctctctccctcggattcgtttggaaacactcccgcaaacttcgccggcgcatcaatggcggccggatcttccgcggccgagtccccctcatccggccggtctctgcccctcccaacactatacaaacactccccgtgcctccctccaccgtttccgccactcgccggtctctcctccccgtcggattcgagc

SEQ ID NO: 40847 - DNA, 1501 bp, Oryza sativa
ttggttcaagcataagtgaaagataaaatttccaactattgaaattcttcatgtgattgatcttttatattcattattctcagctgaatttgtgcttgtgaacaccatccatgtttagggaaccttatacatctaggtaattgctttatgtgagatgattaagatgaaaggactccttgtaactttgttgtgactcttgggaatttgttttcaaaaataaactgttttaaaagctctatcctccaattgactttaccttatacctaccaaggccatatgcaagcggcggggaaggaatctccacccgcggtgactgccagcgaagtccgctcgggagagccagcgaggatcactgcagtgacctcccaaccagcgtggggctctgcgtcgtcaccctcctgctccggaagcggcctggcctggtagtccactccatgtggataccccaggacaacgcacataccccgcagctccaagacgaagccagtcatgtccaaaccacgacgggtgacgctgccggccatctacaaacaaaaacaaaaaggaaaacaacattttaaagatcagattttggcgataaatgaagcagcaagacagagagagactagacagttttcacaaataacaaagaatttttatttcgaaaatactgctaaggcttgggatctaaggctagtcctagggtcaagggggctctgataccaacttgtcacgaccggaactaacccaacgggcgttccttacgtgcgtgcattaatccttgtcccaggaggcaaggtacaccaaaagttgatacaattcagagtttaacaagcggacgcgtaaatagttaacttattacatgggcagcgaaggcccagcacacacagagacaaacgagaaacagcggaagactagggcgacgaccacaggcgcttgacggcaggcacgagctagacaccgaagccttcatcctccaggaactcctcttctggggtttgggaaaaattgggcaagactgagtacaaccaccgtactcaacaagacacacccagaaatgcagaataaatgcaagggagtacaaaggagttatactataaagggttagggttgcagtaaacagcatttaaagatatttagttgctcaaagctattttgtaaacacgattctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgattagaggtgtacatctttacccacaagacacatcttcctcacgtgcaaccacgtgccacataccaccacggtatacagacggaagacgtgacatagtttccaacc

SEQ ID NO: 40848 - DNA, 1501 bp, Oryza sativa; identical to SEQ ID NO: 40618

SEQ ID NO: 40849 - DNA, 1156 bp, Oryza sativa
ctaggagtatgactaatgatcttcttgagtccatatttttggctttgcaatatatatgatgtaggcatgtcaccagtttatccctaccaagcttcacatatcagccttagaataggggtaaattcttgcacactttgcgttggtgaggatccaaatgaaaatatacatctttgagagataagagagaaagtcaaatatgaggaaaagagatagtttgcgaaaattcataaaaatcccatgagtttgacagagaagcaagaaggactgaaatcaagatcgttccatcccaaaaatccttcttttatttattaggagagggcatgattacattttttttaacattatgctcatgcttgatggagcataaattctttttttttcataaccatgcctttccctcctttctttttttttctttcaaaaggatttttctttttttaggagaagaaagcacatgaaagcatggagaatttattttggtggtaatatgcatatggaatggaatattgcttagctcccagtgtaggagtttagcatgtgcatatatgtgggtgtatgatcttgatcatagagcatgagaagtatctacacaagtcataagagtttgacaaagttcaatggaaagtcaagcaaccaaaatgtatatagtttaatcatgatagcatatttttggctctggtaggaatttatatcaaatgaggaactttcaattttatcattttgaaaacaaatcatcggaatttaagtcaaactagtatcaggatcatagctactcttatttactatctcatatctcacaatagcttggacttaaatcagcaagtgcagcccatttaccttaggttcccggataattattggctacttatattcaatctttgagagagcacttaccaagaacccatatataagagatataaaacagagcaacaattcatcatttcaacaaagagaactagctagtcttacctagcatgactcaaacctatcctatctttttggtattttctattttgcaaatttttatgttttttttgagttttataagatgcaattggaaagcaagtatgcaattggaaagggaaatatgcaatgggatacaagttaccttagtggggggagagatgtctccctccaagcttgccttttgctcagg

SEQ ID NO: 40850 - DNA, 1501 bp, Oryza sativa
tattctaactctacccttgctatcctagagaagtattcctgtcaaactcttctcaaccatagagcaaactctttttgagttgtctgctcctcgggtcgaattctatgagccacctccttcatcggagcacatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagataagaaactgtgtggtggaaattgttcccgttctctcttcaagagagagcaaagcaatggtacacctctaccgttggatgtgtaaacggtagttgggaaaagttgcgagatagattctgtcttgccttcttcccaattacttgtattaccgccctaccagtagaaattctcagttttaagcagatcaaaaacgaatcaattggtgcagcctggtccagattcactaatttagtacagtccgaaccaaccctgtccttacccgagtatgtgttactgcaacatttccatacgggtttggataaggagtccgcattctatctggacataaccgctggaggatcgttcatgcacaaaacgccgtcggaaggaagaataattttggatcgcattctagaaaatacttccgtcatgacgaaatccaatgaacccagccggaggcatccgtgtccaagatagaggaacctctaatgatcgagccactcgctgaaccatccacttctgctagctcgattgatgagaaggttccagagcagccgaccgtcgagaatgaagaaattcagactccggatcgtgccgcaattatgttcagggacggctttgacgaagactacggcaataccttgaactattttagcaagaggaaaccactcgttccttttcgacctcccaatcctatggaactcgagttcctacgacaaactgtctgggacttaacatccataatgagcgatgaatggctaagggaggcagagctttcatccgaactaattcagataaataccgctccccgaatcattctttgccatttggaagggaacgacatcggtattctctacagtccaactgtcggggccaatctagtttctgagtcttttccattcgcgtatttaagcgataaggcagtgaccccaactgacaaattcttcaaacatccaaacggaaatatcattgaaggatttgggattgtacaagatatgcctgtctactttgaagactgggaggtgatcttggatttccacatctttgaaattcaagatttcgacatcctaatcgggctgcccattgtgcaacttctcattaacacacctcgattagaaatcctcaaaataacattgggagggaatgaattttcagttccattctcatgagcaaggatcgccttgaccgattccctcccagaaattgagtctgtggaggaggttattgcagttctccctcatgagt

SEQ ID NO: 40851 - DNA, 647 bp, Oryza sativa
tgataaaaaataaatatatatatatatttttgacaactttacaaaaagtaacatggtttaaaatgaaattaatctgaaccacccttcgatcttcgggggtactctcctcatcacataagatagcaacgtcgaactacgaatcttcttagtcccatccgggacggagggagtagtgcgcagtactgttaaacgccgttaaaagcttccagctctgaacaacagatatgataactgacgcggcgattacttgtgccactcctttcccctacatccactacacgtacgtacgtatacatggacacgtggcccgtctccaacccggtcggcccccgcctcgtccaaccaaaaaccgcgcacctgggaagggtccccccacgcatcacgcagccaagtgccagccgcccactctgccaccaccatccacccacgatctctctctcctctatatctcacgcggtctgcacggtcacactcactctcggtctcactccctggagctggagcgtattaaaacccttctccgtccattcgatcctgccacttcctttctctcgccacgatctcctccatctctctctctcttcctcctcgccggccgagtcagctatctcgccgccgcctgagtacgtacgtccgtctcggtatgg

SEQ ID NO: 40852 - DNA, 389 bp, Oryza sativa
aataaattcaaacttaactttgttagaaatccttaaggttcatcctatagtcaaacatatgctctgataccagttctgtcgggtcccaaaactaatgacttggatccgaccatgattaatgtatcaagccctggattagtaaataattcatacatataatacagctggttcttcattgcataggtaaagtttacaatacttgggatttacaaagctgattgtctaactaattatacatagggttactattatacagcggaagtctaataaagtttgactaggaaggaacaaactctgagggttttctaaattatcgaagtcatcatagtagtagtcataagggtcctcctcttgacccagatctaaaaaagggtgaaattgagcaagga

SEQ ID NO: 40853 - DNA, 383 bp, Oryza sativa
tcaatgataatatctattatattattaagacagctcgaaaagaagacaccacgttcaccgtggaggctagaaattcccacgttaatcgaagaaaatataattatttacaccgttggattgtaagaggcatagatttcaatgtctgagatttaagacaaacttggcatgttaattaagagatacggagtaccgtacgcgtgtagaattagaatcaatctctagctaggacctttacatgcaaacggactcaaaagagttttgtccgatttcctaaaccaattaaccagagttagagatgaattaggctataatacacatatataaataaagcagcgggcaacgaaccactatagaacagtaatttggatgcgtttttgttgata

SEQ ID NO: 40854 - DNA, 245 bp, Oryza sativa
tcccctctccctttccccccatttttccctttctctctcgcgttcaaacgggcggttttgctcccgcaaatctcgccggcgccattgttggcggccggacctcccgcgcttattctttccctgccggccgatttctcccccttccaccctatttaaaccctcctcgcacctcctccgtccgtttccgcctctcgccggaatcgagctcgcgccgtcgctctctctctccgccgtcgccgccgagc

SEQ ID NO: 40855 - DNA, 627 bp, Oryza sativa
aggtgatgagaatattcccaaagtctagagttgtaaaaccacctaatgttgcccaattaagcggcgaagcatctacctaaaatcatactagtggtaccatgagtagagtgtccactagttggggttttgtttaatctagggtgaacaaggtaataatatcaataacaataataataaggtcataacaaaggtaaataggcatggctaaataaaacagtgataacgcgggaatttaagtaaagcgataatgcaataatttaaatcaacataattttataaactgggattcaatatgttcaaggatgatgtgacttgccatgctcgctttcccaaacgtcggcttcaacttccacaaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattctgagttcaaatggccaagttatggccatttgaagtttatatgctctttaaataaatatttgcgaatttcttcttttaaaatttaattttaaaagggtttattgcgtcagccgaggggagg

SEQ ID NO: 40856 - DNA, 454 bp, Oryza sativa
tacagtagctcatcatcttagaagtagcttccatcgtgaatgcccttatgcagttttcccgtccaatttctacactgaggtagtatatatagtaggggcaatttgcagggaaaatgatggaagacattgactagaaataaaacagattgttcttttttttttccatcaatagatgaatcacaaaagttggcatggtatgaaaaagtagagaaaaattaagcctctcattgtatgcttctcttatttgccgaatccaaaatttaaattttaaaacttaattttagagttatttataagtttctttgttcatactggcttttaaattgtgaattatttttgttagtttgttaattttttaaggacttatcaacccgtaactcagaccaatcaaaacctaataagtaatccgaaatctcttcaagtttactccttcgggagtccaataagaccggca

SEQ ID NO: 40857 - DNA, 1501 bp, Oryza sativa
gaatcgctgtcgaggctaggagggttttagtttagatgatttgcacatatatatagggcctgtttggcacagttccagctccagcttagctaaacaattttagctccacctaaaatgggagcgaagctgggtggaacgctctcacaaaatgaattaaagaagtgcagctgggtttaggcagctctacaacttcactccagactcaaccgttggagctaaatttaggagttgagctctaacaaacagaccatagtttcctcggttatgggccttatggtgggctttcatctttcttgggctcctcctgatcctgaacgggccaagccgtcttctgccaaaaccacgacacaaaatcatatgggccgatccggaaatggtccaagctaagtcggtgtcattttttttttttgcggggagctaagtcggtgtcattgtggcccacaaatctgcaatggatcgacccatacacacctctagcagcagcagcccctagccccttcctcacggtcgctgtagcgccgccgccatcggtgcggcatcatcggctcgaggagcaagagcggacaagttgtttgaagcctcatggacgtgtcgctctcctccgcctctaccccagtctccttcggcgagaggtggtcaccaaagcattcggctaggttatggcaataatcttccttgtcttacgagtcgtatgatgattcttgcccattgctatattttgttttgtgatttactgaactacctaaatttggatactgtttttgcagtctttcgttaaaaaaagaaagtagtattcgttatatttagcctctctctcttaaaagacttgttgttcttcctaattcagtataattcctatagagtacataaccttctgcatcagtacatgtaaagccttctattagatgtgaattcactctcctaatagtatccctcaacatctgtggcatcatcaattagtagcacatgtttcttacttatggaggcttgaagctgctcaacagcaaaaatcggactgtgagattctctatggagtacttcctccatttcatattataagactttctagcattgcccacattcatatatatgttaatgaatctagacatatatgtatgcctagattcattaacatctatatgaatgtgggcaatgctagaaagccttataacctgaaacggatgtagtaattcttaaggaacgggactattattttgattggtgctatctgatcgccatgtgtttcccatgaactacataggtgaaagtgcattaatccccctagtgggttttggtgattaatgataaatgtggttaagggactaatgagtttattgagctactctcaggtgcattagtccaaggtgtggaagataagatgcttggacaccccccaaaaaagtataaaatcaaagcgaaccggaactcgaggagtgcataggatagtatatttattgcaatcgagttttaggaaaaaccgtactattaagaggggttccat

SEQ ID NO: 40858 - DNA, 1501 bp, Oryza sativa
attctccgaaccacattcgaatttttcttgtacgtattttagtgtttgccaatttcttttcgaattttaattaattctattattccttttagaaaatgatttttatttcgggatgaatttatcaggacgtgacaatctccaaagacaatattttcacgacttccaccttcctcatcaagacttgtaaacatactcctctctcccgtcatatgattggtgcagccactgtccacaacccaacttgaaccaccggaggagtacgcctacaaaaaaaatcaagcttgggatttaggaacccaaacttgtctaagtttgggtcccttgatgttagttaccaaagcctttggcacccacacacaagtgcggtactcatcattgtaattcccattaaaataagcaaccaccttgccctctgaatttttggaaattacatatgaatcatagtaaagaccctctggccggaacttcctggtattatacccggaacttctggtcatccccttcggcctatcagaagcccggaacttcctgtcaaaatgtccggaacttcctgtcttacagggcaggaacttccggtcattttgtctggaactttcggttgtctgaccaatgaaggaatgagtcacctcacttgcttgtggagctttaccttctctcacaaacatcaagaattctttcccatttaccatcacatggttagacacaggacttccatgtcgcgaccgagaaattttgcattttcccgaacgctagtgtattaattcccgtcccaggaaaagccggggtacaccaaacaaacatgatacaaaaggcacatctttattatatcgataatatttacattattacaaaggcacttcaagtctgacaataaaaaataaacagcagcggactagcgggcctacggctccatcatcacaggcgctcaactggggtataagctaggactccacctaagacttcttctccaaagcttctctattgaaggggggaaacattgagcaagaatgagtacaaccacagtactcagcaagccacaccagaagatgcatgattaatgcaagggggtacaaggggataataatagggattaagttttgcagtaaacaacatttaaaagacttttagttgctcagggccattttgtaaacacgatcctagaactacacaatgttattaaataaggccgtgaacccacacgaacctgccttaacccaaggcctacgatgattcagaccgaactggcaaccaaacccaggtcccagctcgtcccaagccaacccaggccaaccattccaaattttagttgttaagcaggttttaagaatttaaaacactaacttgggtacattgctaggcttgcccataaccgagggcgcggctattcgaatagatttactctgatcagaggtgtacatctttacccacaagacacatcttcctcacgtgtaaccacgtgccacataccaccacggcatacggacgaaagacgtgatatagt

SEQ ID NO: 40859 - DNA, 1501 bp, Oryza sativa
atgatagtcaacctcctctgggtaaacattgtgtgctttcttttggtaatgtaggtgctttaggcatagacctactccctccgtcgcaaaaaaaaaaggcaaacctttggtttacgtgtccaacgtttcaccgtttgttttatttgaaaaaatatgaaaaaaaatttaaaaaggtaagtcacgcataaagtattaatcatgctttatcatctaacaacaatgaaaatattaatcataaaaaaattttatataagacgaacggtcaaacgttggacacgcaaacctaaggttcgccttttttttttttaggacggaggaagtatgtagggatctttgttcagcagttgacgaatgtgcccttcttgctcttatgccaggtggtatatctgcagaaacatattcataccttctagaccctctagattgcatatcatattccgaaagaaattgtaattttcaagatacatgaggatatctcaagatttactgactaaacttaaataacttttcgcacttcaatagtggtatattgcttcatagtataattttttatacaaagatttatgactcgatatgtaattttcttttggtacttaaaaattattattgccatggtttattataaatttaatactgtgaccaataatgtgcccgcgcgcgatacgtggtccgggcatcacctagtgtatcgatgcggctgtcttgcctagccatctaatgcattctcatctagctgcattgccttgcctgacaccaatcaatgggaaacacttagatgctggctcaaaattttacaccctgtcacatcgaacgtttaaacatgtttaaacacctgtatgaagtattaaatataagcttaaaaaataattaatggcatagttgcgcctactttgcgaaaaaaatcttttaagcgtaattgcttcatgatttgacaatggggggctacagtaaacatgtactaatgatggtttaattaggcttaataaatttatctccgggtttcttaactgagagggtaattagttttttattagtgcccgaactcctcatgggacagcgtatataataatgtgatgtgacacgccaaaactttacacgcctgatctagatgcaatttctctgttcgtctaaaattgcaatggagaagttgggataatgttgcaaattgggcgtccgggaggagaaaaaaatcggacgctccccccttgacacgcgtgtcgtcctgcacacctgccatgtgtccccatcacacacgccattacaacaaatcacccacatattttagaaaccctctattaagagaatccgtttcatttttttccaaaaaaatgtttcacctagtgtactcacaatgtttcactatgtatagatctaatgttgcagtgaatcgaaacatttttttacaacaaatcacctacatattatggaaaccctctattaagggaatttgtttcattttttgttctaccaaaaatattttacctagtgtacttataatatt

SEQ ID NO: 40860 - DNA, 808 bp, Oryza sativa
gtgtcttgagggtaaagatgtacacctctgatcagagtataatctattcgaatagccgcgccctcggttatgggcaagccaagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggtcttgattaaaaatattgtatagctctggaatcgtgtttacaaaatagctttgtgcaactaagtgtcttttaatgctgtttactgcaaaccctaaccctttatattataacccccttgtactcccttgcatttatcctgcacttgtgggtgtgtcttgttgagtacagtggttgtactcagtcttgctcaatttttcccaaacccagaagaggagcccctggaacatgaaggctttggtgtctagctcgtgcctgccgtcaagcgcctgtggtcgtcgccctagtcttccgctgtttcccgtttgtttttgtgtgtgctgggccttcgccgcccatgtaataaattaactatttacgcttccgcttgataaactttgaaatgtatcaacttttggtgtaccttgcctcctgggacaaggaataatacacgcatgtaaggaacgcccgtcgggttaattccggtcgtgacatgggccccacatgttagtgggtccaactatgtatttttttgtgaatgacatatgggtctcacagatatttttttaattctaatcccac

SEQ ID NO: 40861 - DNA, 1501 bp, Oryza sativa
caaggattacatgacgtaataatttaaaaatgatatggtgaatagtaggaattcattagataataagaactatgaaatgataaaaacttttagtatcaggaatacatgcacaataatagacaatacatggagtatccagttcagatattatatccatgattggagtcaaagaatttaacagagtgaagagttggtgataatcaaataaaatgaatttccagaaacatgttctccctttttttttcttttaacctgaagaaacatgatttctgttcggaaataaactgccattcacaatacacctgacaatctgttcaggaggaaaaatatattttagtagggtatttgtagaatgaatctacatgtcatatcataatacagcactaaaacatgtataggtatagctagtaatctaaaggtgtaaattaccaaagggctaaaatatgtaggaaagactcaccaaaggacacgtgaaccgaaagcatgataaaacaaagcgagtacagtaaagttggcaaacaccctgcggatgcatgatttggtagaaacagaatattacattagacaggatgggtatgttgcctgacttgcctaatatctctgaaatgtattttcagcaagcaatcaagtaaataaaatcatattttgttcaaaatgacaccatatacagcttgctaccatattcatgaagccttgatttcagaattcagtaagtaataacacaacaatggtttagcaagaaaaaaatattaccatgcatgctagaagagaccatatggacatgaaatatgattttactgctaaattatggtttgtcttcatggagctgcacagatcaatataatttgttaacatataaaatgaatcattttagtgtatggggcacgtagagtaagacttcaacttctagactggatttcgcaggcaggaaagaatatgcatctctcgaacaacacaacacccatacgcatctcttgcccgtgtcatataaagaaggaaaaatcaaaactacaaatccatgttagggagcaggttttcagtacgtagaaacataagctatcatatatatttttttacagaggagaagaagcataattacctgagaacctggcaagtccaataaaaaatccaacaatacgacgatctgcagggctgtaaaacagagaggatccctcaattattttaaataacccctaataaaaagttaacaatttcaaatcgagcagagcagtaaaaaaacataagcattagcctagaagttaattaccagaatacttgcttagtcaaattataaattgtacgaacatggtgatctgcagggctggaaaagaaaagaggatcacataattaatgtaaagaaccccaaataaaaaatgcatatatttctgatctaaaccatggcgacacaataaaaagtgtctccgtgtgcgctcgccggtgtccgtaggcctctccttacatgtgtcctcgacgaaatcgctggctgccgaagttctgaccg

SEQ ID NO: 40862 - DNA, 860 bp, Oryza sativa
gaggatgacagaatgatgaatgagaagaaagtcccaccttatatctttatgtctccacttcttatagatattatacaacccctctgaaatacggatgtagcacaggggttgcataatagtactaatgaatcgaagaagatacataggaccaaatgatctgaataagctgctgccatacagcaagcattttgacttttagcaagctgacatgaaaatcccaacagtgtcagcctaacaatttcggtataataataagctcgagcttaaacttaacctaaccttctctttgtagccctgagacaatcaagagagaggaagggataatttaaaaattgtgggtttcataagcatattaacaaacaaaaacctaaacttcgattaaatacgtactccagtaaagaaaacgggacgtgcaccaattttcactaggccacctcctttcaagcatcggaatatgacagttttcctgtaaaaattacacataaacctggaataaagtagcttgtatttcattatttatttttgttgccagggagcaaagcatgtcggcttgctgcaatgaagtactccctccatcctataaagactccatttttcagtttttatacaacgtttgactctttattttatttaaaatttttctatgattagtatttttatttttatttttattagatgataaaacatgaataataatttatgtgtgactattttttttaaaaaaatttaaataagacggatgatcaaacgttggacacagaaaataataataaaaaaagacttcgttggacggagggaatagcagtttttggatcatccttgttcaaaaaattaccctcacacgcttaacaccgcaatta

SEQ ID NO: 40863 - DNA, 182 bp, Oryza sativa
aggaaggcacaatagacttattcttattcagccagagagtggcccacaatctatggcccaggcccaggtcctcttctaactcttcccccacaagccacacaggaagattttttcacggtgcggcggcggggccaaaccccagatagaaccctgcgccgcgtggtgcctagccccgggccgcc

SEQ ID NO: 40864 - DNA, 1501 bp, Oryza sativa
gctgatatacgtggaattttgctcatttgatcatcaaccagcatgcctcttgttctctaaactgttaacgtggaatgttacaactcgctgatatttttagtgtactgtatagtatacattatatatgatctccggaggtttcgttggatttataccttcagatttcagagcaaggttaactagtacatcaggctgagtgtatggatgatacaccagcgaacaaactttgatggatgagcaaggtactttaagcgttaggcagatggactgtattgcacatcatatgctactatttcacattcagcacatgacatactccagaatcttaatatatctcagtttaagtttcagattgtaaatatgcacaacatatagatgaaaaactcactacattctgactatcatagagttgagaagtaactttcttgcaggtataattagaacacatgatcctgatcggcatttgaatcaggagcacttcagaattcaaatctgaatatttcagattcacattctaaagataaacatgaccaaaacttatacatgatgatctcccccaatgtagttggttcttaattgtaagtgctagtagtcaaacctgtttgtatgtgctagtagtcaaaccaatggatgcactccatatttcttaagtagttcgattgtcgcttgattaggtaggaatattctaactaatataacgtctttcatttcaagtagaaataaacaataagatgaacgtttatgaactgaagagagaataggaactaggataatagtccaacaaaaattctaaatactattgattgtaactttcccttggaagaaagtacggctcatttcccttggaagaaagtacggctcatttgtaagagcaggtacaatagcaggctataagccagctgcaaacatattttaaagagataaataaggagagagaagggcagcgggctacagatttgtagccagctgtagcacggactccaagacgcagtgtgtgtatgataggtgggaccatatattaatagtgtagtatgtaactattgtattaatgagctattagattagctatagattaattggagctagtagttagctacactgttaaacttgctctaagtttacggtagttcacacagatcaatggagtagttatgtaaatgacaggctaatgcttcagtggctactggctagattgattaatcaaagatcccatttcccttgaagaaagtacggctcatttgtaagtttatggtagttcacacagatcaatagttatgtaaatgacaggcttgttttcagtgataagatactagtgcgttcgttccagtgacattgggtgagaaaacatctcgttttccgcatgcacgtttcctaaactactaaacagtgcatttttttgcaaaaaaaaaattctataggaaagttgctttaaaaaatcatatttgtcagggttacggataaaatatactctctattcttgaatatacgttgtatactgata

SEQ ID NO: 40865 - DNA, 513 bp, Oryza sativa
atcaatagtagagataaacttttggtctttagatgtgtagacttgagatgtataaaatttggtgcgtaaatctatatctacatctatatacctaactatacctaactaaaaaataagtaaagcttaactatacctaactaaaaaataaagcttccggtagggttttctcgtccgtcaattttttttcacacgcggtatttttctcacgcacggttttttatccgattccggtttttttacgtgcgttttttgcccagtttttttgtccgattgttttttagtgggcccggttttttaattaaaaaataagtaaggcttccagtagggttttttcgtccgtcaattttttttcacacgcgcggtttttttatccgattccggtttttttacgtgcggtttttgcccggttttttgtccgattgttttttggtgggcccagttttcccccaccgcgtccgattttttttgggcccggttttttatatacaaaagaaaaaaaaccacaggaatcca

SEQ ID NO: 40866 - DNA, 463 bp, Oryza sativa
ttaatattttttagtactttaacgaaaaatcaatggaattgacttaaaaggaacattcgagttcatgacacaaggaaatcatattttcttatacttcgattttccatgcattgtactcgtgagagttgatggaacatctgaatcataaaaattgatgtcattatttttttgcgaaaagtccgaattacacctctaaactattgggtgagtacgaagtacccctaaacccaaaaaccatatattttttaccctcaactattaataccggaaattacccccccccccactcaagccgaagtggttttgatcctacgtgtcagtccaatcagtaatttctttttaaaaaaaatcagcgggccccacctattagtctctcaccctctctatctctttctcctcccctctcactctctttccctaatcccctctcttcttattcctcccctcacctccatctctctcg

SEQ ID NO: 40867 - DNA, 241 bp, Oryza sativa
tgggtgagtacgacttacccctctagacctaaaaaccaaacatctttcacccttaactatcaataccagataaaaaaccaccacgggtagctttataagcgattttgatcctacgtggcagtccagtcaacaattcttctattaaaaagttgatagggcccacctttcagatctctctcctcattatctatttcgctcctcattatctatttcgcctctcagacccctctctcttgtcaga

SEQ ID NO: 40868 - DNA, 1501 bp, Oryza sativa
tatcctacaatatgcatccgagcagaagggctgtagtggaacacatgttcagtctcatatagtcgtctcagcacttgaatttccatcaatagaagtacaaatactgttcgccagacatgatacttgtgtcccatggtgcgcgagtgaacacgaccaaaagagaatgaatttgagcctacaagatggctggcaattgtggaataacttgatgactcaggcaataatggtgtcattttcatatatgcatagaaccatattgccagaagcaaaattgttgttgccagcactccgaccacataaaaatgcatgaagtatttttgtggaacagtgaacttctgcagattagaaaagatcgatctgagattatcagcattatacagaagttgaatatgagaagaactacaaatttggtgcgtgttctcatgtgcaattgatcatcaattggatgaaaaatagctcaagaaaagccgatgaggaatcaattcgatcctactatataatgttagtttttactcacaaaactggcttggtatgtatttttcgtatagctaagttagcataactaaatctccaagttgacaagaaaagctggctgtatatcctgtagacaaacaccaattaaaaaaattgtttaagtccagaactgtggttcccaaacatttaagaactaatttcttccaaatgtatcatcttctcacaatcaatcgataatatttcagatttgcatcaactaaacactacaaaacagtagctagctactttggccttaaacaatccacggttatatctttttcaaaccaacccaaacctatatttgctttgaacaagtttcgcttaacttatcaaggtctaaccaagcttcgtttaccaaggaatcatactaactccatgggattgtcgaatgataacagaaaaggcgaagcagcaaataggtgctgcggcaccttgaaccgatcttaccgccttagaagaggaggaaccagaggatgaggcgggggagggcctcacggtcttgccgcgggaggagaaggccgagagcagccggcgaaggaggtgaccaccagcagctgcggggattggcagcgcggcgacaatgatggggagtgtagtggcgatccaggcgaggcacagcagaggctggagggcaggccagccctcggtctccatggaaggcagcgccgcaatggcagctccaggaatttcttgttgggtgttcctacttcatgttccaaaatttaataacgccattagcccacaaaatttgctcggattatgacataataaagcaattgtatctcatagcatcacaaatcgactaaaatcaacacctaaagtttgaaagttgcaaagatataaatataaataattcaaatattaaagatcttacatagataaaataagtacaacacaatttctttaatctgcaccacaatctactcttctaagattaacattgccgattcactacaatttgcatcattatccatagttccgtaccgat

SEQ ID NO: 40869 - DNA, 359 bp, Oryza sativa
aagttaataacatcaaaatctaagatatatgtttcccctcgagaaccttccaaatcttagggttctattttattcattacatgactgtagtttaccacacctttttttttattttcattatgtgaaagtaccacctctaatagattacctttatatgttctaataatttttgtaaccctagaggttccttaaagccttgttcatcatcaaacttttcttttcatttgtaattctgtgctttggcataaatgttgctggcagctacacatgcacatttactctctgctcagcttttgctcaataaatactgtaagcatttatattcgctttcccttgtgctgttctgaaattcattgtga

SEQ ID NO: 40870 - DNA, 1501 bp, Oryza sativa
aggtaccgtggtggtattgaggcgcatggtaacatgttgtggaactgtcttgtgggtacagtggtacatctctggccagagtaaaactattcgaatagccgtgcctgcggttatgggtgggtctaacaatgtttttcgtgattagtctcacattactcattattggtgataatactgtgacaattaaattgactcctggtttggaatggtatattcctggtatggaggtttgatttgtacaaccggggttggttgttcagatgaggttgggcctatgcaacacgggtgtgttgtatagtgtttatttaatattgcttaatttacttaattgttttactattctctcaaatgtttattaaatattgtttatgcaaatgagctttattatgccatcctttgttatcctgtgcacttgcatatttgctatgtggcttgttgagtatgtcatatgctcattcttgcaatattcattcatcagaggaggagtacttcagtgaaggtgatgatctggaggattaggcttgttcgggtcaagttgcttgtggagtggggtcgccatagctgttccgccttttgtttttattttccgctgcgtagaattttattcttttgagaggaattatccacctctgtaataatttattattttgcgaatattaattagtagtttgacattactctattatcaatttgttattgtgtgcctcggctgattcctggacgaggatttaacacacatgtaagcgtttggaattttggatagaaatttcgggcgtgacactcagccagtcttgtctctctcggatagcttcaccaacctctgagacttcgtcaagctcagtactcgggggctactatggggtacacggtacctaggtacccaacgacaagccttggaccgccaccacatggggtgggcccagtgccctaagcccatgtggcatacttgtatacatagaaggagataaaagataaggaagtctatcctatctcttgtaaatagatggcaaggtatccattttataagggatactttgccatgtatgggggggggagccctagctctatataaagggcgctggcgacaatcctacggaggctttttgaccatttttccaccggatacagacaattcatcccactggacgtagggtattacctcatctcgagggcctgaaccaggataatcatctgtgtcaccatctctccttgatctagcgcaccccataaaatatattgccaatcatagaatcgacagaatttatctagcaaggtgtcgactagggtttggttatttgctagtcgttgctaaagttgggtagcataacgactaggtttggtatcttcttgttgatgcgaaaacacgatgcctggaagatctgcttaacttcagtgcaggtccaaaaaaaaatcttgcctttaggttcgtgagcgtgccagttgatttgatcatgcaatcaacaagaaataaaaataaagaaactgcagttaaatccataaa

SEQ ID NO: 40871 - DNA, 1501 bp, Oryza sativa
ataagtacacgaaggtccctcaacttgtcatcgaattacaaaatcatcccccaaccgcaaaaccatatatatgacatcctttaacttgcaaaaccgttcgctttacatcctttggaggttttgaccccggttttatccgacgtgacgggcgagtaagcatgggacccacatgtcaggacgccacatcattaggctctctcttttccctcctctcccttcctcctcctctctctcactctctcactcatctcccaccccccacgcccaagtgctccccgccgccgttctggccattggccggcgagctgatcagtggagtgacaccggaggtgttcgacctgtgcagatcatggccaatttcgtcagagtgccagagttcaggtgaagagaagaaataaatggttgatgaattgagttacctagtgggagggaggcagaaggtgatggtgtaggcggcggcgttgcaggtgaaggtgctcatgccgtcgttgtaggcgtagctgtaggcgcgcgggcacgctgacttgaagatggtcgagtacgccgtcggccggctgtcgatgcataaaacacagactggccggagaggtttgctttactctagtgcaggtccaaagagatcgctttcgggttcagggcgtgccaattggtttaatcctgcaaataacaagaaacaaagaaaccaaagttaaacccgtaaatgatagccgatcggttggattgccgatgacatatcctttgtgccaggccaatatgatacagatcagatcggccgtaatgtgatgaaagagataattgagtttgttctatcggctgtatatgtcaataacacataatatgtgtttcaaagtatgcttaaaccaagtgtttaggaaagatcggtcagcacatcaagacagtataaaccattcgagtccaagaatactttaaagcagggattatatgtactcacagcatagccgataggcaaacccaacgtgtatcaggtagtactcagataccactttatactaagatatgctaaacaagaatcaatctagtgtcagggtgacctaacagactgatggcaagcttaacatatttggtccaagcgagatattaatataaagggcagatttagcgtatcaagtaaacacatatgaaatgagataactaaatcaggtaagatcggctgaaaccccgatgctatctctattaacaatcataggacatgctagatattatggttctaaatgttacttaacagatcaaacttaactgatacaacattaagcacatggagaaacataggatctaaacaagtccatgagagccttttcgagatggtagatatgctatataatctgattcgacacagctatctaaccctatcggctattttcgatgatagaggctagccgacacggttatatagcaagatcgatctagattatatagcatactagagaatgccccgcgcgtgctgcgggacttggttaacatcaatttgttagataagagg

SEQ ID NO: 40872 - DNA, 159 bp, Oryza sativa
aaatcgaagcatagaattcacagcttggaaagcaaacatctaaatttcagacggcaaaacaaaaacagatacatctaaactttgtcatcaattttctacccaaggcacttgtgatttaggtacttgagtattaaatttccgcccccttggttacgcagc

SEQ ID NO: 40873 - DNA, 333 bp, Oryza sativa
agggagagaaaggggactttttatagtttttctttttataaaatcattttaactttgtttatttcttaataattataatttgtgctctgaaaattccactaaaatttatttacgcattttaggcttttaggaaatatacaaaaatcctccaagccttatttgacttttaactttgcacgttttaattgtgggaggctttcacacggattttaattattctaggcataatttagaggatgtattttagagtcgttttgggacgtgacagcccacatgtcatcctttctcctccctctctctcttttctctcccccttttctcttccccttcaga

SEQ ID NO: 40874 - DNA, 204 bp, Oryza sativa
agtgcacatgggtgtgagagctcttggaagggttcaagataatgcaatggagtgccaaaaccttgcccttgttgctggggagtgggtatatatacccccaatcaacaaaactagccgttggggtcgaaaaacccaactctatgctatgccggtcagaccgccatagtgtggccggtcagaccagactactttgtaacggctaga

SEQ ID NO: 40875 - DNA, 1173 bp, Oryza sativa
aggtgctgcccggcgacccgaaacatcgccttcgcctcaactgctgtcgaccaccgttcgccacccatcgccatcaaccgccatggtgccgtcgtcttcctccatggtgtgtcaccaatctatgggctgggatggtggatccattcagattcagaaaaaaaaggaaaaaaatgaagtgggggtaagagtggttggctgggtacaagaaaaatagaatatatattggaagtagggaaattgtttttatcgaaggaaatcgtttacttcgataatggtgggagtggatgacggggcatggggtgggatcggaatcatggaagttcttttatcgaagtaaatcgtttactctgataacagcgagagcgggatgatgggacgtgaggtgaggtgggcctaagctgacagatgtttggcgttcaaaatacttggagtgagtgcgctcctagtagtatctataccctcaaaagagtatgtgatgtcaattcaccgaacagttaatgggggtgttattggaaaaaaaatgcattgcattagagcaaatttcaaggaaaagagtgattacactaacatgtcgccattacgagatcaaaggcacaaacatgatataaaacaccctgtgcatgcatggacaagaataaatcaacggacaaggaagactatgattagcattcacatccagttccacacttttagaaagtaacataagcaagtaacactcagctagtttgaggaaatccacacaaaagctagtaatgccaacattctgctccttgttgacacattgtcaatagttagaagaatttactcctattacaaaaatcaatggttttctagtgcttcattcacgttttagaggcgttgctttcagaggtcctttaattatcacaatcaaagtattgttaagctggagtatgatatagatcgtttgtagttgtaacttgctagggcaatgacagtttttttttccatgttattctcctttatttttacttttttaaatataattctagattgtgtgcatcataactatgtactaattgcttgactaataacgctagctttataaaaagggcgatactccgctctccactagtagtattatatgtattataagtagaaaacatttgtttcgttattaattaagtataaattagtaatttattaatatactca

SEQ ID NO: 40876 - DNA, 1501 bp, Oryza sativa
gcaatcggctgatgataatataatatagcaatataatccagtagaaaccaatcggctaacaatatgatatagtagaacaagcattgatccgaaggttaaagcatacatcggctggaggtccgatgtagtaaaatccacaagattagattgatcaatgaagcctttgctgcggatttgctaaatccaacttatatgtatatgcaatccttataagccgatgcaacatccagataacttatcggctagcaccccgataaaacactagcatgaacctatcggcttaacaagacttatattatcaacaacaatctagtaggtcgaacctaaccgatgttgcacgagattgtatatgataatatagtactcgatgagccgatagatatgtctaatgtgatagatataacaaatctatttataacagcaatgtgattgtagagatatattggctaagacaggagatcggacctaaccgagacagttccaactaaaccgatgcgtctctaaacacaatgcaactagagatagaattgagatatcaggtaggcaaatatatcaacaaaacccttgaacaacaccaatgtagccaatagattcaccagggccggcggaacgtaggacttacccgttcgccggagatcaaactgaaccgatgcagccccgcgtgaggtaccaagttccatcggatgataagtaaaaacctcggtaaagagggtggcgatgtgccgagagtagttatattgatcgatagattgatagattacaatgaccccgggtatacatatttatacccatagggagacactagtccttgtcggacaagaaagaaactaaagaaaaaactttccgaaaaaaggaaactaacaaactattcctaattaatagataacttgccatgccgcattctctttgaactcggtctcttctagataagcttcctttagtagatcaatttccttaaccgaatatagcaagaatccgataaccgacgacttgataactctcatcggctaatctcaggacttcgaagccgatgctgactctaaaccgatgattactccaggcttaccaaatttcactgttaacacatgcccccctagttttggagtatgagaattcatgcttcaaaatttcttgtcttgataactccaaaactaatcttcctttgcttcttgcaatcggctttcatgagccgatactgtttccattagatgaaccaggctgtcaaactcgtggcaaaagaatctctctctgataggtgctgacaatccttggaatgcgagatcggctagttgctcatcacttaggctcaaaccataacatcggctgcggacattatgaaatctctgaatatattccatagccgattctccttcttgctactcaaccgatattaaatctgaaagtttcaactcactgactctagcaaagaagtaatcatgaaattgcttctcaagatcggtccatcctctgatagaatttaatggtaatgatgaaaaccatg

SEQ ID NO: 40877 - DNA, 1501 bp, Oryza sativa
taaataaatcattttcctttagaccaaaaaattccaataatcttagaaattcaatatcttcccaaccgtaagtccgtttgactccgttcaacttccaaaattcctcaaatctcgagatctatttaatggctcgcttagaggtcaataataaggctttattttagccgcgtgtagtttcggagcccgaagacccgcagtgcgaggatttcgaggataaagctcaagatctcgagcaaggcaagccacctttgaacatcttgagcctatattttaactaagttatatttcttgcaaaatattatggattgctaggattgcacttaatatgtttgccccatctacgaggcagatcggtgagcatacctaatttgttgcatttgatccttcctttgttaattgctataccatgttcccttgtacccacctagttgcgcctcggtaatcgtgcactctgcacgggtatcgacggtcgccttcaaacttaaaatctgagaaacatcttgggtgaaacttgggttttacaaaagacttggaaaacccgacacttgagtcggtgcttgcgaactaaatgaatttccaaaactgcggaccggggaacgtaccgggtgtacggtttcccgctcttgcacttaaggaccgtttccttggaatttcatccgatcataagacaagtacgaccacatgggtggaatgggacacccctggctgagtaactagcttatcgggggagccatgatgctaagagacatgtggattcgccagggtggtgtcggggaggaccccttggcatcctggcacagtatggtctaggacctagtctggtgttggtctgggacccctctcgttggcatatggtgaacctgtgtcggctctcgaaatgccttgtcatgaaagccctaaggtctctagtcgtggccattctgcaagggctggatgatccgggttagtaatgtcgtgtgggtaaagtgtaccccctctgtagaggttattaaaactattcgaacagccgtgcccacggtgattcctagcgtagttttgttttctgccttgtgaaattgctgttgtggaatgggtttgatgtttggaaaatctgcggctgatgggatcagccaggcccgggtggccgtttgaaagctgttggccgggtgccaatcttgatcaatttaaaagactgatacattgcacatactccaaccggacgagacgcactgtctcatccgtgtcgtttgagaagcactcacttagttgtttcacaaaagagttcaaataaaatcaattgcaaaaacaacagcctttccttgaagccggcattaaacacttatttcccatggcttgctgagtactcctttactcacccttgctctatataaatatttccccacccagttgctgaagaagatgaagcggatcccgctgacaaggagttcacgggcgcgtgtgtcgcagtggacaaggctctgataccattttgtaacgacccgcctctcccagaccgggccca

SEQ ID NO: 40878 - DNA, 848 bp, Oryza sativa
agacggcttgtagaggtgttacccggtgacctctacgaggagattgtggaggaggcccggcgccggttgtgagtggtttggagttcaccaccttcggagtgaaggaagaactatcctagtgatcgaggcttgggtagtcctctccgtgggtcggctcccgccttgcccaccccttgacgaagggggcgtgcggtggcttcatggttgagtggtggagttgggctcgcctcaacggggattaggaaaccggcgagtttccgaacctcggtgaaaaattccttgtctcttgtctcctttattttgtgcaaatttactttgagcaactttacatactagagcttatttgtgctattatcaccctaggcttgcaaacctcaacataggctagcttctttgtgcacttacttaagactagttgatttaggttttgaactgtacaaaaccgttttgatttacgcttccgcatacaaaactcggttttagccaaaagttttaaaaccgtgttaacagtgaaatttagtaagcccggagtaatcatcgctttagagtcagcattgtcttcgaagtcctgagattagccgatgagagttatcaagtcatcagttgtcggattcttgctatattcggttaaggaaattgatctactaaaggaagcttatccagaagagaccaagttcaaagagaatgcggcatggcaagttatctattaattaggaatagtttgttagtttctactggattatattgctatattatattatcatcagccgattgccttcatatcattatatacattggacatatagccgatagctcaaaaccctatcgctatcagctggcattggcta

SEQ ID NO: 40879 - DNA, 804 bp, Oryza sativa
catgctgcacaggcccaaccatcctgaacaaccatacccggctgtacagatctatctccaaaccaggaatttagcattccaaaccaggagctaagcaggttattaccagttatagcatcatttattatggtgagaagtgtgagactaatcacgaaagacattgttagacccgcccataaccgtgggcacggctattcgaatagttttactctggccagaggtgtaccactgtacccacaagacacagtgccacaacatgtcaccatgcgcctcgataccaccatggtacctcggaaaggagctgtgacagtacccctcgcacaacacaatccaccatagcgcaccattcctggatcataatcacccccttataaaacaaggcatggactccccaacgacccctgtgggcttatctccgccacttctcagtctggtgccccgcaatgaatcatgctatgcaaaaggtaaagctgttgcccatgctggcttgtggttggcacggttaatgtttcacaaccgaaaatcgtgaaccggtccttaattgtcatgagcactaccatcaaaaccatgtgctcacaacccaccattatcaagttttagttggcacattaattaattaaccaatcacgataaaccatcgtgagctatcattaaatatccatcattaagtgatagtgaaacattagttatcccaatcatgtgctaatgtttgtaagcatggctaagcaattatatctaatatctagctgaaccaatatataagtcccactagtcaaattgttacctaaggtatcaaagaataga

SEQ ID NO: 40880 - DNA, 1501 bp, Oryza sativa
aacacatttttatggaaaaatcatatacattttgaaaccacctgattaaaaacacatatcataaataaaaataataggaaacccataaaattaattaataaaattaatataataagtaccttaattagaaaatatttagcaagtaaaagaaatacattattttagatttctaatattatatcaaaatatagataactcaagctggtaaacatatttgaaagtcagtacatgcgcacatctccctgggaaacttctctcaccaccccactaactcaattttcctcctctcctaagtccattaaacttccaataaacatgctctcaagttgctaagtggaaccataataaataagagaaatccaaccatctatttttatttaaatcgatggacccattgtttaggatagttagatcaattttgaaaaaaaaaacatccggaaccaacatccggatccaatgtatacaaacaaacaaaattaatagttcgcatcataggaacgtacttactgtatgtccttctcctctattccttcctatgttattttctatttcatgagaaattaaaatcaaaattattttttagaggcaaaaaaaaatcacagatagaccaactactaggtctagcggctctccctccaacactttaaacatcctataaacgcttataagtcactacgtggtgctattaaattagagaaaatactagaaaatcttttaaaaaatacaaagcaaccgaccattgatacattgttttggattgttagatcttttttaataaaaaaaattccaaaacctctctccctccctccccacccccatgcggtgttaaaattcattaaatatattataaacatgtcacagcctgaatttcgtttcaggatttataaattatttaataaattattaatagaatttatattaaatgttgattaatttacaagtgaagttaaatgtgggaaataaaattttctaaatataaagcatggatggatttaatttttattaaattctccatgattaattatactctctggaattttctcggatttttcagagctcaattcctaattttaataatacaaagaatatttcagtaattatttaattaataaattaatcattaaatggtctggttttaatattcttaaatactttgagtgtccaagtatgttcaagatttttcttcgaattatttgagcgttgaaagtatttttaacaattgaaagatcatctcattggttaatttatgtggaaaagtaataaaaatcctcctcctcagcttgggccgaattcagcccattctctcccttcctctcagcccagccaaagtctgatttacctcccttccgctacagtactccatcttcttcctccagacagagccgagccagccgtgctcgtgcacagtgccgtcgcctcctcccaccaatccgacctccccgttgctcctctttccgaattagttgtgggaatggaatcctctcaatctcctcttcctttt

SEQ ID NO: 40881 - DNA, 1501 bp, Oryza sativa
acacgtggcctgggagatctgcttaactccagtgcaggtccaaagcttgccttcaggtatgttagcgtgccagttgatttgatcctgtaatcattaagaaatacaagcaaagaaaccgtggttaaatctataaatgatagccgattggctagatgccgatgacatatcatttatctttgagccgatgttacctgtgtatcgatcggcggtcatgaataagtaaagaagaactaaatctactcgatcggctgtggacattaacgatatatactccttatatggatatatacttaaaccaagtgattgggatagatcggtcaccatgccgagacagtataaatcacttagattgaaatatatatcaataacaggactatatatgtttatagcatagccgatcagatagatctagcgtgtatcggctaatactccgatactactctatatcaggatattaaggtaagtataatatgtcaaacaaaggcctaacatgcttagatatagcaatatcttgatataaaggacagtttaacatgtcaatgaagcatatagaacaaatgtagttaaatcagataagatcggctgaaactccgatgctattctaatcggcaactagaaggcaggctagagatcgatattctaagcacgacttgatagatcaaacttaaatgatacaacattaagtatgaaaagaaaaacgatatctagacaatcaagccgctagaaatttcatagggtggtagatatcttatataatctagatcaacgtcaaaatctaacctaatcggttgccctctgctaacagatgttagccgatagtaggttagatatcaatattgcccaagattatgtaagatatatgataactcgacgaattacataaacgagattagagtatcataaagatggaaacactaatcttgagaacacaatccgtcataacaagttttacctcttgttgaatatcgaaaccgatgcagctcaacccgaaagcaagaacttgtcgaaacaaaactaaagcaaaagagtggcgatgcgctgaagttgtattgaacgtgtgtgttgttaattacatagggctcggggtctatttatacccgagaattacaagatatgcccacaccggacacgactattatctctaacaaactctaagataccataagtctttgcgacagacttttgcccacatttatctataaggaatttacataaaaatatcctaattaatagatacaattgccttcccaggactctatccgtgcgtggcaatcatcttgaagtacattaacttgaacccgatgtcgcgtacaagtcgtattgtcggaatcagctgtatcggcttactcagcccgactcagacctagccgattctaatcatagccgatctggactccagccgattcctgctctatttccgaacttgatctctgcctctaactttgctttgatccaaccttctttcctgacacagatgttaccaaatttggttgttaacagg

SEQ ID NO: 40882 - DNA, 225 bp, Oryza sativa
tcggagcctgtctttattttatttgcttaagccagttgaaccttaatgaacccatttaatagcaataataaattcaagaattatggtagtcgtgggtgattagttttaatagtcagctctctctgtttgctgggtctgtgtgggatttttagaaggtgacaaccaggagaagtgctactaccggtgatggcaaccaacccgaaggtagcaaccacaacaaccatg

SEQ ID NO: 40883 - DNA, 1501 bp, Oryza sativa
actccttcgttcctcaactagaaggctgaagaatggaggcgaaagaaccgcaatttcgacctctttcaccttctcaagtctgcccctactccaactaactcaatcgtcgtcagcggaggaaaattcccagaaaccctaataccggcaccattgattgaacttcaaaattcgtcgcatacatcgtcaatcctctgaaatcgaaggtaaaatcggattctccatgccgagtactcccattcccctctctttacccatccaatccatcgctggaacgttgccggcaccgcctcccggcgtcgctgctctgttcggccgccgccagccgcatggcgcgccgccgctccagggcgccctagctttggccgtcgccaccctgggactcctctcgcctcagtgaacctcatcaagccaccgccctccccggagttcgccggagtcgccgccgccatggccgcctccacctcctattactgcctgccgccgccagcctcgccaccggtgcttctctcgctgccgaccacaaaaacggaatcgcctcgacctctagatcacaaaaccggtgcccccttaccgaaaaccggcctcctcggctgccagcaatgtgggattccggccagttcctgtgcagagaacgagaagaacagaaaatctgattttcctgttgaaaaataaatcagaaaataccctttttcttttcctatcaagttgaccatccgtttgacctcaaaatcgaaattcaagacctattccaaactcctagaattattccgaatccatccgtgtcagttttgttgcaatccgagcacccgttgtagcaaccctaattttagccatagggttcgccgttcaccgaaattccaaaaatccctaaaattatttccttaaatcctttccacccattgttgcactttgtgatactatttgttttggttatctttgtttttctattatttattgtagtgatgattgttgcgtaaatagaaaacgctgacgttggttcggtagtcgaagcgagtgaaatctccgcgccaggaggagacggtttgtacgactacatcgaacccgaggttgcaagacatgcaccctcctttgaacaatttaatcctagtagatagggagctattttagtagtgtacttgtcctttggagtacgatagattgagcgaattcttttaaattaattatattgctattattgcattatattttatgttgttatggacgccttaatgagccttagagtctaaccaacttaggataaaatttgagaaacatttaaacaaactgttaattatttaacatgctatctatttaatatggatattattactgcatatgaaaacatgcttatggaactatttatggctatatgctaagaactgttgacaccgcttgtgagcgggtggtacacatgatagagttcatgtgtttggtttcatggacctgtttatggtcgtgatggatatgtggatatatttatggttatttcttatttaaaatt

SEQ ID NO: 40884 - DNA, 1501 bp, Oryza sativa
tatcctgagtggtttgaaagagtccctcttcccaatcggtttaaagttccagatttctccaagttttcgggacaagacggcgtgtcgacttatgagcacatcagccgattccttgctcagtgtggtgaagcatcggctatagacgctctaaaagttaggttattccggttatctctgtctggatcagcttttacttggttttcctccttgccatatgggtcgatcaatagttgggccgatttggagaagcaattccacagctatttctacagtgaggtttatgagatgaagttgtccgacttgacggcgattaagtagtggcatgatgaacccgtgcacgagtatattcagaggttcagggagatgaggaacaaatgctttagcttgagtttgactgatgctcagttagccgatttggccttccagggtatgattcctcctatcagggagaaattctcgtccgaagactttgatagcttatcgcatctgatacagaaggtaaccttgcatgagcataggtcggggaagtcaggaaaagctttaagaaagttaatcatgtttgtccatacatgtatgggtcggatgacgaagaagatgattctgaaatagctgcagccgaatgggtgaggagcaagaaggtcataccatgccaatgggtaaaaagtcctggaaaagaggaaaagtatgactttgacattaccaaagctgacaagatctttgatttactactccaagaaaagcaaattcagcttcctgctggtcatacaatcccatcgcctgaggaattaggcaagaagggatattgcaaatggcattattctggatctcattctactaacgattgcaaggtttttagacagcaaattcaggttgccattgaggggggcaagattaggtttgatgattccaaaaagctgacgaaggtcgatagtaagctggtcaagcagccgatggggtccgtgcaaagggttttcaagtaaattcggctaagattatcaacaaatatcagagaaagtatgacaagcagcaggagaagcattacaaaaaatacgatgatggtttcgatcctcattggggttgcgagttctttagattctgctggaatgaagggatgaggttgctatctatcgaaaattgccctaggtgcagtgaaatcatcgagagctcgagccggccatatagtaggggcaatcggccgaggcaggcgagactttctgttcatcaaagactgggttcggtgaatcaggatcgtggccaagaagatgaggcaatcaggaagaatcaatggtgtccttctggtattttcacaaaaaatcagaagagaagggtccaaagattgaggaacagggagcgcctttaggaggttgaacaagaaatcaatcatcggctgcggaaacaaaaacaagacaggagtggcatgttaagaatctggttcctgtagctgatgatgctgcagccgatgaggcgaagaggttggcaaaaggaaagagtgttgtagcgg

SEQ ID NO: 40885 - DNA, 212 bp, Oryza sativa
agaaactctacatactgagagatatgacaattgtcgtaataatatatggtaccccatgatatatcttaatgctaagaacagaatgatggcaccgaattttacactgaaaagatctcttgctacttgaggaccataaaagatctcttaataaatggtcagtgaattaaaggaagtttatctacaatactactccccgttgcactatttccagt

SEQ ID NO: 40886 - DNA, 1501 bp, Oryza sativa; identical to SEQ ID NO: 40850

SEQ ID NO: 40887 - DNA, 334 bp, Oryza sativa
aatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcagg

SEQ ID NO: 40888 - DNA, 581 bp, Oryza sativa
  unsure (1)..(581): unsure at all n locations
cacacgcgtatgtggtgattaggcgtgtaagggataantcattataacgttaantgtttttatggtatataagggtaaccctaaaaaacaaacaccaaaaagggatgaattcgattcnccttcnnaccacggaaactaaaaagtgcagtctttacttccagacaatataagaatatgaattttcttaaggacacttaaaaaatgtggtaatttaccacagaacacaggtacattataatacaacatccacccaattgaagacagaaaaaccacgaaatatatcgatgttttctttatcttcttcgctctaatcttcctaaaatggataccatcatggtggagctatcgtgggcctctgcgtcatgaatcatgactaagtgcccttagtcggtgatgacgaagcacccaagacatagcagccaggagtcaccactacactgttgtggcccttgggattgcgacaaagtacttcgagcgcaacagttggcggtcatcaccataccatcataggcgatttggcctatccctcggccagatcagccatcatcggatccactgttacccattcttctcctaccagg

SEQ ID NO: 40889 - DNA, 1501 bp, Oryza sativa
catcctggtatcttggcccctattttttcgatgagaggcagatagtcaatctttctaagttttctgaagtgaagaggcagcccgagatagcgacaagggaattgcttaactgtgcctgggaagtttgccaaaagagagcttacatcaatctcttcacatcttatcgggaagaattctgttttgttaatattcgtatgcagacccgacacttgagcaaagaaggatagaagctgggccaaagtagatatatcactattctgaggccttgcgaagaccgcaacatcatcagcatataacgaacacctgaacctttcacatctcccgccaatcggtgataagatggctgcattttcagccgctttaaggatacgatgaaaaggttccattgctagaataaatagcatcggggaaagcgggtccccctgccgaaggcccctaacatgatgaattggctggcccggggatccattaagcagaacttgggaagaagaggttgccaggatatttgatagccaatctaaccagcgaattccaaacccaaagttgtgaagaacattgaggagatatggccaacacaccgtgtcaaaagctttggctatgtcaactttgatgaacaaactttgttttttcgttctgtgcaggagctgtaccatattctgaacgtaaaggaaattgtcgtgtatagcccttttacggataaaagcactttgattttgggagacaagctcatttagcctgggcgctaatctgtttgccataagtttggaaattatcttggagaagctatggatcaagcttatagggcggtagtgctctgctataagtagcatcttctttcttgggcaggaggcagatataagccgagtttagatcatgtaattgagaagtgtttaggtcgaagaaagactttactgccgctagaaggtcagccttgatcacatcccatgctgctctgaagaaaactcctatgaacccgtccggccccgacgccttttcagctggcatggagaaaatagtcgctttaagttcttcctctgttacatcctcttcttaagtctgacaagtctaggcttggcaaatgcagggaatcccaatttaatgcagcctctctttgaaaacctgatcctagcctctgtcatgtacggccgcacatacaggcgcaggcgtgacatgcgccgagcggccgagcgcgcgacggcaacgtccagaggctgaagaaaggaaagaagaaatctgctgctacttttggtgtccctagaattaaggatagccttctatatttggttaggccagtggccatataatcatgtaatcagtctctttggaaaggcagctaatagattgtcattcctaatctctctctccactaatcacaagccactagcagaggggcaaaacctcgcggtgaggactggagcgcggctacgagctacgtagtcgcggtccggcgtcgttgggtgccgaggcacttgccaacctggtataacgatcccggcgatcc

SEQ ID NO: 40890 - DNA, 1501 bp, Oryza sativa
gctagactggcggttgttgcctttgatccaaagaagacacatctgaaactcttagtccaaacaaaagtctctttggctttttaatctaacacagatcgcttcattttcttttctatcaacaactaggttacttgatttatcatagattatgagcttacggatatgagaccctaggtctcctttgtcagtaaacaattacgcacataatcacatatccgcatcttccaaaagaatccccatagatcttgtctgtattacacatttctcccttattacatgaatactaagcactgcctaaaaaaaggaaaggtgcttagcatcggtacattgtttctgctatgggttatgattaacacgaggcctcacaggtatggcgtttgctctagtgaccacaaggcgagtgacttgtcttcttcttgcataatggccagagtgatgacgcaggttatgcttcggttgtggacaatctctggagaaatgacctggttctttgcagttgtaacaaattaatgtcttctttactgagttgtccgtctgggaacgatcattctgacttggagttggaattggtggttggaaatccttgctaacattggcatcagtggtaccatagttgctatcaccattggagtctttctcagagtcaaaattgctagggttgtcattctgggtgccttcattgatactatcatcgatatcttggtgaatgctgttgacattgcactcttgatccaagtggtcatgaatggggcaagaaccatggttgttggtggtatcatcagcattagtattgctaatgttgttgtctgcattgtgtccatcttcttggggtaggaactcttgatgcgcaacagaagatccggtgatctgaagtggctcagtggaaatactgggatgttgacaatccttctcttgcagttcgtcatccgattatgctcactttcgagttgcatggctttgtccacaagtttctcaaaatcttcataatcctctaggagtagttgcactacaagctcatcttttaacccctggagaaacttctcttgtttgtcttcatccgtttccacatcttctggtgcatagtaagccaaacgatggaactcgtgcaggtactctgtgacggtcaaatcttcttgcttcaggtagcggaactctcgttttctcagtgtgatcattcctgcgggaacatgtgatctcttgaatacagctgaaaactcgccccaggtgatggtatgtccttctggtcgtgatgctttgtagctatcccaccattctgaagccggtccaaccaactgatgagttgcgaagacaacccgctcctggtctgtgcactgaatcaaccccagcttcttctcgactgtgcgcaaccaatcactggcttccataggatcgacggtaatggcaaaggttggaggctcagttttgagaaattctgataacttgtactgttgctggactgtaggtacttgaacgttggttgcccctgctgggttgtaccaat

SEQ ID NO: 40891 - DNA, 913 bp, Oryza sativa
  unsure (1)..(913): unsure at all n locations
tggtgtgttttggggtttttccctccccaacaaaaaaaaaaaaaccagggcggagaaaagggtgttgtaataaaacacccccccgcgagagacccctccggggagagggcaattaaagagaggcccccaaaaaggggccttcctcgggcgaagtggaagatatttttccttataagccccaacctccaaattaccggcccttagggcaattttcacacagggatattggacacaaagggcgccccccccaaactggtgtgggcgatcccccccacagcgttaataaggctttgcctggcggggtaaattccccccaatccagtggagggttttccgaccctccaacggtcaaacggtatgagagtctaaaaaagaggtcattctcctttcaagacaccctcagcaagaaacttcattcatctcccaggttgagtatagtctctatagtatagtgaaataaaatagaatagaatcttcagtcctcgaagtccccggagaaatcgtgtatggctctagaagctttccttcttttgtaagacttgactttatttggaaattctcctttaaacnacttgggtatgtatactttccaagtatacaaataccacctttattatatatccaggttatatttattataatgttagcttatctgggagatgcaatggtgtgggtataatgatcgtatttacgatgactctatgtcatcatgatgatattaaagtagtattcggtagtttaagcgtggtgtttagattactggatatcattatttggggttatatgctacgtaagcgaggtgggccgctgatggtgatagctcagtacgggtattcctccgcgcgtatatgtagtccaaagttaatttcctggggagggtactcctccgtatttagccccagttgaatggtca

SEQ ID NO: 40892 - DNA, 478 bp, Oryza sativa
catcactcaagtgtgtgagttgtacgtcagttttgggtctagtttttcatctcgtcggttgttgccgggaccttgaataattgaatcgtctcgtcgtcgggtttctgtttttgtagtttggagaagttttcatcaggcggtttgggatttgctcgatttctaaagttcctgtattgccgtcataatgcgcgtgtgagggagaggagatcggatctatgccgtgaatactcccgtctctcccgtccgtagcactaaaattgttaagtagcggatttgagatatttttataaaaacgtaacctacgtgatgtaagcattccattttttaggtgatctaattttaattttgcactatgcatttgagtccctgtaatattcatatttacatttgagtccctgttcgaggtcagtggtcagttcttgttgaaaaaaaaagtaaaaaaataaaaaaaaagaaaaggcagaaaggtgcaaagaaa

SEQ ID NO: 40893 - DNA, 313 bp, Oryza sativa
  unsure (1)..(313): unsure at all n locations
gtaatctagttcgagagagattatctttcngactgtgaggtctcaggggctactgtgagatttatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggca

SEQ ID NO: 40894 - DNA, 1501 bp, Oryza sativa
atgattcacagcgattaatgaatacgagcggatcggacttgccatcatacttgggaaaatcaagtttctggaagcgcggaggtggccggtcggtgttggtctcccccgtgcctgccttgggacccgaggacaacgacttgtcggcggagagtgcgaggattgccttggtgttggccgccgcggtcgcctggagggccttgacggtttcggcgagctgcgcgatggtggtcttgaggtcgtcggtgtcgctcatggcagcagcgcagcaagcggatgaagacgaggtaggggacgtcggcacggcgggcggtgtaggggaggtggtgcgggaaggagaggatcgccgggatcgttataccaggttggcaagtgcctcggcacccaacgacgccggaccgcgactacgtagctcgtagccgcgctccagtcctcaccgcgaggttttgcccctctgctagtggcttgtgattagtggagagagagattaggaatgacaatctattagctgcctttccaaagagactgattacatgattatatggccactggcctaaccaaatatagaaggctatccttaattctagggacaccaaaagtagcagcagatttcttctttcctttcttcagcctctggacgttgccgtcgcgcgctcggccgctcggcgcatgtcacgcctgcgcctgtatgtgcggccgtacatgacagaggctaggatcaggttttcaaagagaggctgcattaaattgggattccctgcatttgccaagcctagacttgtcagacttaagaagaggatgtaacagaggaagaacttaaagcgactattttctccatgccagctgaaaaggcgtcggggccggacgggttcataggagttttcttcagagcagcatgggatgtgatcaaggctgaccttctagcggcagtaaagtctttcttcgacctaaacacttctcaattacatgatctaaactcggcttatatctgcctcctgcccaagaaagaagatgctacttatagcagagcactaccgccctataagcttgatccatagcttctccaagataatttccaaacttatggcaaacagattagcgcccaggctaaatgagcttgtctcccaaaatcaaagtgcttttatccgtaaaagggctatacacgacaatttcctttacgttcagaatatggtacagctcctgcacagaacgaaaaaacaaagtttgttcatcaaagttgacatagccaaagcttttgacacggtgtgttggccatatctcctcaatgttcttcacaactttgggtttggaattcgctggttagattggctatcaaatatcctggcaacctcttcttcccaagttctgcttaatggatccccgggccagccaattcatcatgttaggggccttcggcagggggacccgctttccccgatgctatttattctagcaatggaaccttttcatcgtatccttaaagcggctgaaaatgcagccatct

SEQ ID NO: 40895 - DNA, 1501 bp, Oryza sativa
tgtcaatttgtttctgtctaaagtgttattatgaatattaatcatgcgtgatgaagatgatcatttacaactagcttatatgctatttttagaagaaaaaaaaatcattttttgtttgtgtggcatggcaaaaggcaatgcttgcataagttcctcgaagtactgtagattaaagttaatggtatttgtgtataccaatgtcaccatatggatgcatgggggaataggagcatgttgcttaatttttggatcattattctgaacatggttaaacttcagaaaattgcaattagtttgtatggtcttccatacaactatattagataatgcttaatttttagttgttataatctacctctctttggggttacccacaagtagttgtcaattgctggaattttaaattaccatatacatatcctcaatcagctctattatggtcttaaataatttttcgtaattctcctgtgatgatagttggagaagatgctgatgatggtgtaaattatggaactggaaggctgtaaggatctttttgttgcaggggcactgaaggatcaattatgcatctgcactgcacttctttcactatgtctaaaatatttattaagcatagactgtagaagctaggactgatcgatattctaacatattctaacttatattagataatgctatgtttcgactgaaaagcaaaagtgacatttgatgttcattggagattacagtaagagtaaattgcacccatggtacaataactcggcaggtgggtgcgatataatgcaagatcttgcgaattgaacatttgagtacaataacttgacaagtgggtgcattctagtacaagaactacaatttatagtattttggtgcgtcaacttggctaagcatatgctaggtgagttttttcacgatgtcaatatgccattacacaatattcctacggatattaccttataatattgaatttaatcttcaagaattatactgcatatacaatttaatcttcaagtttttttttttttgctttcttcaccatctcaaatatcaaccgaaatataataattctacatccaattttattaactttcagttatcggttattagaataaatatataaatatgattatacaaatccatgctagaatatggtcaaaataaaaactcaaaaaattaaaatgctccaaataattaagttgtcatgtaacttcttaatttattgtatcaaaatcgtacctacttgcaagttgttgtatctatacgatcacttataaagttcttatactaaattacacctttctaccaagttgttgcactagaacgctcatttctcaagttattacaccaaattacaccacctatcaagttgttgcatgtaattactctacggagtatattttgtttgtacgataagatattatcaaattccgttgctatgtttgataagatattatggagcgacaggcctgtcgctccataatccccatacctaaacagagaa

SEQ ID NO: 40896 - DNA, 1456 bp, Oryza sativa
atagagactatactaaacttgagagatgaatgaagcttcttgcttgaggtgtgtcttgaaatggagaatgaagctccttttatagcctcctaatgacggttgtgacggttggaatggtcggaaataccctccaactgtcattgggagctaatctacaccgcccaggcaaagccctagatcaaacggctgcgagggggattcggccgaaccaggttttggctggtggcctcctctcttgctcccatatgccgacttgtgaattttggcctaattggtcgtgtcatttctgagttcttggcctattcattgataaatctgattctcgacattgtccgattgattgatcgtctattttgatgttgattctccttcattttatgttcattctctgcaagaggttagtaatcctaatgctagtggaatatttattaattaaacacaaatatgcattacaaccatggctagttctcttttatttggatagtattgaccggcaaaactgatcactaacgaccgtcaacaccattttgaacaaccatggaacatattccatctatggttccgtagagttccagattgtcgttccaaaaaattaagctaggaacacgttccacctatagttccgaaattttggaagaggtatactcctctagttccatgcttttggaaaatggcatccaacgttccacgttccagttcctcgttccatcgatccatgaacttttgagacttaggtttagccaaaatttggatgaaacaaacttgtaatgttgattattcaacctagtagtcatgctgcctattgggaccataccttgaccaaatatgctctaccgaatctttcttcaaagcgtagtgcgtacctcgatcttgtacacgttgatcatgttggaggactgatgtcggatggggtcccgatcttctgataggtaatttatcttcccataaccagaaaaaaaaaatcattcatcctttgagtatgttttcagagtgcagagttgtgcattgattcatatctagtccttactgttgtcaggtgcttacttgagctagagttgagtctaggctaggccagcacattgactagtactttgaactattattcaattttgcattttttgattagcacaattgtgttcctctgctactatatattgtgcctcccaagctccacatatatacttctggtgagcaccactttgatccttgcaatcgccacatcacgtccttcaaggtgtcacaaaccagccaccggatgtaccgtccttagcactgctggtaaggcacttgtaagagcttgataaggtgctccatttggctgagttgttgagaggcaccactacaccacatagcagattattagggataaccttcactgtttgttgttgtttttgtgtttgcaatcacatgtatgggtggcgctcaaaatcagcgataccaacaaggtgacaataat

SEQ ID NO: 40897 - DNA, 1501 bp, Oryza sativa
tactgaataaatgtgattagggacgtcctagggtttcccaagggcgcacacccccttaggctaagcccacgacacaattacaaagcccaaaacccaaatcggattcggattggatgagatacgtggcttgttttgcagattcccggtagctcagttggaattttaacgtgggaccaaaaccatctgaaagtagactccataagctttccaacaagtattcatgggccccgaaatttgtcacgcccggaaattcacaagtaatttctaaactaatttgtgcattaaatcctcgtccaggaatcagccgaagtacacagattgacaatttaatatacagattcatcaaattaactaaaacgataaattgaggcacttagtcctcaccatgaagaaaactgcagcggaaaataaaatctagcgaagctccggctccactcccacaggcagctcaactgaggtataagccaaacgtcttctccatcgcaacttttcttcaactgaggtttgattgattattgcaaggtgagcatatgacatactcagcaagccacacaccaaatatgcaagtgcacaaggataccaaagaatggcataatataggctcatttgcaaaagcagcatttagcaaacatttgagaattgtaaaacaatagagtaattaatcatcaatattaatcaacactgaacagcatacccatactgcacaggcccaaccatcctgaacaaccatacccggttgtacagatctatctccaaaccaggaatgtaccattccaaaccaggagctaatgaaattattatcagttatagcatcatttattatggtgagaagtgtgagactaatcacgaaagacattgttagacccgcccataaccgcgggcacggctattcgaatagttttactctggccagaggtgtaccactgtacccataagacacaaccccacgacatgtcaccatgcgcctcaataccaccacggtacctcggaaaagagctgtgacagtaccccttgcacaacacaatccaccacagcgcaccgttcctggatcataatcaccccattataaacaaggcatggactccccagcgaccccagtaggcttatctccaccacttctcagtctggtgccgcgcaatgaaccatgctatacaaaaggtaaagccgttgcccacgctggcttgtggttggcacggttaatgtttcacaaccgaaactcatgaaccggtccttaattgtcataagcacgatcatcaaaaccatgtgctcacaacccaccattatcaggttttagttggcacattaattaattaaccaatcacgattagccatcgtgagctatgattaaatatccatcattagataatagtgaaacattagttatcccaatcatttgctaatgtttctaagcatggctaagcaattatatctaatatatctagctgaaccaatatataaatccaactagtcaaattataacctaaggtaatcaagacatagg

SEQ ID NO: 40898 - DNA, 1501 bp, Oryza sativa
tttgatcaataggttataacttctatatagaatttacatttatcttttatttttgaattatattatattactctaagttgtatatgccaactaatataatattgatatccaattgcaggttatattattaattagaactatccgatttacctcatttctttattttgatttaggagtaactggtggtcttttctgagcacgactgaacccaccatttgataattttgaaatcttccctatacatccgtttgtggaagcaaatgctgaggactccagtgttggtgctggatcaaaggaatatgtgcacacgctcattcagtgtggcacaacggaagaaaaagactgattattgttcaaggcttgaagagagaatacagccagaacaaaatattctaggatctagaaaaggaatttggctgtaatgttactgtggtccatgattcagagctaggaggtacaaaatagcacgtatattgtgttgtatccaagttgtttggtgtgaatgtgtataataatgaatggtctgctatatatgtttgtaggtcattcagattcaaggtgatcaacgtaaaaatgttttgatatttcagtactttgaaatacatttccttgcagtacaatttgacaagtgtaattctctgcctttctgcatccatgttgagtcctatataaacggcaactttatgagttgactttgaaatttatagaactgactcatttgaatggtataattccataggtaacctgcttaatgatgagaaacatagatatcaacagttgatttcaatggtgtcacgtcctgataaattcatcccgaaataaaaatcattctctaaatggaataatagaattaattaaaattcgaaaagaaattagcaaacattaaaatgcgtacaagaaaatttcgaatgtggcccggagaattttcgttaaattctccttggtctaaaatgagccctcaaattttacttaaattttccgagcaccgaaaatatttattaagcaacaacaactattatcaaagtttattaaaaagaaaaacctaaaaataatcctccttcctcctttgggccaaatctggcccaaaatccactctctctctctcggcccacgcccaaagtccttccctcctccctctctttttccttctctctctcttgggccgccctccctccttcccctcggcccagctccctcctcctccctctccctcccgggctgcctctccctcctctcctcctgggccggctccgggcccaagccgagcggcgccctcccgcccgtgccgcgcacgtgcgtgcgctgaccgcgcgcctggccacgtgggtcccacgcgccgggtcgtcgtcctcctcccgcccggcctcctctctctctcccgaaaacctagcgccattcctccccaaaatccacgcgattcaaaccgggaattccaaaattgattagggggaattaatcccctttccttcctcttcaattccaccccaatttcccccttgat

SEQ ID NO: 40899 - DNA, 1501 bp, Oryza sativa
tcccatcttgattattcatattccactacatgtttcacagcatacccaaaaactacttttataatttcccaattacggagtagcgtttagcagtccctaagtaagctacgacacatgttgggaaccatgataatctcaggtctaaggattcaacaccaacactaaatgagatcactgatgacacaacacagatggctcttgcactgtatcatgttgggtctatccaacaacatgttccccaacatgtgttcacattattaatttggtatctctgtactatgatccatgagacatgatcatcaattaatacttgtgctgatcatttaaacatatttgttccacatatgatatttgatcatggatccttaagaaatagtacaaacaacataaagagtctaatgaaagaaccacatattcattaaccaataatgagttatctatttcaaagaacaaagttggataaatatataaacatagtatgtgatacaatcatctgtatgattgcctctagggcatatcactacagtggtgggagtgatgatgcatgctgcacgttgtacaatgaagccaacgacggccattcctgcctcttgttccatcggaactcgaagctgagaggagggaaagaacggggaaggaacaggaggaggatggaggaagaagacgacggtaatttgttcagaaattgtattgaaaggggtaagtattggcacatcttcgatacttactaaattgtggttccaattttataaattataatggtatattttataacgagcaaatttataatggtatgaatctaattagggcccctttgaatcgtaggaataaaaaaacggagaaataggaaaaatataggattctgacaggaatgctagtgtaaaacaaatgattgcaaaacacagaaaaaacacaggaatgatcgtttgattagaccacagaaaaaacataggaatcggatgagagagataaactcaaaggatttttaccaagagattggacctctccaaaacctatatgcaacaagccattccataggaattttgtaggatttcaatccttttcatcaaagagctacataagaaaatttccggtaggatttcaatcttatgaaatttcctccataatttgtttgattcaaagggcccttaatcctagattatattggcttacatgagtctactactagtctactacacgtggcttccatcagggatgtcctaacggactcaaccggtgtttcttctacgcctagtaccttccaggccgagatctcccatttggatcctctgttctgcagtctgcacggctttcttctagctgtcggaagggtgaagtcttgcaacagatgccatacctaccaggaaagcaaagtgtcgaaacatgaattcggcaataataaaagggggttgcgtacgagacctaaagtggatggatgcagagacaaaggatttagacaggttcaggccctctcgatgagaggtaataccctactcctgtt

SEQ ID NO: 40900 - DNA, 1501 bp, Oryza sativa
taaaatttggagggagtataatggattttaaggctcgtaatttatccacaattataagggatttggagtgctactttcccaattggaccatttatttaattttctctcagccttaaatccaatcacccttgccctctccaactactccttatttagtgacggacatcttggtttatacgcttatccttaatctctaaaagggacctagaatcacttttatgtgtgcatatacgttgctgtttggattatgttgtcctaaagtctaattgcttgcacattgactttccatatttccttctcaatgtgaaaaaatttaaccataagacatgccattgtgttaaaattctacgttgataattaagaagaactatggattaggctgataaattatatatacatatgtgaacagaatcatgtagtcattccaagaaatgtatttggacaaagtatgggggatgtttatttggcattacttgtgattagaaaattaacataatgatcaaaatcgaatggcattgatcaataatatgtatatgctgtagagtacatacagtatatacggatttacagagacagggcatgaataattaatcattagctgctagtttgtattaagaaatttttttgataatatttgttctctgccagtgccccaaaattatgattaatgctcagtattctttaaataaattatatgggtttttgctgtcaaacttatcaataaaacaactcatttaataggggaaaaacgcgattcattgttttaatcaaaatcgtagatcacgaatgtgttaaacagaattcctataaggattgcagaagaaaccatgatatatatatgtaactgaccttttttaggtgtaagcaggcaaacaatttctggacaaacatcaaaacaacgaaattagatatatcttagtactctcttatcatatcttcccttgggataaaataaatacgataacttagaatactccctggtgaaatgctacaattgtatatccgtgcgcttgtggatcatatctgtaaccataatatactaggattatttctagtgctattgctgggaattatatttccagtagtgtcactaagaaataccaacagtcgtcacctcatgagggaatatgataactggtgtgaatccaatctctttccaacaacataattaaacaatgaaaactttgtcccaccgggcatgccaaaagcgtgttgacgagaaacacggcggcctgggagatctgcttaactccagcgcaggtccaaggcttgcctcgagtgtgctaagagcgtgccagctggttcgattctacgaccagcaaggaaacaacaaggaaagttagattgccgatcggccgaggctgatgacgtatcgttagtgatcccatccgatgtagttggactagatcggctatggattgatgcataaattagacataaaccctaaatatgcctcatacgctagtttatctatactaatataaaaaggaggagttgtacc

SEQ ID NO: 40901 - DNA, 1501 bp, Oryza sativa
cgggtggtctcacccctatgcgtgtggcgcacccggtctagatcctgttgctaggggctcaatcctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgtgccctcggatatgggcaatcctagcaatgtacccaagttagtggtttaattcttaaaatttgcttaacaactaaaatatggaatggttggcctgggttggcttgggacgagctgggacccagggcgggttgccagttcggtctgaatcatcgtaggccttgggttaaggcaggttcgtgtgggtccacggccttgattaataatactgtgtaactctaggatcgtctttataaaatagctttgggcaattaattgacttttaaatgctgtttactgccaaacttaacccctatattattaccccttgtacccccttgcattaatcatgcatctcccggtgtgacttgctgagtatggtggttgtactcattcttgctctatctttccccccttcagtaagagaagctttggagaagaagtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgccttttgtatcatatttgtttggtgtaccccggcttttcctgggacggggattaatacactagcgttcgggaaaaggcaattttctcggtcgcgacaagctggtatcagagccatctcgactgtaggataagccaagtggataaaacctaaggacatattttataaatgaaactatttgcgaaagttcctttttttttctccttccctaatgctatttgcaaaatgtttactcctttctttcttcttcggatttcaactagtactagttggtcagctttgtgaagaagaagatgtcgtcagttgtctgctgaagctctagaaggctgttggatccgttagcaaagcaaaggaagcagtgaagccagatgtgaagcaagagtgaagatcttggagaaccagtcacagaacctaagccgccctctagggtagtgtggttagtcgtgtgttcttttgcttgtgtgtgtagtgcgtggtttgcatcggtgggttgtgatgtaaccatgctaggttgtttgcttaatcaacttgcagaataagtgaaacaaacaacacatcaacaagaagagttagttcctttaaggtcttgtccctagttctggtctattctttccttgtatgcttcccctctcaacctctaccttgtgacagatggataacactggtaacaaaggctatgggaa

SEQ ID NO: 40902 - DNA, 1359 bp, Oryza sativa
  unsure (1)..(1359): unsure at all n locations
ccccccgctttattgagactacttttttattcttgtataactcctttacttactatgtttatattgttctttaaacgctcaatcgttcaaaaaccacaaacccccccgcggtttgaattgactggcaccttggcannncncccgcagaatagagttcagcctttttttttttggcaaatatagtagtacgtattttttttccctacttctatgtaaacgtacgggagtgtttttttttttgtaatgtacgggagttaggaggaagggatttgccttcttagatctaatttaatggtctaaaataatgggtcgccgatttaagtaaaaattgacggttagatattttctttgtatttaaaattgtagaactttttagagatatgacatgtggcgatctaggagtgtttgtaggagtgccacatggtgatttaaaaacgtttatagaaagttatagatggtgctgccgccggggagagcaaggccaagaaattcctgaagagggcgttgtcgttcacgggtagctcgtcattggggagtgcgatggtggggatcctgtggcctcggacggagtcgtgcacggcggagcagggatcccgacgtccgacggcggcgcagcgagggcgcttaaattataatgagatggagactgggctcctaccccgcgcgtgcgcgggtgattaaatcgcgcgcgggatccgcagcgcggagtcgcttttcattttttctgttttcctttcgcttttctctaagaaaaaaaaataacctttagcacgaagaaaaaaaaaacctttagcacgttttatttcttttttttttttaaggataggacgcggaaaattaggataggtacggagggttaactgcaacaaacttttaaatttaagatttaaaactcttaactcaagatttgaaacttttaacttaaattttaaaaaaattctaagtcaagatttgaaaacttttaatagaactactattaggagtgcagcgcgctcctaatattccaagcgccaaatattcatcagcccaggctcaccccaccccacgtcccgtcatccaactcctaccgttgtcggagtaaacgatttactcctatcgtgcgcctcaaacatccacctttattcgagtaaacgatttacttcgataataaaaacaactcccctgcttccgatcccaccccacgtcccacatcgtgcacccaccattatcggagtaaatgatttactatgataaaaacaacttccggtatatattctatttttcccgtacccaaccaaccactctcgtccccactctattttttacttttttttcggatctgaatcgatccactatcctagcccacagatcggcgacaca

SEQ ID NO: 40903 - DNA, 1501 bp, Oryza sativa
acttcttcaatcatccatgcattccttatgttcggtctctttttttcgcccaagcaagtacctctgcaaacaaaaacacacaaaactcatcgtgtagcaatgtttgttcaaatatataacaagtatatctaatatagaatatatgcacctttggttgattaatacataaagtagccatgattatatctgagctagttgtgttctcatcatgctgcccctacctggcacgccaactgtcgaaacaagatttcggcaatactaaaagggggtggctatcaagttggaaaagtggatgggtttagagacaaggaattttatacaggttcaggccttcttaatcaagaagtaataccctactcctgtccggggattgatccgtcgagtgtattattgatcgtatgatctgagagaaaatcgtgcccctagaggcacccggacccctccttatataggggaaggggtccgtattacaaaatacagtccatatccttaacggaatatgtagttacagataaaatacaatcgtaactgactaagacatacaagtttaaaacttaacccgagtcttctcgaagatattctatctatgcatggcaccccatacccagtcagactatacatgccgtgtaggtatggggtatccataatctccacaaggctggatagtgcatgataaatgtaagatcaacgtgtgttttgattcttattctgtgatgaacaattggcatttgtgactgttggttttgatatttggagattactgttgaagtggttttggagataattgattttcaggtgatgaacagggtttgctgttttgtcgggaccggtcagaccgggcggtggttgctggtcagaccggcttgtgttgagcggtcagaccggctagcccgcggtctgaccggccgccgccgtgtcggtttcggtttcgggttgtttctttggatatccatgattgtttcatggttatggcttctagatggatactatacatatgtaatactgttgtttgctaacaatgagtcaagttggtgatagcttgatcttggaatatggtttttttgtttgtttcttgtgtaggtgactcgatgcctcgggagagtatttgcggtgatggaccgggagtcggcttggtggtaagacgatgtatgtggtggtcagatattatgcgggataattaggctagagttgatgcacgtggttggtgaagatttcatatggcatacgatggaggtattgtgtgagtatgggatgcggagtcgaatttggaaggagtccaaatttggtatgattggttatgtgaagtttgtttcttgtactagagggtttcctaaggtgtttaggacttctagtatgagtttggtttgtggctttaggctgcctacctcacgtataaatagagggggagcgtgatgcttccctgtatcgcttttgagagcaattgagttgctagtttagctagggtttcgagtttagtcgacatttttgtaaggagtgctgt

SEQ ID NO: 40904 - DNA, 1501 bp, Oryza sativa
tgtgcatagagttagtaagaagcatacaatgaaagtatatgggggtgtacagtacagaaaaaggttgtataataaattaacagaaatacagaacacgtttgcggttcgttttgcccacaagtgcgaataacataattttaaatttactcatgttcctacagtaagtttgttcccatgtaaatatctgaagaaaaaggtgacagtaagtgctagagaagagaagaaaacaatctcagcaaaaaacaggtgcatatattatttgccgcgcggcatagaatcttgtcgaaaggaacttgatgcaaactaaaatgcgagaagaagattcagtagatcacacagcgagaaccaggaagtgaagaagaatagttcccttctccattttattaacacgtgagataaattcaggttttgaatcatgcgatgattaaaagtcaccatattattcattgacacaatcgactggaacaacaataatatgaacaccaccagcagatggaagaaacataaatattacttcaatttagttgggtaaaagtgagcgtactctattaccgatcataatatgcaaagaatagtgagtccgtagttaaatctgcagtttgaaacaatcactacagcttataaaatcagtacaagggctctattattcccatcattaaggatgtcaaaaacatgtagttggggttatatgcatagtagttaaaacgatgatcctcacctaaggcccaatataataagttttacagaaaacgcatcggttcaaacaaatatagagggtaaactctgcctgtaatgcatcactgctaattctagaacccaatacatctgtaatgatgaaaaaatgctacttcatctgtttcatattataagactttctagtattacccatattcatatagatgttaatgaatctagacacaaaatcattaacatctatatgaatgtgggtaatgctagaaagtcttataatatgaaacggaggaagtattaaaactgtagaaatcaaagatctctaaaagagatccccatccaacttgagcaaagaaatctcttcatcatctaaaccttattcaagcaacatgtgcaaccaatattagaagttggcaagttgctttaggaaaatctggaagaaaaacagagaaactttcgtgactctaattcagagctgggttgccgactgcttggtgtttcagtaaatttcagaaaatgaaggcgtcttaattaagggcatgcacgtgcagttctgcactatccaggaacccccatgacttcgaattctgattccccactgttagagtagagataagtttcaggattagattggttatcttcttatcttttgtgttgcttatcctatttaacaaactccctgtaactctcgccgcgttttgccggctcaatcaatatattcgtgcggcctcccacgggaggtgataacgcttcctaatcaatctagttcttccacatggtatcagagcctactcctcaaactcatctagat

SEQ ID NO: 40905 - DNA, 1501 bp, Oryza sativa
tcgtcgtcgtcggcggcggagaaggtggcggctcgcggagtggaggggaggggaggaggaggcgcgtgccggtgttaaggtgccacgcgattgaagacgatctctctctctctctctctctctctctctctcaattaagtgggccacgcggatggttgacgggccggcccatctgagtttgtggatgggccctgtgcggtattttttcattttaaatttttattttttaatatttatagaaatattgtaccggcgtaaatataaacatttacagaagtgacgtgagggacggacaagttgaaaaaaaaaaagaaaaaatgcattttttggcaggacaaaaattgcatttacccccttgcagcccttgtagaggacggcaagggacctaagtgcaaaatgcgtacaccttgacgccctctacttggacgacaggggccatttgtgtaaatattttggatggtataatatttctataaatattaaaaaaattaaaattaaaaatgagaaaaattcggccttgtgcttaccggagtactccctccgtaaaaaaaaaagtctaattctacagataaatctggacacacaaaaaaagtccaattctagagatgaatctgtcactggtggagaaaccatctttcgtcggtcggccgatttccgcaatagtcccggatgcaataaaaaccgggactaaagatgatctttagtcccggttcaaaagggtaacgggcatatttgatctttagtcccggttggtaccaaccgggattaaagatcatctttagtcccggttcgaatgctgtcagggcatgtcaggcccccccgggatctttagttaccaaccgggactaaagatcgtaactttagccccggctggtattaccaaccggggctaaagatcctggtgatctttagctccggttggcgctaccaaccgggactaaagtcccacccctatttatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttataagttgtaagttgatgagagagaaaatgtgtgtggggaagaaagaatatatagaaatttagttcatttgctaaacaaggtattataaaatagttgagaaggaaaactctagtgaaagttaatcttaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttttgactcatgtaga

SEQ ID NO: 40906 - DNA, 1501 bp, Oryza sativa
ataataaagatgtgccttttgtatcatgtttgtttggtgtaccccggcttttcctgggacggggattaatatactagcgttcgggaaaaggcaattttctcggtcgcgacaaatggtcaaatcaaactcaaataaaaaggtcaagctcccttcgacgatcctcgttgatcagccgtacaaacatcatacatggattaggaaaccgttgcgccgctcagtttatccataaaaattagcatatatggggacaatattgtctaatagaaaatgtctaatagaattcaacttttcttgaggaaaatgtctaatagaatagaacaaatcactatagatatcatcgaaataatctataaatattacgtgcatgcacaagctgtaaaaaatatcaaccctgctatccgtccgacgcaaatcatccgactagcatccgactgaaacggcgacaacgaacaacatgacggcgtgagacgactctattatctatatatgaatcggtccaacgccatgcaagcagcccattcctgcacggctacaccatatgcaagcccatatacaagtctagactccaagcccaaactcaggaagactccacgacacttctgccggagttttggtcgatctgaatcactgcgtgctaacttcaatctcaacgttctcttgtaatgttttcacagctgcagctgctcattttccagacaagtttttttacccttttaatatactcctctgtttcaggttataagtcgttttgacattgatcaaagttaaactgtttgaagtttgacaaagtttgtagaaaaagtagtaacattttcaacccaagatattgtaaatattactatatttatctataaacttagttaaatttaaaatagtttaacttttaatcaaagtcaaaacgacttataatatgaaacaaaaatattttttttgaagcaaatgacagcaggagatctgctggatatattagaagtattagaaataacaggttggtatataccacagtttcaagttctatttttatgcctataacaggttgcatttaacaaaatataaggctgtgtttagatcaaggggtgcaaagttttggcgtgtcacattggatatgtaggcatacatttaaagtataaaacgtagactagtaacaaaaaatttacataatccacttgtaaattatgagacgaatttattaagcctaattaatccgtcattagcaaatatttactgtagcaccacattatcaaatcatggactaattaagcttaaaaaattcatctcgcaatttacacgcagtccgcgtaattagttattttttttgtctaaatttaatattacatacatgtgtcaaacgttcgatgtgatagggtgtaaagttttggcattagatctaaataggccctaaatgcagtgatgtccaaaaccacaagcatagtttctaatttgtcacgaccggaaataacccaacgggcattccttacgtgcgtgcattattccttgtccc

SEQ ID NO: 40907 - DNA, 993 bp, Oryza sativa
  unsure (1)..(993): unsure at all n locations
agacagtgcacttcgnnctcgaacagaggcagcaacattaatgaagcaagtggttaatcatgcattttcttacccgcataaacactcgtttaattgttcattttctttatggcagcacaaattaaatcttaaaaaaatatagatttgggaaaggcggaaaaaaaaacccacttccctgtcctatttgcatccttaattaagaggacagctataccttctatcaaagtcaatagatagtgtttggttgtttgctactctctccgttttatagtgtaagtcattcagcattgtccacatttatatagttgttaatgaatctatatatatacatatgtctaaattcattaatatctaaatgaatatggataaggctagaatgccttatattatgaaacggagggagtactatagatgatgacttgcaagtctcttaagtttcgaaagaaataatcacgcaattctgtgtttgactgtttgctactccctccatttcacaatgtaagtcattctagcattttccacatttatattgatgttaatgaatctagacatatatatctatctaaatttattaacattaatataaatatgggaaatgctacaatgacttatattgtgaaacggaggaagtactatagatgacgactagcaagtctcttaagtttcgaaagaaataatagcgcaattccgcgtttcaaaaaataggacacatgcatttgtacagtttttttccttaattcctaaggctatgtctttgtacagtttttcctcttacttaatgcaagtacaccttgccggatttaaaaaaaactccgcgtttcaacaacttgatatattgactcatgcaagcacacgtctttgatcatattgtacgactgcagtttataattaaaaattcaccatgaaactgacaactttaccccttttttagctttttcctggaataaaacagagaaccactttaaaatcattaggtacttatatcctatccat

SEQ ID NO: 40908 - DNA, 375 bp, Oryza sativa
  unsure (1)..(375): unsure at all n locations
tgtgtggccttgaattacaanttgatattcgagcttggtaccctcctatcttntctatcaaggtgtgcatgtcactagtagctaccaccatctaaacaccttcaacgcgtagccaccacaccagtgctcattatcggtcggccaataggtaggagctcgacattccgatatgctccacttcatccacgtctttgagttgcagaagtagagggtgagagagaagagtggatccgctctctccagtataagcctgccaacgtggccatcttgtagtggctagccgctgcctcaagagggcatgtgtctggagaagagtttgcttcatgccacctaacgcccacctttgcacaccatcatcatcgtcgtcatctcagg

SEQ ID NO: 40909 - DNA, 1501 bp, Oryza sativa
cactattaatagctggtcccatatgtcatacgtacaatgtgtcttggagtctgtgctacagctggctacaaatgtgtagcccgctgcccttctctcttcttatttatctccttaaaatatgtgtatagttaacttatagcccgctattgtacctgctcttagggacggagaatgtactcccgtgtggctgtgttcttctcaacaagacaacaagttaggaactcttctacacacgtaaaacggaacaatttattagcacatgattaactaagtattaactaatatttctaaaaaaaatagattactgtgattttctaaacaacttttctaaaataactgtgaacatttagaaagcatgcgggtgaaaaaaagagtggatggagctgggaaaaccagccctcgtctccatagagtggagattggatggagcagaccccgatcaccatgcacacctccgccgctccgtcgccgccgcacgccgacgatcgccgccgccggagaaggggcacccacccaccgccgccggcggcggcgcgcggaggccaaaccaaaccacccacccaatccatccccgcgtttaaatttgggtggcgttttttttaacaagttgcactgcatccgcaaaattcgagcaccctgatgattgctgcttccaaagctggcgtttgcagtttgcttcgtacttgcgcattaaacaaaagcggctcacatgtttgggaatttattggaaccgcagctttattacggatggatggaatgcgtcaacgttacggccccgctgttcatcttatcctttttttttatcagttcattcatttattgtactgttcgctgctgctgctcgtccaatttaagcatgccatggttttcttttgcgggaaaaaaataggtaggagtaataattttttgcagagtcagcttttaaatgagcaaatttgaaatagatgaattaatatacctctagattttgaaacaactttttgatagtataaaatagaaatcaatccaatctactccctctgtcctaaaatataagtattttttagctagtgtgtccagattaatagtcaaaagttgctatattttgggacggagatagtagtatggagtacatcaggatgtatccaaccaagcacatttgaaaaaaaattgaatttcaacattttttgtataatgtttaaatgatctggattctgatgatgacgtccgcgtgttccattcaaatgaggggggcacacagtacatgaggtttgtacttgtgtcaccgaaatggcaaaatccaaggaagaaaagctccaaaaaggaatcaaatcaatccaccccaaaaagtccaacccccaaccaagacggcgaccgttaccacgtttcaaacccaaacccacccccctctcgcgtttcaaatttaaatcctccctccaaatcaccaccacaaatcacaaacccaacccccacaatttgaataagacaaacacacaacctctctctctcacacacacagaac

SEQ ID NO: 40910 - DNA, 285 bp, Oryza sativa
cttcgttgagttattcgttacctaaatcagttaggatgctggcaattcatgcccaaatgatgattaccattaaaggatcagttttttgtcagttttgcaattgcaattccaacttctaaagctcattggttcattttgattctgcatcaccatttgtacaactgtggtatgatcctgtctgagcgtatgaattatggtgtagcttatctgcaagcgagtttgtgtaatgtcctattggaataggtcacaactcatttcctgcaagaaccaataaaatatcctatt

SEQ ID NO: 40911 - DNA, 1501 bp, Oryza sativa
ggcctggcttgtaacagtttaaacatacctgctgctcccttccactactgttattctcttgagactgatcctgctgaactggcaccggatgattagcttgctcgatgttaacctcattgctttcattagtctctgatttgatctcaccaccgatgttcaactgctgcgactatcctggaccagcggaagaagattcaccaatttggagtggcttgatacgctgcctctggctactaccttgtgcctcctggaatacagtcattttccttttacggttatccatcctgttcttcttgtcttcaagtcgaattgctttgtcaactagctgctgaaaatcaacatagtcatgggagatcaacgtaactgacagttcatccttcagaccttccaagaacttctcctgcctttcctcgtcagtacgcacatcttctggagcataacgtgccagacgattgaactcatgaagatactctgccacggtatgatccttttgcttcaatgccctaaactcacgcttcttcaaagaaacaactcctgcaggtatgtgtgtcttcttgaatgcctccgtgaactccgcccaagtgattggttgtccttctgctctgttcatccggaaatgatcccaccattctgaagtagatccttgcaactgatgtgaagcgaaaacaactttctcctgatccgtgcactggagcagttccaacttcttctcaacagcgtgtagccaatcacctgcttctactgggttggtagtgctagaaaaggtaggtggcctcacacgaagaaaatcagttgacttgttctgcggcggtggagcattgttgttcccttggttgagctggttctgcatctgctgtatcatcatgttcattaactgagtttgttgagcaagaacttgagcaagagttgggttcccttcattgttattgtttccacttccactggcgtgagtgtttaccatctgttgcagattagagaagataggaggagaggggttacactaaagacaagtccttaaccaggttaacactgatctgatgtgtatagaccattatattgtttaagttgattaagcaagcaacctagtatagttacacactcatcaatgaactactccaatgatgggaatgcaaccatacctacacacaaagcaaacaacaaacgttctaccctactaactattcttcgaggatagtttggcggcataggttctaaggtaggatccaaacttcattccatcttgtccacttggcacttcggtccttcctcgatccacttttcttaacctccataagtagacctcattggcgtcttcaagtttcaatgtcttagaacaactcaagttgaaagagagaggggagtagacaatgaaacaatttgcaaagaattctagataaggaagaaaggagaaattttcacaaatcattttttcggaaaattagtccttaaggtttgaccatttggcttatcctacagtcaagatggctctgataccaacttg

SEQ ID NO: 40912 - DNA, 1501 bp, Oryza sativa
gagtaattgttataaccttgtcttcaattttccattcagctagacaatcaaagatggcctgacctatgacattcccagtatgtggaggatccaactctgcaaagttcagcactcggcattgcattgtccaatttttatctatgtaatgggcaaccaacgccatgtagcaaaggttttgatttgatgtccacaaatcacatgttaagctaatcacttccacactcctaatactcttcatgaggttttctttctcagaatgaaaaaccttcaagcattcacttcttatggtctttctaccaataaactgatatgaagggtttaaatacctcatcacgacattgaaccaagtatgctctaccatcctaaatgggtactcatgaacaattatcatcttagctatcagtttacgagtttcctcatggttatactcactaggggtgacaatgagagggatatctgagtcacctttctctgccgtgaagttgagaacagcttgagccctcttcttggccaactggttcaagtaaggcgtgcacttgttcatgtgcctcacaagatgtgtagtagctcccccagccttgtaagcatacaatgaatggcaatacttgcacttagcctttgtttctgtctcccctggagttaccttggaagtaactttaacctcggtgaagttattccaacaagttgaccgcttcctcccctttacagtagcaactttgggtgaaacctttagcttctttcctcttcggcgtccacccaatgaatcccctccagaagcatcactagtaccaccagtcgctgcctcatcaccacttggcattgacattgacatgtcatcaatgtgatcaaaagaattatcctttgaattatcgtcatcaatctacagttcataaacaaaacagaatttaatcaatgcatatcgacatgcaattcatttattcattttagaactaaggtcatgtagggcaagtactgtaccaaggctattattggagataatggtacatcacaatctttgtatgccatatcacttgtcgtagaccctacaactgcttgggaggaggcaccagtagtagagaatgcagaagcaccgacgacgttaccatctgaagcaccaattgatttggatttggatctatcaacatatttaaagatgagtcaaaattataaacaatggaaaaacaagagtgtgaagtatatgcagtgcagtataacaactaacaaagagtcgcagactcgcagtctcactctcatatataatatactacacaaaacacatggctcaaagcctcaaactatagtattggtacaacatttttgatttatttgcctcattctttctgtaattgaatcattgacagtttgacactgacacacacacacacacgctactccactgaccacaacaatctacagctacatgcctacatgtacatgcatcacaaaaatgagaaaatacatcacgaacctcttcatcctaggctcgtcgttgcggtgtgat

SEQ ID NO: 40913 - DNA, 1501 bp, Oryza sativa
taaggacccaccattgctagatataagagttagtccgttatacccacaatttaaccaagaaaactaagattttttaataaattactgaataacaaataaatgtggagtagctcaagggaatggcatttaaaaatatgttaataggaaaaaatgttaagtcgaagaatagttcaagatcattatatgagtttttgcaattcataagaatccataaagaatctacctagggggaacctccccttctgggggtgttgaaccattattgggaatgaaagtgtttccgagcattagttcatgcctacctatcgaaatgcagcttattaatttggaaatcaacatactgtgatgcactactaaagttccatatgaacaggaaaaacaataccaactacaaataacagaagcatgaagtaatcaatatctgcactgcatcttagtttgcattgttctgacttttgatctgcagttttgtttactactttttacctttatagatgcatggaatgcacactacatccaaaacaaataagactcctaagaatatatgcacttgaactgtttgggaagatgtaggatgagtatgaaagtacaagtatgtccgtcaaaagaacaacatgatttcaaattagttctgatcttattaggttttgcgaatataaaccaataggaattgttgtcaaattgacatcttagttaactttgataatgacagaaggctgtaaagtagtaattgttaggtatccctaactaataaccacttgttaagcacattaactagattcggcagcacaacactattatcaagactggaaccaacttattggtcagaacaggtttgtgatgagctacacaggtacacatctatatctttttcgagaactagaccacaaggtctttctaatataagcccctgttgttatcaacatatttttcacaatataattccctgttgttataaacatatttttttcacaaatttatttcctcaaatcaatctctaatatgaagaaagcttgcttttacaaaatagttgattaggtctcatctcaaaaaggctgattagaaattctaaaggtgcgtgaaagaggacatgttgcatacttgcatcgtactaagcaaccttttccgttgcaaattcaggtgatggttcagaataaagctctgtgacaagcttcttttcatcaatctgcaccagacaagaaggatggaagggaaatgcaacaagttcgttgagttcaggtaaccatgaaagagcggctatgatttcagggcggttggtggtattgttttgaactagttggtaataacctttcttctattcttgctttattaaatatcttacagtcagccggttaggattttgcgcagaacaaaaagctgattgttagcgcaaatatgtattcctttcaccattgaatggaaataaaaatatcctaaatgaaatgtctttgagggtgaatgtgaaaaagactggatctaaaaaagtagcttacttccccaa

SEQ ID NO: 40914 - DNA, 451 bp, Oryza sativa
tgaagcgtagggtggagcgaagcacaagcagtgagcagagcgaggtggcatacatgattgacatggctgaaattttagctcaggtttgttaacttgcttgaagcttggctcaagctcaaaatgataaagatatcagagcatctgatcaagacatacatgatctccacaactcataaccgaactactcctagatagattgtgaccattactaggagtcaaaatttagcgcaccatccatcaagtgccgagcgcccccatcgcaatgaggtgaggttagcaagcagtgcatgttatctagttctcaaccacacacattaatcaagtggcgaggagacaccacctcttttaaaattgtaccactatctttgaactagaaaggtaataccgaagttcacatgcatacctcccacaaggtggacctttgagaattttattttaactactctccgta

SEQ ID NO: 40915 - DNA, 507 bp, Oryza sativa
gacgaagagggatagaaaaacatagtgaaaaggtagggtccgatgtccgtgaggaaaagtaacggtaggatggggcgaggcgagcagggtggatatgggcacgttcccagatagtggaacgcataagagattagatcgcaaaggcaaacacggttaagtagaggtcaccgggcgaaaatttagggtcaggtggggccgacggcagaataaggatggacctggaagcgtcgcatgggaaggtatcgataccaggcgctgtcacccagcagtaccgttgggcacaatgcggcacgggcagggcccttgatcagggaggggcctcctcctccccctccccctccacggcggtggcggcgcccgtctacgcccccacgccgcgggaccgggccctgcggacgccgcacagcgggtaagccgtcgcccggagactgatcatcataccctcgattctgattcagaaatgtaggattcagtttggattcctgctttagctcggattcttcggca

SEQ ID NO: 40916 - DNA, 940 bp, Oryza sativa
tatatttatgatgtggtgctcaccaccgtatagaggagaagatattgaacgtcatagtaagatcaaaatcccaataaaagccgacaggattttctcctctctcttgtataatatagaagtattgttttcccatataaaagcttatagagtcgccacattattttttatcatatataaacatcttttcaatgagatggatagaaatacgtggagaacttcactttcataaattgtttcactcccgacagagaaggtgtctccacacatggaatattgtaagtgatttctagaatgtcaaaaatcatatttaatatttttgcattatattgacgaataaattttttttcctattaaaattttttaagagccaattcctataagttccccccaatttttataatccaagtatttacttaaaaaatttaaattttcctgtttaaattggggtaaaaaataacaacccttaaaaatcaagcaaggttggttctttatgacataaaattaattatgattttttcccaactactaattgtgcatattttttttttcattaaccaaatttatttttcaccaacaatattaataataaatattaatgtatgtactaaaatgcatatacttaacatcatctagttgtttaggggtgctgcttattgtgaacgttccttgtccatactgtgcagtgcttctgtattaaagaattcaagtaaaaaaatgtttatttagtaactggtgtgcctgtaagggagattcgcagtatacattcttgtaagctttgatcctttctcagcgtgcaagttttttactaaataatgagatgtcttatctattattctgtttaccctgatatttcctctgatttgtaacttatcactctctacattgctttacatgccaatggctttcttcaagtaatcaacggttattatgtttcattagg

SEQ ID NO: 40917 - DNA, 1402 bp, Oryza sativa
catttgttccattttatttaaatgaagatgatattaaggtgagtgaaactagtatgtttaccccactacattgaattgttggttagtgcttggctcaacaattccactgatcccattgagggcaatggaaggaaatatcatactgttgacgattcttaaatcataatatctgaccatcaatacttgtatataatgaaataaaatatggtatccaacttagtggtagggattattcctaatcatttccactagtgttggtgaaatatttgaatgcaggtatattaaggagaaaacacgtccgtcatacgacaaaatacacctccggacaatcaggacacatttacatggattggagggcccatatgtcaatcaaaaccacttataattgggccaaatcatagtacatgatgttgggggcccattaacaacctcccagccaaaggagtggccaaaatgtgggtttttgggttcggccaaacctgttctaaggccgttgatcgccatcttccacgtttacgctcttgatttattcccaatgacggttggagggtgttttggacaattcccatagttgtaaccatcatatggaggctataaaagaagaagctcacttcacttcacaacacacacaactttgagctgaattataagaggctctattgtatcttttgtacattaaaaaataggtagagggtgaaggggaagctctgaaggagtgcccgaaagtttggcgctatctccgacttctacctcaatgggtgtagctttctaggaggaattctggaggagtaccggagctgtcggtacactctgctcgggatcttttcttatgttatttaattatttagtctaagatagattttcatatttgcgggttcattgtttagtattcgtactgagtgctccaatactagactctggataaagaaggaagtttctgcacaagtattagattagtaattaataacttaggcatggtgtctaggttagagattacctttgtttattgtgtatcccatggatttgtcagaggtaaacgacagttggtgacagccctgaatcctatcctagtaatcctccacgttcggatgcatcatagagctatagccggaaccatgctggcagactagcaagggtcggtgcccgaagcagcagataggaaattacctttacttagcttaaataattaaaacacatagaaagtcctctttagcctagctagcctaccaatagttgttgtccttggattgtcttagccttaggtagattatacatgttccctgagttcaaaatccttttggggtcacccgaaggtaaagtgcaacagtggtatttcgtgtgcttgcgaatttatttgtggtcataaaaaataccaacaggataatccagtgtacaatgaaga

SEQ ID NO: 40918 - DNA, 1501 bp, Oryza sativa
ccccccgtttttccctctctctctccctcggattcgctcggatttactcccgcaatcctcgccggcgcaatcaatggcggccgagatttccgcggccgattccttcctctccggccgccctctctccctcccgacgctatataatcgttcctcgtgcttcgctcctccgtttccgccactcgccgctcactctccccgtcggattcgtgcccgcgccgtcttcctctctctccgccgtcgccgccgagctccggttcgccgccgtcgtcgctccggacctcctcccgactcggcgtcacctccttcggcttcgccgcgtcctcgtcgacctcgtccgctcctccgtttcggtcgccgactgtcggagcgccgccgtcctcgtcgatccgaaccgcgccgccgccttcctccgctccggttgtcgtttccgccgtcatcgtcgacccggggtgagccgaggaccgttgtttcacttcccccttccgtcccctctctcggccgccgctccgtcgcgccggaggtcgccgccggcgaccatcggggcgcgggcgcgccgcctcccgtcggccgtgccggcgaggccgccttcgggcgcgccccgcggctgccaggtgggcccggccgtcagccgcccgcgcccgcgggtgcggttgacgcgtgggacccacggcgccggtcggcgacagccgcgtgcacccggtccaccgtggaccgagaggctggcgcgtgggccccactcccgtggacccggtccgcgcgccctctctcccggctgacgcaataaatgagtttttaattaaaatttaaatgaagcaattcgcaaatatccatttaaagagcatataaacttcaaatggccataacttggccatttgaactcggaattggaccgttcaagtctctaacttttccttaagaagtcaagaacccatttttgtgctttgtttctgctgttatgtggagtttattagagtaaaagccttttcttttccgttggtcgtgtagacgctacagcttcggaagatccactcttcgtggaagttgaagccgacgtttgggaaagcgagcaaggcaagtcacatcatctttgagcatattgaatcccagtttataaaattatgttgatttaaattattgcattatcgctttatttaaatccccgcgttatcactgttttatttagccatgcctatttacctttgttatgaccatattattattgttattgttattattaccttgttcaccctagaataaacaaaaccccaactagtggacactctactcatggtaccactagtatgattttaggtagatgcttcgcttttaattaggtaacattaggtggttttacaactcaagactttgggatattctcatcacctggacactttggaattgttggtctattgtggaattggattcacacctccccctctattcaaaatccccaaaaatggttttaggctgggctcggggtgcatggttttgatggtagcac

SEQ ID NO: 40919 - DNA, 208 bp, Oryza sativa
cccgtgttctcttcatacacatgaataacatatatggtacaataaaagagaattgtagttttacagcctctgtgcaagtagctttttaagtttaaatggtaaatatttagttttaccttaagagaagtttaccaaaaaaaagttctttcaactgagatgcttatgatgtgtgcttgatgtcgccttagtcaatcttgataggcccaag

SEQ ID NO: 40920 - DNA, 1094 bp, Oryza sativa
ttgcatatttgctgtgtggcttgttgagtatgtcatatgctcaatcttgcaatattcattcatcagaggagtacttcggtgaaggtgatgatctggaggattaggctttgttcgggtcaagttgcttgtggagtggagtcgccatagctgttccatcttttgtttttatttccgctgcgtagaattttattcttttgagaggaactatccacctctgtaataattatttatttcgcgagtattaattagatgtttgatagtactctattatcaatttgttattgtgtgcctcggctgattcctagacgaggatttaacgcacgtgtaagcatttggaattttggatagaaattccgggcgcgacaagttggtatcagagctaccttgaccttacgataagccaaatggtaaaccttaagtagccttcaaaatattttgaaaaataggactgctcttctctattctcttacaaattaattaagttggcagcacatgcaaggttatgtaccaaatttactaaatcctactttaccaaaacagaaacatgttcttttatttaaaaaaaaactttactgttcagggtattaaatagtttaattttctgaatttcattggttagtcggcactgtacatctattatggtatcgattcaatcaagatagcaccagcactactcatccctgttaatggtgacactataccgtgcttatggtagatcctaagtattttagttttgttttattcatttgtctaaagcaatttgtctctgtccaaagttgatttcattttccaaacaaaaactttgtttagttccgtttccacgagtactgtacaggaagaaaatatatttgcttctttttgtttacttccgaagtctgtgctcctgtataaataaaaattttcgaaaaaaaattcagaaaaacaaattggtttctgaaaatttatgtttcggtcagaaaagaaaaattcgaaatttaattagttctgtttcctccttttcttttctttttctttttgggtcaaattaattaagtctagtatgtgcagctaacttaaatatatgcataaattcctcctttctatgttcctttaga

SEQ ID NO: 40921 - DNA, 322 bp, Oryza sativa
aatactagatatcttaaagctcctagcttgccgcaaccagggcgatttggactccgtcaactaatcgtatcgtgacacgtatctgcaaacctagttgatccacgccattaatttttgcagaaaagcccttaccattttggtatttacgattgagtccatcgaatcagagccgttcgatatcacccgtggacataatgtgatcgttcgtctcccatgtacatggttccgtccttacccagacgtggaatccacgatctctcgtctctccacgtcgcatcccaatccccatctcgcttatcgcttctttgaccggaggcgccga

SEQ ID NO: 40922 - DNA, 327 bp, Oryza sativa
ggttggcaatgcgccctgcccctgattgactaccggggatcgatagatgagacgatcgacgcgatggagtgtggaaaagtaattagaggaggggcgtacgtacgtgtcgccaccatgagactagtcctccagcgtacgaggattagacgtacctaccgtcgatcacgcacctctagggtcgctgccgatcaccgtccatgtcatgtctgctgctgctatacctatagaaatgctcctctccaaccataaaaaggacccagccagtgctgccattttcttctctccatgatcaggcagtgctatatatgctagctagtacacacagtc

SEQ ID NO: 40923 - DNA, 652 bp, Oryza sativa
gaagtattggaggaaaaagtaaaaagacatatttgcaaatgaaaaataatttatgaataaaacttttatatacaatgttcttaacgatctgaaagcaaaggctaaaaataaggataaaaatttcaaaattaacttcagatttaagcttaaaaatttaaattttgatcaataataagtataaatataggtgaaaaaatgaggatactatgggcctgtttgggggagcttaagattttaagaagcaactggttggtagtcagcttcttagaatctggaaaagccgggtttcccagtttctggcttctagttcattttctaaattctacaactacagcttctcagaatctggactaaaagctagactgtttgtgggagcttctgattataggagaaactgcaacagctagaaactcctccaaacagaccatatagttggctagagatgttgtagcctttctctcatataaaactcttgacacgaatttgatatagtaacaatttatcccctcacaccaccataccaccttgaacacatgcacaccataaccagcctgaattgccattaattttgataatttgactctttgcaaaaactaattttacaaataaaccgccgccaaaacttatttcaaaaatgacccttttgttcagc

SEQ ID NO: 40924 - DNA, 313 bp, Oryza sativa
  unsure (1)..(313): unsure at all n locations
cacaaattaggtgttcgtattatctaaaaatttccgcgtctttnntcataataataattncgaattttgtctatatatataaaatttaatttcttctcttccnnncccccnnncatgttgaatgcatgtcgaccttgacannnaacaaacgggntnacagnanaacttagcagattgtgaccatcagcatttgcagaaaatattagtacatagtacttgaagacaacatttttatgtttcagaaaagatttcctgcaggggtctacaaggaaacatgcaaactagatactagtgatataatttcagatgccat

SEQ ID NO: 40925 - DNA, 1501 bp, Oryza sativa
ggaacattggacttatcccttcgccggagatcgaagacgatgcagccccacgtcgggtgccaagttccgtcggaacgtaaaaacaaaagtagaagtaaaaagggtggcgatgcgccgaattgtattgatcgtgaagatagattacatagactccgggtgtacatatttatacccatgggttgatacaagtccttgtcggacaagaaagaaactaacctaaagataaaaggaaaacataaagtctttatcggacactaaacacactttcctaaagataaaaggaaactaacaaactattcctaattaatagataaattgccataccacatcctctttaaactcggtcacttattgataagcttcctttagtagattgatttccttaaccgaatatagcaggaatccgactattggcgacttgataactcccatcggctgattccgagatgctgcagccgataatgattctaaaccgatgacgtctttgccgattaccaaatttcactgttaacagttgccaaggtggcatgaggcgccattactttctctctcttaatcaaactttaaacaaaattttattctaaaatatatatccaatctataatttataacaagatctcacatgaatatattttgataaaaatatatatgcgttctagaagaaaacaaacttatgttgaactatttaaaaataattctttcatcacttgtggagatgtttcaacccacttcacaaattgttccaaagaggtacaacatataaaaagtattgacggcaacaataatcattattacatgaaacattaagtcccgactagtgaaacattttttatatttagattgaaacatcgtattataattaatgtttaaacataataaatgtatttgctgaaacatataaaaagggatagcatgaaacattgctaatgaattagtgaaacatcaacaatgcttgttggaacatttcagtaacaatgtgtgcaacatttgaaaagtaaatttaaaagtcgtcggaatatagtcatgtgatatcttgttataaagatttaattgtaacgaatccaatgatataattagtttgaaattcggataaatagtttaagagaaaaaatcatttaaattttaaaacatgtttgaatgcatgctccgttggtttgtcgtacacctaaccaaccgtttcaccatgcacctacactgttgttattttagattgagacgtccaattttttatttctggccggacggccgatggtaagcattttcgggaaaatcccccttcttgcgatcgatccatccatcgatttaaatcgatctccgcagcttggcctctcgagagagagatcgggatcgagagactacgaggtctatcgtccatggccgatcgagacacatagctagggtaatttgttgtgtgtcgtggtggggggctcgatcgatcgatcgatctccatggagaaggggaagaggcggggagggtcgtcgtcgtcgtcggggccacagg

SEQ ID NO: 40926 - DNA, 815 bp, Oryza sativa
  unsure (1)..(815): unsure at all n locations
gtgggatgaatgctatacagcttcgnacccnagaggcccggtccatccaaacttgcggccgcatcgcggcatccaccaacgaggccgtcatctcggcccgcgcgcgggcattgggccacgggggcatctcgggcattccggcccacgtatcggtgtaacggcgaaatcactagccgcacacgcgagcggagccggaggaggagacggagccggcaggatccaccactgctccagctttctccactctcactccccgattcgccggcgagcaggcggcggcggcggagctcaaggcttcctctccgctccgcaggtaaacaccaggcaccatcccctcggctgtggctcccccgttcctcttgtcccactctctcttggccccgaccctcgggagtccggcgctaccgaatccgtcttccccccggagctgtcgaaggagcgccgcgtgcggccgtgctactcccaccgacgccgcgtcacctcgaaggcgaaggggctcttctcccctcccctccaatggactgaggcgtatcccgtctaggccgatttcttctgttgagacggaagccctaacatagctagattgctttttccaatgatttgtcgcttgctaccagcaatcaaatccttgtgttattttttgcttgtctggggccactccaatccacacatatagtcgcatatttgatttgattttattactcgaatggcagcttgctttgcaaaattttcagaagcgcaactgaaccctcgcgcctgatatctaaatagctgctcacgaatccacctcccttattgtgtaccaggtaccaaga

SEQ ID NO: 40927 - DNA, 532 bp, Oryza sativa
ctatcggcacggaaaagaagcgtcgtaggggcgtgggatcggatggtgactttgcctgtccaagtagacatttaccaccttttagttgtagtgaccttttagttgcagtgacagagattttgactgttgcgcctcgtgagccatgtgggccacacccatcacccacccgcacgcctcgatcgattaaccacccaaacaacgccaatgcaagcagctcgttcccaagttgccacaacacaccatgcatcttcgagttcgactcgcgggcgcacttgtggagattatgggtaccccatacccacacggcacggttatccgactagttataggggataacttatatatatgaaatatgtaacagatcatgacttgggtattacgtttccttgtatattacggaacggcctaaagtcctggtttgataagattgtaaagtagatttaggaaaccgataccgtattggataaggtttctatcttgtaatcatgtcccccatcctatataaggtgggcaggaggccctctagggggca

SEQ ID NO: 40928 - DNA, 1501 bp, Oryza sativa
aggagggattaccacaacccagttggtggtgtctttacacataggttggtgataatatcatgagtcaaataaatgatgattagatgtctagtcacatgttttatgccataagaggttaaggaactgctccatccgtccaaaaaaaaagccaacctagaaagggatgtgacccctactagtataacgaatctggataaaaggctgtccagattcattatactaggaggtgttatgttttgaatagcacgctcagtacattaagaggattggtatcggaggtaaatataggacggaatacaacatgataatgacatactccctccgtccaaaaaaaaccaacctagtactggatgtgatatatgttagtactacgaatctagacatatctctgtccagattcattatactagaatatgtcacatccagttctagattcgtttttttcagaactgagagagtatgcgaatgacaattgagactaccaggtgaaatatggtatagatgtacgaatgtagctgttgcacgaatgttaaattactagttgctccgtttcatattataagactttctagcattgcccgcattcatatagatgttaatgaatctagacatatatatgaatctagacacatatatatgtctagattcattaacacctatataaatgtgggcaatattagaaagttttataatataaaacggaggaagtacatagttttgacggctgcattatatgtttactatatatatatgcttggtagaggggctataattttataatgaaaaagcaatgttgtgcccagatcaaaagtaactaaagaagatacatttagaaaaaaaaacacaaaggtaaacacgtttgctttgcttgcttgccttcttatttaatcattgtggctcgattaggaccttgctgagatccataacagtggtgtgtaacagtctacctgttgatggacgtgtccatgcattatcgggtctcaatcgcctgctgaatcacatgacattgtctgaataataaacaattaaacaaataatgagataatcagtaactaatttgaacatagacaatgtcgatcttttcgtttttttttcttttgaaacaacccgtataaaatagtgagatgtttttattgataaagcaataataaaatataagtctatagtcctataagtgtaaaactatagtcaggagaaaagaaaatacaactatgccacgtgtctacatttgattctaatgatagaaacataacatgtattctaaacaacgcctccaagaaaaaaaaaaagacgctaagagggtcgtcgtcgcctgttctatagagccagattagatatgctggagttaattttgagcacgagataaacgggtgccacgtttctctacctaaccggaattaacaatacggttttaccatttggaccgagcctttttttagtactccctccatcccaaaaaaagtcaaattctagagatgaatctagacacatatgtgtacac

SEQ ID NO: 40929 - DNA, 1501 bp, Oryza sativa
ccccttcaggatatatttcttgtacaactctcccttgaagctctgaaactgttctgccattttcttcagagtccaccttttcactttgtcctctgtacctgcgggaagggtgaatgtctcgagcattgtggtccacagcatctctttctccgaatctgggacagagctctcatgatctccgcgtgcccttgttcttcgccagtacaccgtactaacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgtgtgccctcttctgtccaacggagggttgactaccactagcctcctcctcctggttcccctccacatcactttccacgtgcccctgctggttcccctccgcatccctctccacgttcccttcctcgttcaagtactggtttggatccccattcccctcttctttattccagtactggctgcttccctccgcgattgtatcatacaatatctgttcctcatcgtggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcatgacataagctaagtctaggtgacgtatattatacaaccctagctagtaaataattatatactaagtctaattacaaataaaataatcttatattaaagctcaaataatattacatgctaagactaaaatagtcatgtatatgctaagtgtttcgtgcgtatatgctaagtctaattaagactacaatagtcaattgctaggagtcgcaccaattccgtagtcaataattgcatactaattctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagttgcaccaattccgtagtcaataattacatactaattctaattacaaataaagtaatcttatattaaaactcaaataatattacatgctaagactaaaatagtcatgtatgctaagtgtttcgtgcatatatgctaagtctaattaagactataatagtcaattgctaggagtcgcaccaattccgtagtcaataattacatactaagtctaatttgcaataaaataa

SEQ ID NO: 40930 - DNA, 386 bp, Oryza sativa
  unsure (1)..(386): unsure at all n locations
taagatgtaaaacgtttattatatctgtttaacnctctatttataaatttcgtgtgttgttgcaggataaattctccccccccccccccccggtcatgtgacaactgtgcaccnccggcnaanaaaanacaaacaggcgaggcagccacgccgcgggcgaaaccaaccacggggccgcccatttcaaaccncccggacgaccccacgagcgagcaagcgaccaagnggacccggagnacccgcagcgccaaaattattttttccacgacctgcagattcaggtaaaggttcttcgcaggtattcaataagaggtgctctcatcttgtcaaccttccgacgtggaccgcaccgcctcagggatttcaagttgtcccacccgtctggc

SEQ ID NO: 40931 - DNA, 371 bp, Oryza sativa
cgctaacgggcggtgtgtgcttgatggagtgggcggacttcaaaatgcgcacccaaaatccctttaaataggcgcacccccgacggtgcgaattccaaggaactgagagaaatccccgccggaaatttctaggtccattacgcgcggcagtttttgacttaagttcaaaattcactcgtgaccgttgggcttcaaacggcatgttcgactacacgtcatctccgtggttctcgtacctggaatgataacgttctcgacacccgaagtcgcgaatggtcgcacgagttcattttgagcagaagtcgggagctactgtcagggttacgggtcaggcataccctctacccttcgatatacgttacgtatcgaca

SEQ ID NO: 40932 - DNA, 215 bp, Oryza sativa
gagaaggaaatatctatagtatatctggtactgcatccatttcatattatagggccggttcactatgatgccattttcatctcttaccaaacctggtaaagatacaaaaaaaagtggcttcatttagtttgctaccaaattttgctaattacataagacatcctggccaaaatttgggcagctaccattctggctatgccaaaatttggtaagga

SEQ ID NO: 40933 - DNA, 201 bp, Oryza sativa
gcccggaaatgcaatggatctggttgagccaactctaagtttgttggggggtttttagtaagaacatgggatgctcatttgttctttatgtaaataaatccttttcttcgggatgagctcttcagaaaatgaggcggctcttcttttctgcttacgcaaagggcctttaattctgtgtcatacctatatttaatttgcagg

SEQ ID NO: 40934 - DNA, 1098 bp, Oryza sativa
  unsure (1)..(1098): unsure at all n locations
aacccaaaatgttgttttctttcaataaaaggttgaaattccccaaacaaaaaagggcctatcgaattttgaggtagagttgggaaacctattaacaaatggttttagaggagagaataatgggggtaacaagaggggtttttaccaggttcacccaaagcctaaaagcctatttataaaacagggaatggtgggttctaagaaaccaataatccgcccttcggtggtccctgccccaatgcagagggccaatattgccagggtactctggggtaattccaattgtttttgtaggatataaacggtttaaccgtgtaaatcgaaaagcaatcttcttttccaagttcaatggcagaaaagaaaagaacctaatgcaccgaatccaggggtgacatcagtttgcccttcaaattgacccaatttctccaaattgattagaaaaaaaggttaattcatcggttggaagcatctcaagtagtcataattcttttgttctcatgcaagtgtaaatacgaactggtacataactgcacaatttagttagtgaaagtgtgaaccccaataggtttgtatagtacatatatgtgtgctnccgcatgtttggcaactttcaaataaatatactataccatcttataagttccaaatgaaaattattattataatccattctaataattatatacatgagtgcatgagatcaatctacgtagcctacgaatacgcatgcaaaataccttggtcttttacaaaagatccttcaaacaacaaacatgttttcgggagtggggaaatgggtgtagagcacacccatttgcctccaactccatctcaaaggaagataagtgacgttatgtgtccatatgatctttctctagagacttttaactctgtgggagcaatttattgcaggggcctatacccttgtggttttcatggcaagaatgtaacaactgctatgagcaataattctagtctctcagttgttataggttttactatagttttaacattaaacacaaattttgttatatttaacatgtatttctgttaaattgatcttcactatttgctcaaaaacccttttgcttgtctagc

SEQ ID NO: 40935 - DNA, 319 bp, Oryza sativa
  unsure (1)..(319): unsure at all n locations
accaccacctcacttctaatattatatatatatgaagggtagatattatcttanataatacttatgtaggggacgggtgtattaattaaataagtgtaagggtctctttcccnctcnccccgatgatttgcactcacctccaaccggcacnnncngnganaaatcagatccatctcgggttcctcccgcccttggcagcaagccggagcttttttccggggaagaaatggcgccgtttccgtgagttcttggcaggttgggatgatgcttggtgggtaggaggactaggagtgcggcggctcgggagaggctgtgatgg

SEQ ID NO: 40936 - DNA, 1501 bp, Oryza sativa
ggttgtgaaacattaaccgtgccaaccacaagccagcgtgggcaacggctttatcttttgtatagcatggttcattgcggggcaccagactgagaagtgggggagatgagcccacgggggtcggtggggagtccatgccttatttataagggggggaatatgatccaggaaggtgcgctccggtagattgtgttatgcaaggggtattgtcacaactcctttccgaggtaccctgtgggggtattgaggcacatggtgacatgatgtggggttgtgtcttgtgggtacagtggtacacctctgatcagagtaaacctattcgaatagccgtgcccgcggttatgggcgggtctaacaatgtctttcgtgattagtctcacacctctcatcatgttaacagatgctaattggtaataatttgattagctcctggtttggaatggtatattcctggtttggagatagatctgtacagccgggtatggttgttcagaatggttgggcctatacaacagggtatgttgtatagtgttggattaatattgtttaattattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttattttattttccactgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttatccatagaagctctctaaaaatattggaaaagtagaactgttctcctccctttctcttttaattaaaccaaactactggcacatgcacttcataatctcttttaatggttctcattcaaaatttattccagtgttattagtactgtacatctattactatactaatggctcatttaccagcaaaagttttacaatattgttttatttaatcttactgcactgaaataaatttaacatgttgattttataactttctttcatttcttttgaaacctgttattcaaaagcacaaaatttgtaaccttatttccaactgtttcaacttatcttgcaagcttggtttattttatttacttacctttttactttgattttctaaactttattcaaattaatccaaaaacttgtgctattaattggataaatgtcttaactccctcctttcacttgtctttaga

SEQ ID NO: 40937 - DNA, 210 bp, Oryza sativa
tgtgccttgaacttgacaataagaacctaccaatcctggaggcactagctataagtggatgccgggggctattttctgtggtaggattgttcagccttgaatccctcaagcttctaaaaataaaagattgcccaaacctgcagtgccctttacaaccacttcaacagcagcttcagtaatgtattatcacgaactgtcctcaattacagg

SEQ ID NO: 40938 - DNA, 198 bp, Oryza sativa
ctggtactgcctcaatgcatataattggatcgatatttaccaaacggctaaatctggatcttagctgccgtatggttcataactagcgatcattcaaccaaggttgcatacacacattcaacttggggtacgcgtgaaatagctgtacctttttactaccctgtcttgctctagacaattgcaatttgtcaccataga

SEQ ID NO: 40939 - DNA, 1501 bp, Oryza sativa
ccaccacgccgctcgctgccttcgtccccagccaccgccgctgcctccctctatccccacccgaactgctcactgcttccatccacgccccatagctccggaagggcgcaaggaagacagtgaggtagatgaggtcggcgacgctgctgtccgattcctcctgctttctcagatctagcggcgccgagctcggggacgcctgatccggcagcccgcccgctgtagccgctaaagaagaggtagaccaaatattgtttttcttttttcttttttttttgggaatttttggattggatttgtttccgtaagcttcggttcttgttgttcgtttggttggatttttttttatgttttgaattttttttcctttctccgattatgaggatgcaaagaacgcgatcggatttagggacgacgggtgcgatgggcgcaacggacgaaaacacggaacgaacgtgtactgactacggatggatgaagtaaaacgaactcttcaactacgcacgggacgcggacgaacgagaagttattaattttttaattagttgttattattattaagttattattataagatttagcatagcagcaacaacatcataaatcagttatacccgtaaagctacgatttttctcttttttttgaatttttttcggctcctcggagaggtttacacgtggttggtaactttgcaaaaatttatattactccggttgagttgttgtgtacctaacactgtgagtgagttggaagaaatttgcaatttaatttgggccgtaacgggatttgagatgaggaaagcccattagacccaaagtaccagcaccataaaaaccctagccgccctcctccccttcctcacagccgcctccactcctctcctcttctctcctagccctagccctagccctagggcgcgcgttcgctcaccgccgctgccgcctcggcaggtaagcattgatcgatcccctcgccgaccgtctctcttttcctctcttcttcttgaggcaggtttgccttgtatgttcatcgcgatcagtcatccacatgcaaagaacacctctctttttttcttttttgttaatttatcatccgatctagcaggatggaaatggttttcttcaaatcttttcagtactgagtgctctagttttgttgcgtctagcttcttgatttgccttctcatagatcggatgttccttttcagtattttgactgcacatgatttggttgtgaggatagcagtaaaaatgaattgatgtgttcttgataatagccataagtaatcatctttggtatcatcctaaactcgatttggttggtttggtatctgggttctgtgaattttccttgggcttattaacttctcctgacatagttgctggaagatttttggctaagattgcatgcgcttcagttttttttttgttggcttctaacgaggaggctcctttgctttttgtaaacaggaatttgcatccgtagcgtgatcttcaaagg

SEQ ID NO: 40940 - DNA, 1501 bp, Oryza sativa
tccatatagaaatacaattaagaaataatagaaattcagaattaaaaataaggaataatagaagtagagtatagagtccatatagaaatacaattaaggaataatataaatttgaaattaaaaataagcaatattagaagtagagtatagagtctatgtaggaatttaaaactaagtaaaattcgaaataaacataataaaattaaaagtagagttttgagttcatataaaaatacaatttacaaataactaaaattataaattagaaaaatgggatgaagagtctaaattcaatataggaatacaatttaaaagtgactgaaattcgaaattaaaaattaaagaatattgaaagacgagtttagagtccacatagaaaatagaaataataaaaattcagaattaaaaataaataatattagaagaagagcatagagtttatataaaaatacaatttacagatagcaaaaatttgaaattaaaaaaagaaatattaaaagacgagtctatagtccatataggaatataatttacaagtaaataaaatttgatattaaaaataattaataaataacacgtatataaaatacaatatgaatattacacattagtagtttcgtaaagttagtacaaaatttaaaattatgttgtcattttaaaatatttgaataatacattgagaaaacgtatatgctattatatgagagaaaatataatgatgctagccgcgcaatctgcgcgggccaccatgctagttacacatattcaaatagataaatcgtagtggtaattttctaaatcaaagaagttgtagtggtatatatggatccaattaacaaaaagaaacggagggagtataaattagaatttagacttccagtggatgaaatcatacgcccatgactccaccaccatagtctccttatagtactggtgttttttttaaaaaaaattcccaatttctaaagatgaaccttgacaagagcttgtcggattcatcacaagaaattattctattttggaatgagagaaagtactactcactctgtccacaaatacaggttctataaaaactcacatctataagggatggaggccagggagtaacatccaaaaattgtcaaaaacaaattgtttaatcgacttgtctgcgttttcagtattgtaaaaaaaaatcagaaactaataaaacatggtaaatatctagaaatattatttcctgttaaatatttgtaccatatgatatatatatatatatatatatatatataataaaaaaatgctgctgcagtcagccactgtctatccacccaaccagccactgactgaagcttcaccatccccatccctcccatggccatggccgccgtcgccgcaacttcgccgacgacgacgccgtcgccaccgaccacgcacccaccttccacctaggcgacagtccgctccctgaccgccgcgggcaaccacgccgccgccctccgcgcgctctcctccatcacca

SEQ ID NO: 40941 - DNA, 326 bp, Oryza sativa
ttggtccataaaagcatcctggaaagttaatcatggggccagtactttgtctctagctttacacctttaataactatcactgcaaacttagctttgattaatcacttaataactaatacaacaccctctttatgtgtggttccattgtacgagcagctcctacatgacaatgccgtgaaaaagagaggacagcctgatcaagtgagtcctcatcccttagaacgatacatgtactctcatcgatttaaatttcatgtaaattacaagtatacataatttagcaaaataattgtaaaatactaaatggtgcctacgataattttgtg

SEQ ID NO: 40942 - DNA, 184 bp, Oryza sativa
caatccatgcacaaattttattatccgagcattgcatttcaagtttgaaaataagttggaaatatgtttaaattcattatttttacaaaaagatttactgctgttacatcattgcttgttgaagcagttggtggtttgtccctgccgctctcgtcttctcacatgatcttctcttctgtctagt

SEQ ID NO: 40943 - DNA, 1501 bp, Oryza sativa
acatttcatagacacagatgggctcatttctcattcactcagagtgtcaaaacagcgatcatgcgtccacaagtacgctgccggagccagtgagccaccaccacatcgatcacgcgcagctgcgcgcggccgcacataggcgaggcgcgaccgacttacctgctgtccggacaaggtcgcggaggacggcagagcgcgcgcacgccaggtgttcgacgcaattacatcgagaagaaaactctctggtagatagaattctcatctcggcttcggctgtgtgataagcaaatggtgaatttttggtttgctgtgagtgacgtctgttctttctgggtcttgaccagatgtcagcctgcaatgcaggtcatcaaagcaggagcatatgagcaccactgaggtcaggtagcagataccgaggtaactttggtccatcgttaccatctcagcagccacgggttccttgtgtatttgtcctaggctgacgcactccagcccttttgttttccaacaatttgcactcccaagtcccaactggcaactgctgttgacatttaagttttttagatcaaaaggctaccgcccagctttacttgaaaaagcataagatgtctggatacaggtttaaggctggggattccagcttacaagacaagcatttagccaagtctggcaacataagctgctggcccagcagaagcagagacaaaccagagagagcgccaaaactaccaccagattactgcacatttatccggcaaatcagctgcttcttcctgcttcttggatactggcatgcagtgaggccctcaaagcttccagctctcccctcaatttcattgggaccagatttttccactgtaagaaaaaagataaagctttatacggcacatgcataatgtcagaaatgttgacatttaagttttactcttgaatgccgattacagtacgaatcatatgatactctcgagctcaacttcctggaaggtgcaagttgcgatatttgatggttgatgcttaccacaaaatatagtctaaagtgtggcgtacatgagttcaccccatcgccattggtagcgtgagcgatcagttcaacaccgctcaacaactattcgacaaaacaccttcaaggcatctccctggcccttgtgattcctggctggctggctggttgcgaagaattaattcaggttccttctctcgtatctcttagattaatttgatgggtggtttcgatttcatacttccataagaagggtgttcggctatatcacaaattagattgtgtctatattacatttttatttcagtgctagatggatattttgtttgaaagctcacacaatcatttgttttcgatttaacacaacttttcagcaataccagtgcaaagtttgtacatatgatgatcgatgtttcacgtccaatcccacttttcaggtccactgataataactgtaattgagccagctatatttgactgcaagatttgaggactggatgg

SEQ ID NO: 40944 - DNA, 347 bp, Oryza sativa
tgtgcatttttattatgcaaagctcaatataggacaggtactttttttgttggggaaataaaagaaaaatcaagaaactccatcaaaacaatgagcttctggtttatattgttaaagtttttttttaaaaaaaaaactgcgacggtattgagagatggaaaagtttgaccacatggccaaaacagaaaaaggtttgcagattacaaatcaaatgaaagccacaaagagtgaagagcatcttcaagcagagcacctaaattaaagcccccaaagagtttttgaggtgaagggaaagaaaaataaaggtccaccagggctcctataaaaggccccaaaatagggaaagc

SEQ ID NO: 40945 - DNA, 186 bp, Oryza sativa
ttgggtagagtgacacgaagcaaagcactcatatatctcatttaatcatttctagactaagcataagaagaaatagaaaaaccgtcatttcctataattataatatacactcaattttagtctacatctgttagtatacaaccatatagccaatacccctaatagtgcactcctggtgcttctaga

SEQ ID NO: 40946 - DNA, 1501 bp, Oryza sativa
cagtacaaaagtttggattttggttaaaattaaagatgatgtggctgaaaagttatgtgtgtataataggttaatgtgatgaaaaaagactgaagtttgtattcaaactttatgggtggacagacagaacaatatacagtgcactaatgtgcaggccagcaaacatgcataaattttgacatcatctttctctttcctctgatgagcagaggctatgcttgaatgcttaacgctaagctgaccaataatgaaggcaataaaatgaaatgaaaatcaagcagcagttgctgctgcaagtctgctcaactcagataacacttgcactagcaaagcttcttctagtgacagtgacagacatggaaaaagttgctaatccattgagtactctactaccatggtaaaggggacaaacagataatccatactctcatcactataaacaaggggcgtttgcctggtgcaagacgtctcttctacctgttccgtggaactgtggggttcctcttgtgcttatctttcattcttccttttgatttagtaacaaaccatggaaatctgaatttacatcaccataacacctcaatttgatctaaaacttaacaacaaagcacaaatgctaaataattaccctgagctcaaaaattcaaactacaaactaataatgctctcaggagcagattcggacatagatacaggaacatacaagcaggctcactcacaacatgcgaagactactcctgaagaaaagatcaaatctgcagacgaagtcgatcaccgtgtgtccctggagcggctggcaacatgcctgagcagtgcctgccctgactgatgcgcgaaatgcttctgcctcagctgcacgtacgggtagcagaggctggacaggatgtgtgctggcttcgagaaggacatcacctcgtaccacacctgatcgtcttcgtccagctgcaccgagaacctctcctcccctgcctgcaaaccatcaaaatatgatcatccaactcattcagtaaaaaaacacctgcaactctgcactgcattctgaacattttacattactgagtagtgagtactacaatgtttcattgttacttgatgagattaggaggcaggcgtaccagcagatggccttgtagagtgccgctaccataagcaaaaacgcagccttttccatggcctgaggagttgcctccattgccatcggtcacataggcaatctggaggggcaacatgacccaagggatcagctccttgtaacaaatgcagaaccttgttccagccttcaccggtgtgtcgggttccacatttgcccagcctagtgccaaatgcctagatatacaccagtttgcttggttatggagaccagatgaacaacataacaaaatttgtagttcttgggctttacttccaggagagaagcgcggatttggcatggttgaaggtggtagtgccagagccaaccagaacacgtgaacggttcacgaagaagccgcgctcgacaagc

SEQ ID NO: 40947 - DNA, 584 bp, Oryza sativa
ttttgtccttgcaagacagtgacagcatacagtgactgcctttgatcttgttccatgattacttttccttatcttaccaagtagtactttaatgcctttatttccctttcgactttttttttctctctttctcactctgcatctgccgctttcctatactactacctaatctaatctgcagccaattcatgcttcctttttgttcttccatgattgccttgctcatcacctccaataacagtacgtcacattggtgtcatatgattcataggttaattgattatcataatcaagcaaatataaataggatcatatctaggataagagtactttttgggagattatctataggcacctatccaactagtgctgagcagaatcgatcaaaaattaattctgcgtaagttaatgaatcaactagttgagttggtaccaagaatcgaaatcgtgcaaaacaaaaaaactttcttgaaataatttcagttccttcatgagcaaatttttgacaaattgatgcccatcaagtctgaagatttttgcatcgtggggttgcattctgtactaatttcacttcaatttccagg

SEQ ID NO: 40948 - DNA, 1501 bp, Oryza sativa
ccatttctctgtttagttagcctagtagacaccattgaactaaaaaatgaacaaggaaggtgacccttaccaggtctcctgagctcatctggatcagcaagagaatgccctctgaaccggtaagtctcacactccacaagagtcggtccttcacctctccttgccctctcaatggcctccttagccacctccctgaccttcaggacatccatcccatcaacatgcacgccgggcattccaaacgctggacccttcttataaatctctgggtctgaagtagccctaagatgcgacatcccaattgcccatagattgttctccacaacaaacacaataggaagcttccaaagctgagccatgttcaggcactcaaagaattggccattgttacaggtaccatcaccaaagaatgccagggttacatcaagtccatcagggctagactgcttgagcacctcatggcggtatttagcagcaaaggcagcaccagtagcaacagggatgccctctccgatgaaggcaaaacctccaaggaggttgtggggttcagagaacatgtgcatagaaccaccttgtccacggcagcagccagtggccttaccgaaaagctcagccatgacagaacgtgcagggacacccttggatagggcatggacgtggtcacggtatgtgctgacaacacagtcagcttggttgagcagcttgatgaagccagtggagacagcttcttgcccattgtataaatggacaaaaccaaacatcttgccacggtagtacatttgcgcgcacatatcctcgaaaatacggccaagaaccatgtcctcgtacagctccaaagcctcttcccgcgtgacagcctgtggaaaatgaaacgatatgaatcaagaaggctactattaacacttgtaacagcagacaagatgagttttccctatcgaagcaccacagtggctacaaaattgcaagctgcatttcaagaagtgaggcaacattctccagttctgaaattgcaaggacggatccttccctttaaactttgcatttccagattccatcaggtttagtagtaaattgcatcaccaaattcgtggcaaacaatgaattctagttgcttgttggtgacctcttatttgcactaaagaaatctcaatcgagaatacaaaaccgcttaaaaggttggacagtcacagtaaggaagtcgccaagagggcagctttccggaacactttcgatctaactaaaagaaagtgccatttttagtactgagaactagctgctcaacatgagattcagtaaagtagcctagcataaaaaaaattccaagcagcgcgtgtaatcttaactatgttctagaattaaaccacctcaggaatgacgacgaatctacaaaccggaacacccaggatcggaaattttaccacatctcaagtagctaaactgcggcggcgccccgcaagatcggacacacacacacacacacacacacacacatatatatata

SEQ ID NO: 40949 - DNA, 1113 bp, Oryza sativa
taattgtcggtatcggaaatggaaacggtaatctttttcggaaatggtagcggaaatgatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctagggcaccgccgcgccatgttgggcgccgccaccaggtcgccgacgccggccgcaacctccttcgccccgacggccttcgtcgcagccggccaccttccctcccccatgctccatcgccggcttccgtgccaccgagccaagcaccgagcgccgccgcaccgccccagcctcctcctccccaccgatgccgcccctttctcctctctccttcccccaccgccgccctgcgccaggccgccatctccggcgcctctctcctctcgggcgcgcgtgaaggagccaaaggcagagaagagaacgagagagaaaacagagaagaaatcgagagagcaggaaaaggaaccgagagaagggaaggataagagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatccatcaatctaattgtccacttattaatcatcatataacagcgtatggtaggagctgcatgatgcaagggtga

SEQ ID NO: 40950 - DNA, 1501 bp, Oryza sativa
aagaaaaagttgtttgtgtactaggcggtgtagtgctagcataacaaaataatggaattatcaacctaccaatgtgagtggttttcttcctcatagatgcattaattctttggaaaacacatacaacattaatcaagtagtagtattataaaacaagcttaatttgcactatctattcactatctacccacattgtaagtactaatgtaaacagtgatagtataaattgggctattgttttactcaagtagatatacatatcaacataaataccgcttaacacgttaaatcaatttgagaaaatcatattttcttcgagcatactctagctattcacatgatagaactacatctaaatttatcaaatacacattaattttataactgacataacaatacaataaaactgtcattttatttaagaccttaattgactgcatcaaatgagcaatcatgtatgccttgagaatttttttttaaagacaaagcaggacctataccaacattcattgaagagataaaaaatttttgctaattagagggaagtctaccttagacttcaaactccttatgtttgcaatatagctaccaattaagaaaaacccacatgactgaaaacactacatatgttacatatgttagtcttggcttttacacatttgggttttaatgtacttgaaataaatcaaaagtgccttatttttttttcttttttttttttggcccaaacctcttctcagtcaatttcacagtcaaatttgttggcctacccacggaaggacgatggatagactaagtccatacgaggctcctagcatatatgcaaaactaatgaaacaagattagatgccttgaaattatcttagagcattattaattgttaacttttgcatgatgttactcactactctaatagacatgaacaaatatttaatagttttatattaaaaaataaaaataaaataaaaagatatatatgttagcttttccataatgtttctcactactctaattgatgtggacaaacatttaattgctctttgtatcaaaagaaaacaagaataaaataaaaagatatgtccttatattatattatattatattatatgctaacacgaaattttttgtttgctgcttgaaaattaacgtttgaactttcaactcaatagcttaaaaatattttacctaaaagactacaatatataacttaaggtttttaaaacttccacatgagagctcctagatattttttttttgcatgaacagcagagccagcccctgagctggtcaggtggctactaggactctattgttgtaatgcttcactgtggattatcaagaaacccataaaaagttgtcgtcaacttataatattcttttatcacccaggctgaacaataccagtggcttcgtcattgattattttctccgtaaaattgtaatgtccgctttattttgggccctgtttcatcgtttcttctctattgggcctaaatttccc

SEQ ID NO: 40951 - DNA, 1501 bp, Oryza sativa
taaagttttttcatgattatataaaattaatatgtataaagtttgaaatacaatttgtttcgaccttgcttaactaaggggagaaggtgggcagtagaagcgtagtccagttcggaatttgaatccaaatacagaattacgaatacgaaaagtttgaaggtaaactctagaaactctcatggcctgcccaacccaatttagcccatttaacttatttattcagcatatatatattgacattaagatgacattggttcgtactccttcggtgaatataaaggatcatgaccctctgttcaagaatatatggtatttttgttgtcccgaggcaagcaaggacaacaatgacactatcaacagcaacaacttttcatttaccccatcggttctaaaaaacaaatagagaaaaagtactgctaggactacttctaccgtccctaccgtgtttaattcaccgccaactaccctaaacttctaactttccatcacattacatccaaaactttactacacatataaacttctagcttttttttccaaactttcatctttcccaaaacttctaactaactaaacacaacccaaaacaatagggaataatattaccccatcagcagcagtgtgtacttttacatatctaatttgctaattcatcattcagcaccagagtgacacttccttaattattgctaaatgggaaatctacaatttccatatagttggtacccactaacaattattagaagttaaaactcaacatgcaagcataccacatcatcacccactagcaattactattctagcttatttaaaatcccatgcaagcataccacatcttcactcactagcaattactattctagcatattttaaatctcatgcaagcatgacacatatcatctacaatattatattatagagattgacaagtatgtgtcaaatcatcttcctcacattattttctcagtatttcaactttcatcatttcaaaaatatttaacatatactcatccatgaatactgcagcaaaacgcggggtatgacctagtaatctcttataatcctggacggaggaagtatttattaacatgagagagtacctatacaacgttcaatagttaattgtgtgctagctacttgaccggagtcaagtatatataatcgtctttatctgctgcttgtcttatttttctatacccattaattcactcaatttagatgctgctatagctccacatgaacagtatgaaaatgtacaatgatgcttataagtcaagatatcaagccaattatagagagccaaattcttcccatgtaaactttgtttattgagtccgcatcaaatagctaggtggatcgatcgacacatacatgaaaagagctagcaataagatcgaagagatcgatcagctcattgcagcaattaattgcacatgtaattaatcattgacaataatacattgctcatgtgagaaattaatccatcgcctaattaattagt

SEQ ID NO: 40952 - DNA, 1501 bp, Oryza sativa
catcatccacataattcacataatatgtcaacatatctctccatcattttttattcctcacttaattaatgttatttttctcttctctcataagtcgtatcaaattaattggttttagcctttagatgaataatctttaatccaaattatctccttcatttttttctctcattaagccatatcacctcaactgtttttagctcttaaatgattaattcatagtccaaattatcttcctatagttcatcctcgcttagttaatgttatttctctcttttcttattaagctgtatcacattgattgtttttatctcttagatgattaatctatgatccaaattatttgcctcttttcttctctcattaagccatatcatctcaattgtttttagcccttagataattaatctatggtgtaaattatatccctatagttaatcatcacttagttaatattctttctctctttgcgcattaagccatatcatatcaattgtgtttagcccttagaattaatctacggttcaaattatcttcctcattttcttctctcattaagctatatcatatcaactgttttttagaccttagatgattaattagtggtcaaaattaattatctctctcattttcttctctcgttaagccatatcatctcaactattttagcccttagtgattaatctagggttcaaattatttccctccttttcttatcccataaagccacatcaccttacttttacatttgaatcatcattattccatatactatttaaattatcataaatcatatcaacttatataagctgattccacctagttatccattatttactaaaggctcacagcaacgcgtgggtttcacctagtattaggagaaagagaaaagggaaaaaaccaaaaaaatggacaggatggacacccaagggcttataactgaagaatttaaccaccacactattgcggttctgatcaaagaatatgcctgtgctactatttaatccggggagacctcaacgccaagtcatttcacactaagctatgatgacttggcaaagtcacaacacctcggacgagagctcagcaccaatattgatggcactaagacattatagcttgatcagcgttatctaggttagcactaagccaacggttcatttttcaataagatttttttcacgggtcattcttcgaataagttttctaaaattatcatttttgtcaaaattttgggtacaacgtggccggtagcccccactgctacggaaaccatttctagataaacagctaaaatgcgtttggaaaggtggtgcagatgatggcctctaataaaaagcatgtgaaaaatgatgcaaaggacaacgtgccgccacagacggcaggcaaccttatagcggccgttgttggaagtcgatttttagagatgatcagctaagatcaccagctaggaaaatagggataggcggtcgactttaactgaccgtttctagcctctaga

SEQ ID NO: 40953 - DNA, 828 bp, Oryza sativa
caggttgcgtaagtggaccaacaaatggagacacaagatgtgaggaaggacagagtatctttttttttttaaattacacagtgcaatacagacactcacaacgcacgcgcactcacccctatgaacgcacgcacgcaaaccctacccctatgagcatcttcgaagattgagccagcaaatccttgagattgacgaagtcaccacaggtgcctcgctatcgacggatacgtcacctaccactgaaagcacaacgctattaaatcctagaaaattcgctcccatgcggagtcgaacccagggcctcaggtgctactgaagctcttgtaaccactagtctacatgtcttttcgcaaggacagagttttctcattcacgttcttttcaccgtatacaaaagcctcgactctcctccctttatatagccaattctcatatgtggaaagtagggtaaggcctattagtgtgttgggctggtcttcttgggccaaaagcccaagtttctcaacaatccatttttttttatatattcttggatgtgatattaatgtcttaaaaccattaaatgaacgacatccaaattctgaagatgtagtccaataaatgaaaatttgttttcctgtatacgtggcaattgaataccatagagttctattaaagtattgaatgtatatatttaattattatttagtatctgaaaggttcattgtctacttctatataagtaaggacgaatgaaaattgccaatatacttacaagcatactgaaatataagagaaaattagaaacacaagaaaggaaagaaagctataggtatatcgcccgcgata

SEQ ID NO: 40954 - DNA, 1501 bp, Oryza sativa
caggaaagaagaagacaatattataatgtaaacctaaacctattataagaattcttgggaaacaaaaaagaaaagaccatggaaacctactgtcacagcaggagctctcccaagtccagcggtacagtgtatatatgttaccccaccattatggttgacaagcttgtgcagtttgctaatcacagcaggaagcctcaatcgcaaatcaaaagcatcaaaatccctggtgtaattaaacattatgccactttaagactttgaaaatatggacagaacagacaatggaaaaggcattcaagtcaatgcaggaaaagttacatttgacaaataaatgctgattcaaggaaagatgaatcatctattccaaaaatagaagagcataggaattataattggaaagagaagggggaaaagagatagacgttcagatcatgccatcttgtagacattattaatgaaaataaagggatttctattgcatttgacatagactacaccaaatcaccaaaattcttagtttctcaaagtaaaacgaagttatagaactttaggtacctaatttcggcacgacagtgctctatatctttacattgtagacaatattcttgaatggcacagatgtcaactccaaaatatctgaactggttaaggatggaatacaactattcactgaaagaacacattgggcagcaatggaaacaacaagcaactatgctgtcagtataaaatagaactatttttatgagatgtacaatatgcattgtgctgaatatcatagctgcagaagaagtacagtagcagggaagtgaggagcaaatgtaattgttcaatagaattatggttattgtccaatagcacagtaacataattaggaagaaggcatgctgacataaaagcactccctattccaatagttattttgataaaaagccatcaccagaattttataattctcttcgatatagttggtgtgattcacagtaagtgacagcatacatttcaagaatcaagaggctcaaattctctaaaccaggagaactatggaaaaatgatgtattatctatttaattatgagaaatatattagtccaaatcaacatatatgtagaaaataaaaaacaatatgaaagaattacggaaatacgtactaatgtagttatcatatataatacaatgagaaaagaagaccatagtcaaatgctttattattgagcaaaaatgatggtattatttttatcatcttttagaggaatctatctaaatatagttaatcagcccgtgttagtagaagcatgtatcgtcatgcatcaacatatcatgagattattagttatagctaagtacaccggcgtaatcatacttagcatatcacgagactatcgggtaatggacaattatctttaattgtgctagagaaaaaatatcatacttagcatatcacgagactatcaggtaatggacaattatctttaattgtgctagaaaaaaaaaagtactccctt

SEQ ID NO: 40955 - DNA, 1501 bp, Oryza sativa
ttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctacatttaaattctctatttatttcaactgtgcatttattttcgaatgtcactgggtggtgtgaacctattcctttgttatggcatgtttgcattgattactttattccttgataccttgggttattataacttgactagttgagctttatatattggttcaactagatattagatataattgcttagccatgcttagaaacattagcacacaattgggataactaatgtttcactatcacttatggttatatttaatgatagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatgattcattatggtgtgccagactatgaagcggcgagaagtccgtgggggtcgctggggagtccatttcctctggttttgagggggagattatgatccaggaacggtgcactattttgagttgtgttgtgcaaagggtattgtcacgatttcctcctttgcagtgccatggtggtacttcggggcatggcaacatgtgtggaatcgtgtcttgtgggtacagtggtacacctctggccagagtaaaactattcgaatagccgtgcccgcggttatgggcgagttgagcaatgtttttcgtgattagtcccacactactcattaatggtaataatgtgataattaatttgactcctggtttggaatggataattcctggtttggaggtttgatctgtacgaccggggttggttgttcaggtttggttgggcctgtgcagcatgggtgtgctgttcagtgttgattaaaatttctgattaattactctactgttttacttatcttaaatctttgctaaatgctgctttcgcaaatgaaccctatattatgccatcctttggaatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagatttttctttccgctgcagttttcttcttggtgaggactaagtgcctcttaagtaagtatttatcggtttagttaatttgatgaatctgtatattaaattgtcagtttgtgtacctcggctgattcttggacgaggattttatgcacaaataagttcggaaattacttgtga

SEQ ID NO: 40956 - DNA, 1501 bp, Oryza sativa
cctgcatgaaaaaatagcgatttttgcagacattttagggcagatgagcggctcaaccacacgcaaaaataggaaccgaccgtttggaaaaatggttttttaagtagtgtgaggagttaacgtgcagctcttttgctctacaagggcttcgaggagtctaaaatttgaaattaataaaaattgaattgtttcgtgtttggagactcaattatagagttggcattatttaataaaaaaattgttaataatacgtagttgtacgcggttttggggtcccaattacatcatttttcttgttttaataattttataaaattgaaaattgtaattattttgttctacttcagtatagactatcagttacagatttttttttatgttttatagttcatagttaatatatgccaacttgtcataattaagcccatagcttataatagatgagctctaaattacccaacattcagaacagttgggtttttaatatgcagaacgatgttaaatgcaaatctacagccataacaatacaattcatccaaggtcttccggtcttattatgtgtgagataataccaagtgcataattagaatagttatttacttgtgcgaagtcaatagcaaggccgtatatatgatacgtggaatttcagtaacatggcatacgttagtttaattttgaaataatggagtattacttatcataagagggaccaatctttttaggagcacacacaggttggggggggggagggggggattagaatgaaaagagctcaaaaaatattttattatgcagaaaaatataataaaagcatcccaaaacacataattaagatagatacatgctcccaccggtcacaaatattaatttaacatttgtaataagatttttttcaaattttgaccgtcaccaataagtactgttgtaatctcataaacttattagatcttataatatttatctaatataaaattatgatttaagccatgcattggaccttgaaaaaaaaaatctaacttcatatattatctgctagaggaagtacttggttcagagagatcagtgtaacttattgttgaggatgcaaccagcacaaatttatagatttaaacaaatcctccttccagtaggtaaagtatagtagttcctaattaatgaatacctgaagagatgttattagtaagcaaaccagaaactacatcttgaaataagccatgcatcagacctacaacttggatggaaaatgtcagaagactcaggatcgcaagataaatatatatataattatatagctatatatattcaacttaattccttccgcaaacctataaaaacactccagcatggaaaaaattgcagatttaactgtgaacatcatgcacaatacatagtactacttctaaagcagctagtctgtgtgactcgtgaaccccagaaaagatgaagcatatatatatatatatatatatatatatatatatatatatatatatatatagga

SEQ ID NO: 40957 - DNA, 591 bp, Oryza sativa
agcttttaatcagatggataactttcttgaagaaaggtggacatttatttcttttttcctagttaagcttgaatatatatccttcgattagactgaaattgaaaatttaccctcataactcacatgcatgtaacaagaccccgccatattatgtcattggtacaagaggttaaatccactcctaatttttatctgagagctataaatgtgtgtacgacgacgtaattaacattccttttgaatatataatgacatgaatccaattaaccttatagagtagtattctattgggtatatatctggtccagattgtataatatgccaagcgcgcgcgtatagtgggaaggtataaagttgctggctgtctgtctgtctccgttgggtatgcatactcctacttaaaacatcattaacaaattatctataattttcgtctaaaaatttgtttttgtttcctaaactgaaaatagaaagtgaaaaactccttccttcaacagatagcctaaattcaatccccaaaacttaaaagtgggcccttctattaaactatcaatagaaaatttcgttttttttttctttcacgcgcgcaga

SEQ ID NO: 40958 - DNA, 348 bp, Oryza sativa
  unsure (1)..(348): unsure at all n locations
ccgccatcttcgctctcgctatgtatatacctcttacattctcgcttccctcgcttccntgattgttactcgttcacgctaacgtacattgantctcatgatcttntnctnnctcacccccccccccccgcggctttgaaatgccanatcgtcatnctcgcangccngcaggncgactctagaggatcccccatccatccatctccccgcctcgttttcagcgctttattgcagcacgcacgcacgcacgcacgcgtcggggcccttttatagttttgtccagcgtcgattagccaggatcggaaatctgaataatcttgcattttgttgggctcttctccttctagc

SEQ ID NO: 40959 - DNA, 176 bp, Oryza sativa
ggaggggggcgatagacccaaaattttgaaaatttcagtccgtaattttgaacctgcttattacatatatagtacgttaatttaatcatgttattacaagcttcccgatccttgtgtatccgatcataaattaatttatcacttggtcatttttgatatgaatggtgcattgcagc

SEQ ID NO: 40960 - DNA, 214 bp, Oryza sativa
taaaatcccaatataattatgtctctctttatttattctctatccatttatcttctgctttcacaaaatttgatgcaataattacttaaaacaaatttagtttagaacaaaggacttaattaagctgcatggcgtggcgggcccttgcgggccagcaactaacatatccatctccatccaacactgccgcgcgggggggccctcgcgagcgtca

SEQ ID NO: 40961 - DNA, 430 bp, Oryza sativa
  unsure (1)..(430): unsure at all n locations
agtggtganttagnagactcactcgngcaagccngcaggtcgactctagaggatcccctgagggacacaactaattttagaatcgacgataaattgaaggacctcaagtgaactaacttcgtggataaatccacatggaaaaagttcacccaaggtccctcaacttgttattgggataaaaaacgtcctcaaaccgtaaaaccagataccgcgagttccttaactatacaaaaccggtcacaataggttccttggtggtttgatcccgggttactcctaccgttgctgagtcagcgtggaacccacgtgggtcccacatatcaggaggtcaacgtatatctctttcctctcttctcttttccttcctcccctttttgctctctctctctcaggttgggccgacggtgagcggggctgagtggcgagacca

SEQ ID NO: 40962 - DNA, 790 bp, Oryza sativa
aacttctacttaatggattaattacaaagatttctagttgcatacaaggaaggtggaaaaaaatgcgagacagaaagcaaagaagagaaggaatacgaataggatgatgaactgatgattacctggatggataaaaaatcgtcggcggaacacatgagtccatttgcggattagcaggtggggaaaggtggacaggttccggctgacgagggcgcgaagtcccccggcttctcatctcccgccgataatccgtcgccgtcgctgctgccgccgccgcggcgtgtccgcgaggggccgagggcatgttaagagcatcagcttcctaaaattttattcccagatttttgattatgtgaatcctaaccataaaggtgttaaaatttttctctctccaagagatgaggttaaattggaggtgaatagggatctgtcgtccgatcaaaatcttagcgtccgatttacgtgcaaaactactctaaactgatttttctcctaaattacttatccaaatcatgacccgattgcaccattaaattcgttgcaattaaatcttgaaaacaagaccacacttggatatattccggcgaaaaaaattagcttattattaaattatttttaaatattgcacgatgttccaccagttatttcggaattgtttcactgagtaaatcgaaaatgtttcactcgtttaaatcgagtgttgttttaccttatataaaaacaatgtttcagcaaatagcgaaagaatgttttagttcactgcaacattagatctatacatagtgaaaca

SEQ ID NO: 40963 - DNA, 371 bp, Oryza sativa
  unsure (1)..(371): unsure at all n locations
aatctcaacgatttctttaacattatccgctcttgaactatcctcgcgtcgaccgttgactatccaccggagccgacgacgcnccgctcacgacgagagagcgataacgtcgccgcttcgaattttgaaggccattttttttttcacagcttgctgcccacgacgacgtctatggctttggccgcttccctccccgacgtcccaacgtgcgcgcgcgcgcgacgccgccgcggccttccacgttttagccgttgcgtttcgcggaggcgccgtgtcactgccaggtggggtcacagattgcgccgcagagcgagcgagcggcgcgcgctgcgctggtggctggcgtcactaccggtgccaggctgtaagca

SEQ ID NO: 40964 - DNA, 1501 bp, Oryza sativa
ggccggaatgctctattccattatctaaaaagaggattacgtttgatttcatacttacataatactccctcaaagcttgattcatattataactttttatttgactctttttttaaattaaacttatttaactctgaacgagaatgactccataaaaatcgtgatagacgaatcctaggctacctaatactccctccgaactgataatacttgtctttttagacaaggatgagatcaaacttcagaatctttaattgtgaatcattttaaaaatatttatctttcaaagatggtgactacatgcatatattggtctttaaaagcactttaataaaatcacatatttgttaacactcttattaatggtcaaagttgttttttagagaccatgcccttgtccaaaatgatagtaagtattatcaacccaaagggatcgtatatcggagtgtatttagagcaagtttaatagtatagccaactaatagctctaatttatctatagctaatctaatagctcatttatacaatagatacatactacactattaatacttggtcccactagtcatacacacattgtgtcttggagtccgtgctacagctgactataaatctgtagcctgctgctcttttctctcctcatttatcttcttaaaatatgtttgcaactggcttttagcctgctattgtacctgctcttacaaagagagatgctatacatacgatttttcatgtacgacactcgtacgacgtaaacgtttcccaatgcaagcctgtggcgtttttcagtcatttcccggcgatgcaccacaccatgttcaccatccgttaataatcgtatatgaattgcacgtacaagtcatatgcatactattttcgatttacaaaacaccctaaaaaattactaccatgtaggaatgttaacggcgtaagtttatagtatgaactagagattacggcgtaagtactgaaatttgcactaagttttgaaagctacaatgtattttgtaaatttagtgtaaatgcatattatttattgtttaaagaatgatttttttctttgaaaaatgtggtgccataaatggcaatatagctagagtaacagatcaagtctatctcattatttcatattataattaattgtctcttacaatattggcgaggcaaaccatttcaaaggtattttttatttgcagattataaaacatagtattttaggataagacttttgtattttataatttcaataaaacttttatattcttacaatccaaaagtcaataccaagaaatcaaaaacaaagtaaaaactatattaattcaaaattcatctctaaaatacataaccgaagctgccactaaagttttctcctttttatacaccacgcgtgtttggttcttgatttcactatcccaccaccattatttaatggaatctttacaactccaactttgtttaaaaaaagcctaccgtccaccccagctgacgaagacgagatgaa

SEQ ID NO: 40965 - DNA, 1501 bp, Oryza sativa
gccgatctaatagttaattcatataatagttgcttactatactattaatatatggtctcacctgtcatacatacattgcgtcttaaagtctatactgtagctagctatagatctgtagctcgctactcttctttcttatattttatctcattaaaatatatttttagctggttaatagtgtgctattgtacttgctctaactagtttaggatcgccttaactttggtattactgagtacgttgaaccacaaaatcccgaaagaacatgctactccggtagtactaatgaactggaatatcttgccacgccttgccaccctaactcagaatgcaagaacttcacataaattttacaaaggtgtgtttagttcatgtcaaaattaaaagtttaataaaaaaaaagttgaaaactaaaccaggctttaatcttaaatacgcactccgtccatagaccatagaacaattttccgcacctttaaactttcatccttttccattccgttacctcgagaagccaacaccgaccccgcggccccgtccatccccttgggaaattgcacgcgaatgattgcgccggagcctctcttttccccgtgagcgatccagcgccggtcttttccgcggccgcgggccccgtgctccccgcggcagcaaaaggcgcacacacacgcaaaaaaaaaaaaaaagcggcatcacaccaccgtgcgctcgcgcgggcggacacgaatcagccgtcacgtcgcctcgtgccggcgattcccagccatccgcgcaaagcgagagcacgaacgatcgcgccggcgcccttttttttcccctcccgagacagcggctgtttgctgggcaagtactgtgcgtgcacgctgcacgctgttcgactcacatgaaacccaagttgccgatggtcgatgggcgagcagacaagcaggttccgcgagcaaaactgagaagccacgataagaattcgatctaccggcgggagcgttgggtaaatagtgccagccatttttgatcaggaatgatgacgttgtgctcatattcttcatcggtactctctccgcctccataatataagagattttagagggatgtgacaaattccttatattatgagacgcagggagtaacgaagaaaaagtagcagagataaattcatatgcatcgttcttatgatagagagaaccttatgttactctactggaaagttagagagcactaaggccatggccaacgctccatgctagagcgtggtctcacccgcgaatattcgcgtcgcgtggtctcacccctcccgacgcgaatattcgcgccagctcggccgggaccgcgctctcgtagagctccctgaccccccgcatagcatcgcatagtttcattagcttttggcgaggaacgggcgagcagccgtgttgggggagaggcgtcgctccgtaccgtaaccctggaacgttgtagccaactacctcccgcgccaaggccaaaaatggcgaggaagtaggcg

SEQ ID NO: 40966 - DNA, 1501 bp, Oryza sativa
gccttaaagaaacttcggagtaatttaatcacaaggggaacttcagagtactacaatttagacatgggttaaacgggtgccgatcgaactgccgatttcagagtaatacatatagaatatagtagtagtacgtatatcgagtgtgattctagctaggatttaggtcaattttgttcccatgcatggacatatatactgcccagattaattttaaaaaccatacaaaaatgctggaattcttaaagcttcattattagatgtgttgtaaagcttgagtaatatatttatttttatgagcagaaaaatctgaggcatatattaaggtgtgttaggtatagtccacatcaatagctaattttttagagcacaacttaaaaggtaagaatgtccctccctagctagtctttttttttttgaatcgttggtccgtggactaaacatgaggctttttagatacactaacataatttcacaagaagatatatcataagaacaagatgaggaccgaactttgtgtgtcaaaagaaattgatatcaaattttatgtttttctctactatcttaaaaacacattcgttctcctctttccatcctaatcccacatataaaaaacccgctccaaaaaatggtgtaaaaaaactgaccaaccaaggcctgtgtctagttttaagaaatcacaaactttatgttagatgcagtactcatacagtaaggccctgtttagatcctccaaaatggtaaaagttttgctattttgtagcactttttgccattttggatctaaacactagtagcaaaagctggcaatttggcatttggcatttgctagtccatagtagcaaattgtgtcaaaaagtgttttgggaccactccctctcactttagtgctagaatggcaaaattttaacatgcatctaaataccaactagtacttttgcaatgccaaaacttttgccatttgccatttaccattccaaatggatctaaacaggccctaacttatgagcaagaattcctctatcaatcagaccttgttggcccatccatgtatatatattgcttattagtgcagcctttgttatagtactctctccaatcaaaaaccaaaagcttaaaccctccatatcttcctttagttaaggctattctttaaagcctggatgcaattccacacctttcactgacccatttcttcacaaaagcaaaagtaggcccaaaaaaacaaaagggatgccagggagagcagcagaaaaaaaaagggcagccaaggaaaagataactagtaaaggtggagatggagagggagggaggcaaaataaaacacatgacttctttcaagcttcttccactcctccactaataagttcttatgcccatgagagattcccttccctccaaaggctcatatgctttctccctcccccccctctctctctctctctctaaaggttgacctcaaggtgtaaaaggagatcactagctagctgagagagagagcctg

SEQ ID NO: 40967 - DNA, 1501 bp, Oryza sativa
agcatatcaagggagagggaatatggataggggagtcctccacaaatcatcagctctagtgggggagatgggggaaggccatggatggtggagtgtgaataatttgaggcccccctttgttgagcagcttcacaatccggcttctcttttcttgccatcctccaccaccacctccactactccctcttcttcctcctctcccctccattccttctcctccctgctgctctcgaatcactatcctcttccttctactgcgacgacaagcaccgccgccgcgccttggcacgacaccggcagccgccacggccaacatctccaggactcatggaaccatatcttactgtaattcacacacacacattctctctttttttatttatatgtttgtaattgattaacttgatattattcttggaaatggtctgtttctagaattcttctgaacagctacatgaaataatattgtgctaaaaacctcatctctccctctttacatggtcatatatattgtgatcatccagtggtggattggctagtggtgaagaggggtacaacaagaactgggaaggccaggtgctgttcccaactacaccagctgcagctgctgcagaagctgatcatgggagcaacagctacaacaacatttacagaccaccacgactagccatgggagcagcacgagtgatgatgcttcccaattggcagtggctgcaaggccgtcgtcttctccatggggtggcatccatggccatcacccccaccacaacgccttgcagcagcaagcttcctcccctaggtcttcttgcatcacctctaccacctcccttggaagcaacggcgtgctggagttctcaaacaacactttaccacgtgaggtagggacaatcatcattcaagataatcagtctggtaatttttgtttgtgtgtagattattttaggtgcttatcatttactgaggagtgagggtgggtgaaaaagtctttctttgaggaagctcatcatcaccttttggatggttagaaagagagattcaatactaatagctttgtgtgggtagataaccatgcatgaaagtttcactcctcctggaagcagttaagatagggagccatgttgataattaattagttatgtatgaaagttttgtaactttgctctccatccttttgtgtttctcctagtgcatcagcacagcatctggagcagctttcaagaaggccaggacccaagaaccctctccggctcaagctacagttaaggaactctctctctctctctctctctctctctctctctctctctctctctctctagatctctcaatgagcatggcccaatcaatcagagcaatctaagctagcactgaagcaatagtttgcttgctgaaacggacaggcatggaatcattgtaggttaagagataaggtgagatggggttggagatggaaatgatggcgttcttaattagtatgttttgcttgtgctttttcttcagg

SEQ ID NO: 40968 - DNA, 761 bp, Oryza sativa
ttgcattgtgtaggtcacttgttcaaggtttttgtgaattttatttctcaaaatactaatgtattgttacgttaatcaattaaacaatcaacctcaacaattccagcaaatttttgtttcaaataggtactccctccagttttataataattgatgttttagacaagattgaggttaaacttttgtaactttgaccatcaataactttaaaaatatttactttaaagaaactagaacaacatatatagatttgtatttcaaaacactataataaaaataaacatgcatttatttattgtatatattataatagaaaataaagtcaaatgtatattttgtagaccgtgtcattgtccaaaacgccaattaaaatgaaaccggagggagtagtgctgtagacttttagtgacctcctttatatgaattcattcatgcacacccaacccaatacaacaaattgtcaaattattatttattaaattacttcctttgttttatctttatgttggacgtaataaaaaaaaagaggagggactacattggagttatattttctacatcttttcaaagaggactaacgtaactatttgtacttggttcgatcgtagtggtcacacatgaattttcaagaaaaaaatcattaaataattaagaaatgcacaatcctaattataaaccctcattactaccaaggttaatcaagcacttcaatcaaatcaaacacaagatttttttagataacgagtcatcgagattaggga

SEQ ID NO: 40969 - DNA, 1501 bp, Oryza sativa
agatctaactccaaaccaggagctaagcaaattattaccaggtataacatccataattattatgggaggtgtgggactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccctcaaaaaccagaggcatggactccccagcgacccccgtgggcttatctccgccacttctcagtctggtgctccgcaatgaatcatgttatacaaaaggtaaagccgtttcccacgctggcttgtggttggcacggttaatgtttcacaacagtagctcgcgaaccggtccttaattgccatgagcacgactctcaaaaccatgtgctcacaacccaccattatcaagttttagtttgcaagtaattaattgaccaatcacgattgaccatcgtgaactatctttaaaccatcattaaataataatgagtcataagttatcccaataatgtgctaatgtttctaagcatggctaagcaatcatatctaatatctagctgaaccaatatataaaggtcaactagtcaagttataatatcccaaggtatcaaggaatagagtaatcaatgcaaacaggccataacaaaggaataggttcacaccacccggtgacattcaaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgacccttcgcaacgacggaaacgacaagctaacacgcaaaacgaggaaaaagactaataaaaaccaaataaacaatacataaaaagtaaacaaacatgtagatcataattttagatgaattatgagacttgaacggcctcattctgacttaatatgaatttaatatgaattttacaagattaaatctaattaaagcccatttaaaaagaattaaataaatttaattcaatttatggacaattttaatatgtagatctttattttatataatttttgcaacttgaaccacattaaactgagttcaaatgaattagttatgaattttcaaagattaaatcggattaaaacacttatatggattttaattgaattatgacgcaataatgaattatttttgaaaaggaaaagaggattattgcgtcagcggctaaggtttgcggtgaaccgggtgcacggcagcggttcacggaaacgaacggccgagatcaaccctatccaaaacggacggtcgagatcgattggtccacgaccgggccacggggaacggcaacgatgacgtcagcaa

SEQ ID NO: 40970 - DNA, 844 bp, Oryza sativa
  unsure (1)..(844): unsure at all n locations
gcgtgcacggtaggaactcactcttgcatngccgcaggncgactctagaggatccccaatgtttttgttaatcctctacaaagtggctagtgttaataaccaatatatatagagagtgtgtttttttttcgaatataaagtgaattgtctgctttttctaatcagttggggcttttagtttgaattgattggggcacaacttaatatgcaatcagatccaaagatctcgagatcaaatcttggttagcgctctatttcatgctaaagggcttgaggaggcctcgcgtaagggtgcatgcaactcaatattctactatagtagtctccaatgacattttatgtgttttacccccccccccccccatcattatgcattccctactccccatgcattgtatgtgtgccggcttaatttgaatgtgtctatttttcacacgataattatttaaaaaccattgaaatgatatgatttaaaaacaacaagaaacaaacgatagattgcaccatatggtaaaataatgtgtttgggcttaatttgaagcgtgatcgatctgagttcgatcgacgaccccccaacgtaccaacaaccatatatatcgatatatatatgagccagaaaataatgctacaacaactaagtaaggacgaaaacggttttcctatatatatggaccgtggttacgtttggaccacgccaacaaagtaacaacaacgaccaacgaccattcattccgatgatctacttactcctatctatcagccgccacccaataatgaagctgcctgcatctgcatctgcatgccttgcccacggtaaaaaagaccaggctgctgctattgcaga

SEQ ID NO: 40971 - DNA, 1501 bp, Oryza sativa; identical to SEQ ID NO: 20554

SEQ ID NO: 40972 - DNA, 317 bp, Oryza sativa
tctctctctctctctctctctgcacttctagctgcactgctgcttgcatgcttgggctggtttttgctattgggccggctagctactgggctgcatgggctgggctgctatctagctttgctctttttctttttttttctctctctctctctcttctttctctttttctctaattattgcggggcgctacatacacccacactcgaagattcgacgtccccgtcgaactccatctatacctgggcttttcaaactgaccaagaatggtcctctgttagcatcacgtatatatgtacgatttcggcgcacatccatca

SEQ ID NO: 40973 - DNA, 1501 bp, Oryza sativa
attcataactaattcatttgaactcagtttaatgtggttcaagttgcaaaaattatataaaataaagatctacatattaaaattgtccataaattgaattaaatttatttaattctttttaaatgggctttaattagatttaatcttgtaaaattcatattaaattcatattaagtcagaatgaggccgttcaagtctcataattcatctaaaattatgatctacatgtttgtttactttttatgtattgtttatttggtttttattagtctttttcctcgttttgcgtgttagcttgtcgtttccgtcgttgcgaagggtcgcgagtgcgccggaagtattcaagaagattaattgaagaccgattattgcaaggcaagtcacacagatcctaaacacaatcctttgagcatgttgatcctatatttaaattctctatttatttcaactgtgcatttatttttgaatgtcaccgggtggtgtgaacctattcctttgttatggcctgtttgcattgattactctattccttgataccttgggatattataacttgactagttgacctttatatattggttcagctagatattagatatgattgcttagccatgcttagaaacattagcacattattgggataacttatgactcattattatttaatgatggtttaaagatagttcacgatggtcaatcgtgattggtcaattaattacttgcaaactaaaacttgataatggtgggttgtgagcacatggttttgagagtcgtgctcatggcaattaaggaccggttcgcgagctactgttgtgaaacattaaccgtgccaaccacaagccagcgtgggaaacggctttaccttttgtataacatgattcattgcggagcaccagactgagaagtggcggagataagcccacgggggtcgctggggagtccatgcctctggtttttgaggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtcccacacctcccataataattatggatgttatacctggtaataatttgcttagctcctggtttggagttagatctgttcagccgggtatggtgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgttgtgtggcttgctgagtatgtcatatgctcaccttgcaataatcaatcaacctca

SEQ ID NO: 40974 - DNA, 685 bp, Oryza sativa
ccatttacccaatagaactttattcataatatctaaatccaggaacacccaaaccctaacttgatctatagaagagcaaacaagaggccattaaaccaggtggtattttttaataccttggtcttcttgccacaaaagtcttctcctgaaatagtccatcctatccctaacaccctgtggcagtctatagaaatagatcatgtacaaaggaacattggtcagacttgaattgatcagcactaatctccctccaatagactgaagtcttccttgccaacaccccagtttatgctccattttattttcagctttcttccagtctttatttaagattctctttttgtcaatagggatacctaagtaagtcatgggtaactccccaatcttgcaagtgaaaatctagctatatagaagctgattctccttagcctctccaaaacaaaacacctcacttttgtcaaagtttattttaagtccagaaatttttgcatctgacaggatgtttatgttcaggttgcaaaggttgcagtgtagtgcaaggtggtttgtcaggtcacaatgcccacctcagactacaaaactttttcaaggtttgtttgacacgctagtattttttttcctgatgcaagaagcgagtggtcagtgtgcaatgcctacatagcaggacatggtcttttttcaaaga

SEQ ID NO: 40975 - DNA, 1501 bp, Oryza sativa; identical to SEQ ID NO: 20552

SEQ ID NO: 40976 - DNA, 255 bp, Oryza sativa
gctacctcattttgttcacgttgttgaagataattcttataaacatgacgatcaccgactttgttcacgcggaattagttgagtactgaccggttgaggataaagccattatcaccgcatttaggctgagttcggtagcaagagtgcccaactcacttccctatacaaaagttacttaaaaagatcatattgatctattttcaaaaaaaagtttagctaatactccctccatcccaaaatataataacttttagc

SEQ ID NO: 40977 - DNA, 1501 bp, Oryza sativa; identical to SEQ ID NO: 20551

SEQ ID NO: 40978 - DNA, 444 bp, Oryza sativa
tgttttttatgctacttgtgcagcatagatgtacatacatacgtatacttctagcacctgcatgtttttttcccctttttgtggtccaaataatgggagcagcaacaagaggagatgaaactgaaactggaagctgtggcaaccatcccaggctgcgcgaccaatggtccattggtccccttcctcctccaaagctcaagctggagggactgtctggtcccaacggcaagtgcttcaattccaaataatgcatggcctgcatgatgcttcgccgatctgttgttgccctttcaatgctattcttgcattaggtgtgtttcttcaatgcgcgctattaagccttggtttaaggttttgattgttctcctggcctgtgatgcctgtccgcgttcaatccccaagcttgaacaatgtcctgcgctacagtgctggaggagtagctca

SEQ ID NO: 40979 - DNA, 1501 bp, Oryza sativa
tagcaaaaaagaattactgttaacgattgcgctcgattgaattacttcatggtctggaatactagataatttacaccataaactattaatattggacaaataaactccttgagcattgttttgggtggtttttgctcgagcttacacacgtgacgccaaacgtgacaatccaattaacaaataaaaaaaatctctagacccacccgcccctaagccaatctatccctagtttcccctcttctctctctacacctatggctagagaaggagggcaaaggcggagaccgcttgggcaaggcggatcgaggaggcagcaacccgaggcagagtggaggcacatggatgtagagctcgaaaccaacttggggtcgagaatcccgtcctcactaggaactcgtccccggtggcgaccaccaccatacgtcgcaccgtcgcttgctgcgtccacgccacgtttggccactggtctccatgggagagggaggatacacgggggaggaagaggaggatgggaatatgacagtgatagcgagggagacaacgaagatgccgcacatccggataaaagcacaagtctcatatatggaccccgacggtcgcatcatctccaccaccactcacacggacgcagctgcacatctcgccaagctccgcaaccaaaatactcttcgaacatcttcgccaccacgtgcactgatgctcgccaccgcctgtggccttttccaccaaatcgagctctaggagataatgcctagagagctcgagctcagctgcccttcgcacaaagagctcgactccgccgccgcctgcggccttttccacccaatcgagctccaggagataatgcctagagagcttgagctcagctatccttcccacaaagagcttgactccgccgccaacacctccccaatgaagtttgagctccgttgcaggctctcctctaaccttgctgtcaagctagagcagtggagcacgcgaccataggtctggaggccactcgctctacgacgaggatggtgttgcccaaccaagctgaagccatgcggaggctcgcaagttcgccatcgccgtgagctttgcatcaatatcttccaccattgtccaccttctccaatctccagcatgagagagatagagagagagagagagcaggggactagggatgtgattggacataggaagagaaaattctttgttggttggattgccacactgatgtcatgtgtgcaagctcaatttaaaaccgactaaaacaatgctaagaggattatttgtctagtatgaatagttcatgttgtaaaatgtttggtattttagtttaaggagataatttggttgacctaaccacgatagttcgtggattaaagggactatttggattaaactaaatatttggtagagttttagcaccaacaaaattttagtatgctatagttgaaaatattgatttggattgaagtcaaactatgcttataagacacaagtttacaggcaaagc

SEQ ID NO: 40980 - DNA, 233 bp, Oryza sativa
  unsure (1)..(233): unsure at all n locations
aatgtttgatgcatatatgcaggtttgaaaaacgtccatgtcttcatcaaggaggctgatcttgtgaccttgcctgcagatgaagtttgtacaatgacatgaggtgtttcatgttgctactggacctgtaactgttcttttcgatattccattcctggactagagaacctcaatttcctaatatttaaacttcatanacgaaatataaacttactcatctcatgtttggtagc

SEQ ID NO: 40981 - DNA, 1501 bp, Oryza sativa
atatagttaaatatccaaaaaaagcgtggctgcagtagagtgagagggaaatgaatggggaagattgttatggcggttgggtaacctgcgaaagatagtgaaagatgagatggaatgataacgacaattaattaaatagccaagcttgtttttcagtcatcgttatcgtctggaaagttgatttttcatggattggctagctttttataagttcataatttgaattcctagttagtttataagctgatattttagacctttttaggcatttaaattcgacagacccatagtgttctaactcaactacagttggggatgccatgttggtattagagttcctcttccattatttaaaacaatattttgaagggatattttttcaaaggattaaaatgaaaactttggaatattccataattacaggataaagatgaccacgcagcatgaaattaaggctgaaagatggtcattttccattttttaacacagtaatccatttttctatcgtattaatttgactgggttaaatcttgtacttgttgattgatgtagcatcaaactcctgcgaaagctccatgacccaagctcccaatgatgaagttcatctggattggaagaaccggatcttatcatatatgtgaccgacacaactaaatggaagccttgtgggccatgggagagcgaagttttaacattgatcgttacacaaaaacaaaaccacacatgtgcaataatttagataaaaatcgtaataggttctccacagacaaattagagaaatactacttgacatgttttaacagaacgacatgtaacatgtttatatatctcctagccatgccaacatgacaacatataaatttcttctcgagataatttgagctaactatattatccagtatcagttatttagccgtcgcatttatataccgggacgtggtcggaacatatattacctgcacatcacgtatactcccaaaggagcacttttgttgcgttacgtacgcacaatcaccgccaaaagaaaaaaaagaaaacactcgatcagaagcagccgaatttcactatgccgaacagcaaaaacacagtgtactaccgcgcgtggccagatctacaccgggaccagatcgatcaatcgagcgagcgccgacagtttggaacctgcaacgcagcatcatcgatcgacccgacccgcgcgcgcgcgacccctagacgacacacgtcagaggcgccaccaacagtttattgacgcgaacatggcgcctccccgactggatagaatctcccatgcgccgaccgatctggacgcacccctcgctcgtgtccgtgtcagctcccgagaagctgcccacatgcagcacacctcacaccgaaccaaataactagctactacttgcgtgcatgtgttatctacagctctcctgcctatttaagcgacactacctgccttctgagtttggccattagcagcacattcaccggcagcacacgcgcgcacaca

SEQ ID NO: 40982 - DNA, 1501 bp, Oryza sativa
cccgattgagatagattcatccgtgacagccgtttacccgattgagataactcttcacatctgtgactactagcctgtgacggatgccgtgcccgattgagatggtgttttaccacccgattgagatgatggtatcccttctagtgcttgttatcctagcaagctatcggcacggctcgttgtctagctttaaccggctcgtttggctcgtgagccaatgaagtcatgaatagtactggcaataatctgcaactgattagcatttcaagtatagcagcatcatccaacaaatgaacatataagggatttgagcgacaatttacagacatgcaggatcatctgcatgaatcaatatatcatgcaaaatctcagaacaacaacaacaaccaaaaaagagaagcacacagtatcacaaactcacagtagctgccattctatatttccaatcacgatagagaaagcagtacataatatgctactggatctcattttcctcctccatggcggataaggacacgccggcgagcagcgtggacgtggtgcgcggtgcgccatggccttcggcgacgggatggccaagggcgtggcgctgtggggacgggcgacggcgccgcagcccatgggatggtggtgggctgctggcggcgctagggagattgagattgggcggcggcgtggtgataggaatggttaccatgggttatgggctagatcgcaaatgggcattgttaggcttcctctagactcctctgtgctgttgttatttcttggctcatttagctcgtgagcggctcatgagcccgcttgaccccctgctcagcacgctaacaattttcaacgagctgaatcgagccgaaccgaccatgaatcgagcgagctaatgagccacgagctttctatccacctccatgcgtgggagaatctggagagcaaagcgtagagaaacaaatgccctttcctgaacctgccgacacacgtatggcttcacttcttgctgccccactcaactcctctaccgtctcttcatgtgctatctgcctctaccacctccctcctgcttcggcgaaattttctaccagcaaaggtttgtttaaagatctgtgcactggtaagagtttatctgccgggaagcttaaatttagtggccaattggtctgtcgaaaatgtctttttctgttggcaaagaattttattgacatgttctttcccactcacttgtttcctattgagaaaagcctttactgacaggccgaatgacatcataaacacataacctttgccgacaattgagctgttggtgcatttaggtcatggtgcagtgatgtaatgaagtttccagtctaagtccaccaaacacacaagtatcttggacctccaaatttaactttttcctgttttctcttgttgctaatcccctggtggccactcgccaagaaaatatgttcatttgatgatgtatatattgagctaataacattctgaattctgatattttatattt

SEQ ID NO: 40983 - DNA, 603 bp, Oryza sativa
tattatcaatttgttattgtgtgcctcggctgattcctggacgagggttcacacacatgtaagcgtttggaattttggatagaaattccgggcgtgacaagttggtatcagagcccctttgaccttaggttatgccaaatggttacccatagaagccctctaaaaatattggaaaagtagaactgttctcctctccttctcttttaattaaaccaaactaatggcacatgcatttcctaatattttttttagtggttcccgttcaaaatttattttagcgttgttagtactatacatctattactgtactaatggcacatttaccagcaaaagttctacaatatggttttatttaatcttgctgcaaggaaataaatttagcatgttgattttataactttcttttatttcttttagaacctgttgttcaaaagtacagaatttatgaccttgtttccaactatttcaacttatcttgcaagattggtttactttatttacttaccttttactttgattttctaactttattcaaattaatccaaaaacttgtgctattaattggataaatgtcttaactccctcctttcacttgcctttaga

SEQ ID NO: 40984 - DNA, 159 bp, Oryza sativa
tcaaaaaaaaaagaaaaagtaaagctactatactgtagtcattctgtctaaagctcagatatatgttggacagtaaaattgtaaaacatgtcactgcaatgtattagatggtatgcaccacagctacaacagacatgattctgcatggtcacttacagg

SEQ ID NO: 40985 - DNA, 499 bp, Oryza sativa
aggggggtaattcgtccgttattgaaagtttagggtgagtgatgtctgtttttgaagttcaagggggtaattcggtcgaccacgatagttcagaggtgtaattcgtactttttcatttggcatataatgatgtggggatgtattatagtatgtatggtaccctaaatggttctggcttgaactgcatctgtctttataacctaaatgatgtggggatgtattatagtcaatgacatgtgggccacagggaggaaaatactcgaaaattccatcattcacatgtgggccatagggaggcaagaggcgcaagacacctggtagttgggttcttcttcccagcatttgcctcttatttccatattttcctgatgggtaccaagattgataggatttgtccaagggcttcaatcccttgttctccttgttttgtgcatgaggtgctttattccctttctgtttttgataaagctaattattcctttttttacttttttttaga

SEQ ID NO: 40986 - DNA, 249 bp, Oryza sativa
tgtgaagctccgaaatttcacaaaaaaatccggagaatatattaaggttcccggccatgatttttaaaggaaattttttaattccctcattatttcacttgattaaattgttttaacttttatttaatttctagaaaatgcattattcaatgatttttaatcccgaacgaaaatcggggggttacacgtgcgccgggtgctgcgcctttccgccacgcctgcctcaccgacgcttccacctctctacca

SEQ ID NO: 40987 - DNA, 386 bp, Oryza sativa
cttctccccctatccttttccttggatgattttatcatcacctcgaagcaagcgctctcttgattgctgtgacggccatggctggtttggggcctgatcacggtggagacccatccttcctctgtgcaatggatttttgtccaagaaccaaattattccattagccttttcttcggtttgtttgcgtttcatctttagaagtttcagcatattgaaggacagccacaggaattcagcaactcacaaactggtcactagttttggtctatcaatatactgttctacttggaagtagtagtagcttgcaagaagaagcgaagatattcatttgttcctgcaaaatttctctcatctgatctggattccggtctgttgttttcttcaga

SEQ ID NO: 40988 - DNA, 327 bp, Oryza sativa
gataaaaaaatagaccgcaggtatttcatacaaaagtttaaatgcatttgtctcccaaaaaaaaatacaacaatacatgtaactagtatgtacaattgattacatgcaaaatttgcccatcaaaacatatattttgaagctagattttgcaaaaaatagttagaacaaaccttgtcaaaatattaaaaaaactccactttccaccaacaaaatataacaaaaatggagccaaatgaagcaggatagagagttcttcacctttcgtatagagttcaagtaaaaatttcgagttgaaaacctccccccctaattggtgcttgctttagg

SEQ ID NO: 40989 - DNA, 1127 bp, Oryza sativa
cgattaaaattaaatatcaaaattaatgatataaatttgttatctgcttgagttcttgctaagtattattatttctaagatgggttaattgaatattctaacatgtagccttctagatataccaagttatgtatgcttaagccaacgcgacttaaataaaattacatagatacttgatttaagagaagatttagtcataaaaaaatatttgtactggggttcccttgttgccttctcttaatggtggctcgatcaacaaaacacaaaaaatctcctatgggctctttttgtgatgcattggatggctggcaacctagtaaaactcaacgctagtcatccttacaacaaccctctaaaccatgcaacaggtcactacaacctcacctgacatctcaaataattttctgctagataacatgcttggatgaataatttttttattaaataatgtgtgtatacacatacccattgaaatgacccaatagccaaaattaatgggagaattaaattaatgaggattaagttttagatgctttatctgttacaaaagaaatttaaagtttcctcttatttgttaaagactttaatagacgttgtaggagggttctttagggagtttaataaaccgataaaataatactttataattttatatgtcctagggattagccattgatatttttatttactattagtgtattattagggtatatgctcttgagtttgtcttttaaatttctatgattcttattatcgtagacatgttttttttagatagattaaagtacatcacacgtgtctttggctatgtatgtatataaaatgatacaaaatgatataatctatattataaaatggagcaattgcacatttgacccaatttgaaggtccaactaccgatttgaccctgttttggtcactttgctcatttgaccctccttttcaaaaccgaagctacactctgaccctcttctcttaagggcattcatcggttcatcggtgttaacaaaagctccaaataccacttctatccttacttatttgaccatatttttccaaagttaatttttctcctttggtccaattttatgcggaagaaaccgcaggtagcaagctaatggcggaga

SEQ ID NO: 40990 - DNA, 1501 bp, Oryza sativa
tgtgctgaagtaatttgaccaacattatgcagtaacattaagggtgtaatttgaacagaaacaatacctatgcagtagtaatcaatactaaaagggaaatggaggagatagtaagtgaataattaccaacagtatcaaacatttgcgccatggggatgacattctctgcagaaaccaacccatgggaagggcggagtccaaagatgccgcagtaggcagcaggcaccctgacgctgccgccggtgtcggtgccgagggagaagtcgacgaggttggcggcgacggcgacagctgaaccactggaggatcctccggggactctcccaggcgcgcaagggttggtcggcgtgccgtagtgcgtgttctccccattgatgctgacaacaacaaaccaatcctagctcataagagttaagacccacaaattttgtgacaaccaaccttttacaaattttgtgacaaaattattggaaatggggaaaacaaatttattttggggggatagttggcttggtaggaaaccattagctgagcaatatcctttcatttataacagtaccttcaccaagcatgttacagttgccaaagtgacaaaagaggggtgaaattggatttaagtttaggagaattcttcttctttttttttagaaacaaagttcaggagaattgttatgggtgacaacttgctttagcatggagataaactttcaacagaaagttcagtcgattgtactgaataatctgaaagataaattaatctggaagctgaccaaagatgggtgctttactgtcaaatccttctacagggcattaaaaatgcaagacttagcttatccttccaagaagatttggaaattaaaagtgcctctaaaaatcaaagtttgttctttctgtggcttgtgtttaagaaggagtattctgaaaaagagcatgggggtcgcagtgggtacctgtagcccatctcgtccatgatggtggtgccgaggctggtggcgccggcggcgagcgcggcgaggacgacgggggaggtgccggcggcgggcgcgtgggtcctcgcccagtccgggttgccgaacccggtgacgcggccggcgatgtcgaagctgcgaattaaccaaacaagacagtgagtattcgtcgttcatttgggggagaaaggaagaagaagaaggcagcgagcgagcgagcaatccgtacatgtccttgatggcgaaggtgaggccgtggagagggagttgctgcgatggcggcggcggcagcacgaacctctccatgaaggcgccgtagtctcctcgtcctccacccgccatcgccatgtcgagctcgagctctctctgtctctctctgccgcgtcacctcggctaatctaatcgtcttgttagcatcgaagctgggctgggctgggctgggctggacgatggccatcgcggtggggccagtgatgaggaaagtgaggggctgatcagattgacgctatttttaattatatcacttttttggg

SEQ ID NO: 40991 - DNA, 1501 bp, Oryza sativa
acgtaccaaacgactgggacctgttccattttctagtggaatgcaattagggactagtgggaaagaaagccatacgactaacttgaccttgacgaggacagtgcaattgtgcatactattccacaagactacattccggtgtggcaccaagtcgtttcagtcgcaacttctcggtctttgcacggagttttccgattataaagaacccggcaaggcaactttttttttttaactacccctacgtgccaggttttatatggacgaagcagaaataaattacgagaccatagtcctaatagactttgtctacagaccgcggacttcatcagaaatttattcgttatcaagaaaaccacttccttccttcaaaattcctgaggctgtgttttttttcttgttcgagttggaacctctcccttcaaagttcaaacacgcaaaacggagcaatccattagtgtttgattaattaaatattagctattttaaaaataaattaatatgatttttaagtaacacatgtatagattttttttaaaaaaacacaaattatttagcagtttgggaagcgtgcgcgtgaaaaacgagaaatgtgagttgggaaaattcaaacaagccacccatcttacttcgagaagtataattctcattaaaataagcaagaccaagttgataagacaatagtttacaacacttaccaaacgatgaaactgatacatacagagttggggttctgaatacaagtattcgggtggtctagccaacacatgcaattacaacgaagtggctgaagctaaactttttcatctaaacaaaacccaagtgttattggttactgctgatgtctaaactactgctgctgatgggtggaggaatgaccaggaggtgaggtgggagcaaaccctagtcattctgagcactaatgggctctactaaatataagtcccaagcccaagtttctgatgtggatatcgttttggtcattctgagtagcttcgatcgaatctgatgatgaggtcgaacgcatatgaaagtagagatgagatctttccaacaagtacttatttgcccccattaacatccggagtgaagagccttaacttcatcaaagtagtagtcactactacgaaaaccatttttcgtggcggccattttggatttttcctggcggaatttgcagccgccacaaaacaatggccagcgaaaatcaagatcttcgctagcggttatttatcgccagcaaaaatccattttcgctagcgactgtgttaaatcagccatcagtgaaaatatattttgggccagaaagaaatacccatgcagctgcacaaccgccagcgaaaatacccatgcagccgcccattgattcattaatttcaaaattcaaatccacatctagattcgttgctcatttccaaattcaaacacgaaatataaaatcatcatcagcatagatcaaacatcatttacacagatcaaaacatatgcaacatctggaacaaca

SEQ ID NO: 40992 - DNA, 259 bp, Oryza sativa
atgtattgatgagaattatctagtgcaagggcatattatgaagcatggagtagatggatctttgatttactttttccccagttgtacaaatgaaataccattgccaaatacggggtatcatttgtacaactgccacgaactaaccattcccctgcagaccatagaagaattttttgcaggtggagcatacagggagacgcgcaacatgacaatgaatgaacgagagagttcatcatcctcaacacccttgatatgtaga

SEQ ID NO: 40993 - DNA, 1501 bp, Oryza sativa
ccaccacctgaactaaccagttccattaagctaatctaggggtgattctaatcacggtgaatttggtcgaccgcacataaccgcggccacaactattcaaatagtttttactctgatcagaggtgtacaactgtacccacaagacacaaccccacgacacgtcgtgtcatgcccagaaattcactagtaatttctgaagttatttgtgcataaaatcctcgtccaggaatcagccgaggtacacaaactgacattttaatatacaagtccatcaaaataataacattgcatctttcaaaaaaaaaaaaaacagcagtggataaatggtctagcgaagctccggctccactcccacaggaagctcaacttgggtataagccaaacgtcctcttctttgcgacttctcttcaactgaggtttgattgattattgcaaggtgagtacatggaatactccgcaagccacacagcaaatatgcaagtgcacaaggataccgaaggatggcataatataggctcatttggaaaactagcattaagcaaacatttaagagtagtaaaacagtagagtaattaatcatcaatattaatcaacactgaacagcacacccatgctgcttaggcccaaccatcctgaacaaacatacccggctgtacagatctaactccaaaccaggagctaagcaaattattaccagttatagcatcaataattattgtgagaggtgtgagactaatcacgaaaaatattgctcaacccgccatttaccgcgggcacggctattcgaatagttttactatggccagaggtgtcacgtcctgataaattcatctcgaaataaaaatcattctctaaaaggaataatagaattaattaaaactcgaaaagaaattggcaaaccttaaaaagcaaacaagaaaaattcgaatgtggcccggagaatttttgttaaattctccttggtcaaaaaggagccctcaaattttacttgaattttcagaacaccggaaataactataagcaacaacaacctttatcaaagtttattaaaaagaaaactaaaaataatcctccttccgcctttgggccgagttcatcccaaagtctttctctcctccctccattttccctcctctctcgggcctcctctccccccccccggcccatctccctccccctcccttttttctcccgggccgcacttctctcctctccttcccgtcccactccctcctctcctcctcccgcctaggcctgccccggcccaagccgagccgcagccctcccgcgcacgcgcgccgcacgcgcgctgaccgcgcggactggtgggtcccacccacccggtcgtcgtcctcctcccgcccggctcctccttctcccatgaaaccctatcaatttcctccctcaaatctgcgcgaatcaattcccttctttccaaattgattagggggaattaatcccatttccttcctcttcaatcccccctaatttccaccttgaa

SEQ ID NO: 40994 - DNA, 283 bp, Oryza sativa
  unsure (1)..(283): unsure at all n locations
caaaaacacagagtagggtattacgcttcgcagcggcccgancctgtatacatcgccgtgtctcgtgtgtcttgcgggcgggtgatttttccacatacagagagagagagagcttgggattgcaccctaagcccttggtcgaaccggcaaaggggggcttacgcagtctcccggtgaggggccacgagctccgtcatctggcgcgccaggtagggggctcagtgtgtgttttctgagctctcagactcttccgtgtgcgccaagtttttcttgttcagcctaa

SEQ ID NO: 40995 - DNA, 1501 bp, Oryza sativa
aatcgatgacaaaagtagaagtgaggtactatgtgaacatgggctcgctctatgtgagagcggactaatgcggattttggaggctaggtgtcatagatgacatcagagtataaaccttcgttatatgtttcatgttcattgggctacagtctgcatcagaagggtttccgggctacatgcagtgcgcttatgaggccttagcccttaagggggataattgtaacaaagtagttgtattggctgaagtggcccagaagtggttgtagtggcttggaagtttaggtctcttttttccattatatatactccctacatcccaaaaagacttagatttctggctattgacttgtctagaactaaagtctttttttgggaaggatgttacagccacttcatcaactatgcattcatcaatccaagctagagttatcccctcaccaaaagaacggtgttaacaccaaaatttggtaagattctttagtggattcggtcagggaaagaatacaatcagccgatgcaaagtttatccagaagagaccgagtttaagaagaaatcgtgaagaccatgacatggcaacttgatttatctaataattaggtagggtttagtaattttcctttttatgcttagaaaagtgtttagtgttcgatcaggacttgtatcttttactttatctttaaaaaagtctgagttgtatccaataaggacaagtatctaccgatgggtataaatatgtacacccaaggacaatgtaaattatctctcgatccaactttcagcgcattgccaccctcttttccgaggtattatcaccggcggaacatggcaccaaacgcggggctacatcgcttcgatctccggcgaaggggtaagcccttaagttccgctggccctggcaattgtatcggctatattggcattgttcaaggctatgcttcgatctcttcaattgctctggttcagttggtatatttgtctaccctatatttcaattctgtttttaattgcactgtgttttgagatgcatcggtatagttgggatggtctccgttaggtccgattttctgtcttattcgatatatctctacaaccacaatattgttttaaatagatttgttataaccatcatgttagcatagatcaaattgacttatctagcttatttgatcagactaatctagaactgtctcggttgggtccgatcttctatatgactgctgataatctaagtcttgctaaattcatatatttgtgctacgtttttatcggagtgctatccgataagttatttttgcattggacttccatccgatgtatgttttaaccatcgagcctacatttaatattctgtatcaatattggtcgattggctcattagacatctacttcatcatattataatcggttgattggattgtttgttaaagttcttccattgtcattatctaagtgtcagaatctacattgaatatatagccgattgttcaaaaccctatcaac

SEQ ID NO: 40996 - DNA, 1501 bp, Oryza sativa
gaaccgtcgcccgtgcgcccggtccaccgaaaccctagccgctgacgcaataaaccttcttttccttttcaaaaataattcattattgcgtcataattcaattaaaatctatataagtgttttaatccgattaaatcttcaaaaattcataactaattcatcttagctccgatttagttggttcaagtctctaaatttttctaaaattgagatctacatgttaaaaatatccacatgtactgttcatgcttgcttatgtgttgttttggtgattttgcttctttctgtttagatttcgtcgtttccggagagtccgttttcgccggagaagagtttgaagagttccaaggccagcaaggcaagtcacacagatcccaaacaaccctttgagcatgttgatcctatttaaagctattgtttctatttaactattgcatttattttcgaatgtcattgggtggaattaacctattctttgttatagccctttcgttcttgattactttattccttgataccttgggttattataacttgatctagttgagctttatatattggttcagctagatattagatgtgattgcttagccatgcttagaaacattagcacactattgggataacttatgactcactattatttcatgatctcttactgatagctcacgatggtcaatcgtgattggttaattaattaatgtgccaactaaaacttgataatggtgggttgtgagcagatggttttgatggtcgtgctcatgacaattaaggaccggttcacgagtttcggttgtgaaacatttaccgtgccaaccacaagccagcgtgggcaacggctttaccttttgtatagcatggttcattgcggagcaccagactgagaagtggcggagataagcccacgggggttcgctggggagtccataccttgtttataagggggtgactatgatccgggagtggtgcactgtggtggattatgttgtgcgagaggtactgtcacagctcttttctgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttttcaccataataaaagatgctataactggtaataatttgattagctcctggtttggaatggttaattcctggtttggagatagaactgtgcagccgggatggttgttcagaatggttgggcctatgcaacagggtatgttatatagcgttggattaatattgtttaattattacttaactgttttattaaattctgaaatgtttattaaatgctatttatgcaaatgaaaccatactacgccatcctttggtatcctgtgcacttgcatatttgctgtgtggcttgctgagtatgccatatactcacctcgcaatcattcatcaga

SEQ ID NO: 40997 - DNA, 1128 bp, Oryza sativa
tgattagcagcaaattcaagtcattcattatccatcatcacatcggtttcagagagaagtgtacaacaagattattttctgtgaagaaaatagttaccattcgtggaagcctagaaggcaatgttcataataggattataccagaaggctaaaaaggaatattaagtgagaacttgttgactcatatttgacagactaaaaagaaaatgcatactttcagagcagacacctatgcaggaccaactattttatatataaaaaagaacatgccaatagaaggtctaaaaaaaaccactgcattggctcctcgaaaaacactaaagtaactatgtctgcataattatcgggagtgaatctgacaatgtgtgtatcaggatctatcaagcatctctaatagcaatatgattttcatgtgcactgttcatagtgtaattgaggggccattttgcaattaacaactacaattaacagcagtgggcttaaaaggaatcttaagtgaaaacttgtcgactcatttgacagattgaataagcacacttctacattcaaagcaggcacctatgcaggaccaactattatagaaggtgtaaaaagactacccctgcattggctccctcgaaaaacactgaagtaactatgcctgcaaacctattgggagtgaatgtgacaatgtgcgtatcaggatctatcaagcatctctaatagcaatatgcttttctaagtggaaattgcactgttcatagtgttattgaggggcaagttttgcacctaataactacagttaacaacagagcacaggcattcatagttcaaaacgggggaaagaaaataaaaggactctgatctactctactatgcagtgatccttacggttttggaggaggagcagaggaaagactcttaagaacagaagatggaatagtaaattatatgatatgtcatagagcctaagagagagatcggcaacaatttggtgccacaagcttagttaaggcaatggaacagtgtaagactgatggcagccatagaggtcaggatatagcaataaagacatcagaaactcatattctgacatcacagttcataaccaagaaaaacacggactcttccagtgcactgaaggaaaca

SEQ ID NO: 40998 - DNA, 1501 bp, Oryza sativa
tggacgaggattttatgcacaaataacttcagaaattactagtgaatttctgggcatgacacgacgtgtcgtggggttgtgtcttgtgggtacagttgtacacctctgatcagagtaaaaactatttgaatagttgtggccgcggttatgtgcggtcgaccaaattcaccgtgattagaatcacccctagattagcttaatggaactggttagttcaggtggtggattgggcctatctcaacgtggtgtagcgttgagcagggattggttagtattgattaattattacaattgttttactactttcaactactgcttttaaatgctagctttatgcaaatgacccctagcctcctttggatatattttgcatcataccttcccttcctgtatgacttgctgagtaaagtggatagtactcagtcttgctctctcttccccacaccagagctgaaaatcttcccagttggagctctcccggagaagttgggttcgtcgttgccgtcaaggatgcctgtggagtggagtcgccccactgcaggagtcaggctttcaagattagctcgcctttctcttttccgctgcatttgtaatcttttaatgtttctgtaagacatggatctgtatgtcaacaattatcgtttgtataccctggctggtcctggacaggggttttaatgcacattcagcttagagattctggttcatgaatttctgggtgtgacaagttggtatcaaagccgaccttgattgtaggacaagctaactggaaaccctaagagcccttcgaatccttttcatttgcatatgctctttgcaattggatttgtttcgggaaaatgagggtttgttcttgtggttgatgggaaaaatcttgatcgcttgttcaattgaaatttatgaaaatgagatcagtctagggttttagtaaaattctagtttgaatttatttgacagtcaatcgggatttatcggggtatatgcgttaattcgtgtctagacttgatggggcgcaatctttatgcgcatcattactactatgtagtatctattttgggcattaatttattgcttagttagtgtcatttcatgtacaatgctctatgcataaaaaaaatagtgcttggctagatacttgagttatttgttgttttgtttaatttggatttgagcgtgcattagttcctaccccttgtcttccttagatgtcagacctgttccttgatcacaagtgtcgctccaagctttcagagacaccgcctttagctttattgtcttcttagttgtatgcttggtttctgtgtttaggtttgttgcttgtgggttagtcggcggtcgatatcatgtgtcagtggtatggttgcctgaattaggagttgcttgcctcctttgtagtgttttaattcaagtcagatcaattgcagttaaatttataataaagattagtttctaagccatctgttttcttccttttctcttatttctatctatcccctcaaga

SEQ ID NO: 40999 - DNA, 1501 bp, Oryza sativa
cgccgcgccgccgttgcagccgccgtcgtcggtcgccgtcgccaccatcgggatcgcgaggtcgtcgccgtccccgtccaccgcttcgccgccactgtagcacgccggagcaccgccgtcaccgtcgacccaaagaccgccgctgcttcaacctcgttgccgtcgtcatccgtcgtcgtttgtcgtcgtccaagatctcggtgagttcgccgcgtcgccctctacccgttggtgtcctctgtttgcgtcgtcgcgccatcgttcaccggcgagcatgcgttgccaagctgccgccggtgatgacgtcatcgctgacgtcatcgtcgctgtccccgtagacccgctgtggaccgttttgatctcggccgcccgttttggatagaatcgatctcgggcgttcgtttccttagaccgtcctgtgcacccggtttaccgtggaccgcctttgatgacgcaataatcctcattttccttttcaaaaataattcattattgcgtcataattcaattaaaatccatataaatgctttaatccggtttaatctttaaaaattcatatctaattcattgtaactcggtttaatgtggttcaagttgcaaaagttgtgtaaaataaagatctacatattaaaattatccataaattgaattaaatttatttaattctttttaaatgggctttaattagatttaatctagtaaaattcataataaattcatatgaagttagaatgaggccgttcaagtctcataattcatctaaaattatgatctacatgtttttttactttatatgtattgtttatttggtttttattagtctttttctttgttttgcatgttagcttgtcgtttccgtcgttgcgaaggttcgtgagtgcgtcgggagtgttcagaagattaattgaacaccgattattgcaaggcaagtcacacagatcctaaacacaatcctttgagcatgttgatcctatgtttaaattctctatttatttcaactgtgcatttattttcgaatgtcactgggtggtgtgaatctattcctttgttatggcctgtttgcattgattactctattccttgataccttgggatattataatttgactagttgagctttatatatattggttccactagatgttagatataattgcttagccatgtttagaaacattagctcactaatgggatgaaccatatatattacattattatttatagttatatttaatggtagctcacgatggttaatcgtgttatgataattaattggtaattaaaatatgattaatggtgggttgtgagcacatggttttgaaggtcgtgctcatggcaattaaggaccagttcgcgagctactgttgtgaaacattaaccgtgccaaccacaagccagcgtgggcaacggctttacattttgtatagcatggttcattgcggagcaccagactgagaagtggcggagataagcccacgggggtcgctggggagtccatgcc

SEQ ID NO: 41000 - DNA, 1501 bp, Oryza sativa
tgcagcattctgaattaggaatcttgatgcagcacattataatgttttggtgaaaattgagcatccttttaattgcacaggtacaatgatgtctccagatatcgctgagatatttgtgaaagacatgatgttggctagatacatgcatgtaccaatatatgccaacaatgtgatttgaagaaaaaaaatacaaaataaaagttatcatcaagatagactgatacatgtaacaaaggtgcataactaggcgtgacccatgctatgtagatatggtatatctagatggacccaacctgctaacatgcgtgggagcataggcctatagatgccccttgagcatcacggataaaaggagccgagcaagagtgccccatgttgcaagagttgtgcgtgaggtgggcacggaggcatgatatagaggtgtaagtggctaacccgcgaaacccacttataagctaaaataagccgcgagcccgcttattagcctataagtgggttcgcggctgacccacttacacccctggcatcacatgatgacaaaggcatacatgcggaggtttggattgcgtggagataagacttattgggcattcgttccagtaacaaacaaaagatgcttttcaaatactcaccaccttttcgattatgagaaggctaaatttgtttttcaaaaataatctttgctatgtagttttagaattcttttcaccaacactatattggtaatccaacaaactatctcgctgaccgtatcaatgtttaaagggaaaattggaaccatgccattataattttgtaaaatttgagatatgccatcctgacccacatgtcattgactcatgtgggttctacatgtcattgagataccgatgacatatctcaaactttgtaaaattataatggcatggttccaaattagccttgtttaaaatgacacattggagtaagaagcacttctcgaccagcatatatgatgatgattttgtatatttatgttcttccatccataccttaagaaacaacggtatttttttctagtgtaataaaatgtggccgtctgtactcaaaattttcccaaaatgaaattttaaaaggcacactctaatttcctttaggctgcgtttctagtgtagttcgtttcgagttgaccctgagaaaatttactcaatttttcacgcgcacactttctaaactctcctaaatgattgtgttgtttgcaaaaagattttactttaaaaatttatattctaatacctaattaatcatactctagtaataataattcttatcgatttacgtgtcatcgcaatatttttcactttccccctcccatactccacacctttacccacactagaaacagttttgctagtcccactccaaaaccatattgccctagcgaaacaatcaaacggtccaaacccattgggcccccaccaaccaacccccccttccctccgaccccatgggcaactcccgccgccccgccgccgcggccacc

SEQ ID NO: 41001 - DNA, 1501 bp, Oryza sativa
atctttagtcccggttggtaacaccaatttatgggcccccttttcactttcgcaatcctccttggcgtcctgcaacatctgaccaagatcatccacaatgtcgttaccatcagcatccctttcctcctcatccatttgatttccttaaaatccagcgtactgagcaaagtccgtaatattgtcgtcttccacttcatcttcttccatttcaaccccttgctctctatgggatgtccaacagttatagcttggcatgaaccccgactcaaacaagtagaaatgaataatcctggatgcagaatactccttctgattcttacacttattgtatggacaacaaataaaacccttatgcctgttagctttggccactctcaaaaaataatgcacgccgtcaataaactctttggaccgccggtcagcgtacatccattgccgatccatctacatgaaataaaaaaaaatcgtacacaaataattattcgtacagtaatgacagtcatacaataatgataaaacaattacaaactctttcaacactcgtacagtattggcatatcattattcatacaaaaattataaaatattacaccaaataattcttatttactatttctaaagttttaaactagtattaatgtgttgtacttcttttagttttcattttagtttgttttctattatttaagaataactttcactaaattaatatattctttcttccctacataaattttctctctcatcaacttacaacaaaattttggagacaaaaaagtgtgcaaaacatagctccaaatgtaatatgacaaaaaaaacattggagtatgaagttgctaaccttctacgcacctccgatttgtatataatcaccaaaataaattcactagaaattttggcatgacctcccctcttttttgaagaaattttaaagcttgctcgggctgaaggaggaagaagacatatatatatataggggtgggacttaccaaccgggactaaagatctcaggggggcctgacaagtcctgactgcatttgaaccgatactaaagatcatctttagtcccggttttaattgcaactgggactattatagaattcggccgaccgacaaaagatgatttctccaccagtggtagtagcatccatatgatcaacaatctagctaactggtgatgagtttctctgacacaatctaggagccgaccagccaatacttttccagtgtttgcttcacaaccataacctaccaatcgatgccacttcgatcttcctcctttttcacagtttgcccatccagagtcaaaccattgtatctgtgccgatcaaccctaatctgtgcccatcaaacctaccacctgtggtcacttgcttccactacacggccatatggatcatcagcctgttctcacaaaaagaaagaacaccagcctttgaggccgattgagcgatcgccgcttgccacatgccgctttccattgcacgctgagtgctcatgc

SEQ ID NO: 41002 - DNA, 1501 bp, Oryza sativa
gaaaatatgttaaggaaaataaaagaactaagtaaaataaaataaaataaaattgctctaggcaaactcacctgtgacgggctctatctgtagggccgtcacaagtgacctcacctgtgacggcccagagtgttgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctccaccgccgtcctcgccgccgccaaatccgccgccctctcgacctctccgccaccctctacgccctcctctccaccgctgcctcgacctccccaccaccgcctcgacctctccactgccgacctcactgccgctcaccctctccgccgaccttcccgacgccggcctgcaccaccgccgccgcactcactctctcgaccgccaccatccatctccaccgccatctccaccgtcgccatctccgctgccctcctcgccgccgccctctctgccgccatctccgccctctccgccgccctcgccgcctccttctccaccgccgcctcctcactcactctctcgaccgccgccgtcctctccaccgccatctccaccgtcgccgcctcaacctctcctccgccctctccgccgccatctccgctgccctctctgccgccatctccgccgtcctctccaccaccatctccgccgccgtctccaccgccgccctcgccgccggtcgtcctctccgccgtccgtccatcgacttccccgacctccccgaccctgacctccccgacgccgggatccccgaccaccgccgaccgcctcgacctcttcaccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaattttgctgcagtggatgttcttttctttatggataagaacagattatctacacttattgatttatatacccttgttgtctatgaatagttgaattgttgtttatatacatgatttatatacccctgctgctgctgccacataaattattgtgggctgttttattatctacacttgccccttgctgtctatgtttgcccatgctgctgcctatggttgcaactgttagttaaaacttgaatgtgtagctagtttgcaacttg

SEQ ID NO: 41003 - DNA, 1501 bp, Oryza sativa
tatatatatatacatatgtataatatacatatatgtatgtataatatacatatatgtatacatatatatatatatgtatatatatatatatatatgtatacatatatatatatatatatatatatatatatatatacatatatatatgtatacatatatatatatacatatatatatacatatatatatatatatatatgtatatatatatagtaaatttgtttggtgctccatggtgcccggacaccatgattgaaattgagtatataccaaattcaaatgagtatgaatttgtgtatgccccatatgggtgtcatatatatatatgcatgtgtacggctttttgtccgcctacagtttaagctcatgcagtggtggagcatatttagccttatctttcgcttctatacgtactttacaatctttatattgcacagtttaggcacttgagtgttggtgcatggtttcatcttggttcaccttgttgtgatcagtgcatgatgtagacgttatactcgacgatggcgtcgtttttcttgaggtctaaggtgtgcgtcttcaactgggcgtagcctcgggagaaacggaaagtgccggtgccgccgatcactggcatctcccggacattgccaaagggaccattgcggccgagcacggtgaccacgctgccgttgtaggggccatgggtgaacaccaggttcatgacctgaagcaagccaagcttggcgaggcccgtgctcatgtacatcccttgggcccggcccacgggctgggactcaggttcaggcccctcggtcagcgcgtcatccatgacatacaactacccaaataatgactctgaaattgggtccaccgagtccaccacccttacagatgttggggacggcttgctcaccttgtcgttgaagtagaagtgtaggtgcgtcatcggctcagacgccaatccacggcgggtcaaacccatcgtggtttctttcgggcgggccgcacctgcagccgctgcaagggagagcacaagggtgatcaccactactcccttggcttccattgttgtgcttaattagtgtgtggaagctaggttctttctatatcttgtgacttgcgagtatcacttggagtgtgtgattcaagtggagctcatgagctacatatagtggtggcatgagcactcagcgtgcaatggaaagcggcatgtggcaagcggcgatcgctcaatcggcctcaaaggctggtgttctttctttttgtgagaacaggctgatgatccatatggccgtgtagtggaagcaagtgaccacaggtggtaggtttgatgggcacagattagggttgatcggcacagatacaatggtttgactctggatgggcaaactgtgaaaaaggaggaagatcgaagtggcatcgattggtaggttatggttgtgaagcaaacactggaaaagtattggctggtcggctcctagattgtgtcagagaaactcatcaccagttagctagattg

SEQ ID NO: 41004 - DNA, 306 bp, Oryza sativa
ttaaggatataaaaactctatctttacatcatcactttccctgcagaaatataaatatgatattcttggaatactcctaggcgaaatacgacagcgatatccgtgcgcttgcagatttatctgtgatcataagaaataccaatatctcctaaccgtgactccttgatgttaaatattttctctccaacttttctttgatcgtcccttcagtaaggaatgttggagcacaatgcaaattcagagggacacacagctctggaactgaggccatgcttcatgctgctaaccctacttttcactactaga

SEQ ID NO: 41005 - DNA, 1501 bp, Oryza sativa
atttgcataaatagcatttaataaacatttcagaatttaataaaacagttaagtaataattaaacaatattaatccaacgctatataacataccctgttgcataggcccaaccattctgaacaaccatcccggctgcacagttctatctccaaaccaggaattaaccattccaaaccaggagctaatcaaattattaccagttatagcatcttttattatggtgaaaagtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcagaaaagagctgtgacagtacctctcgcacaacataatccaccacagtgcaccactcccggatcatagtcacccccttataaacaaggtatggactccccagcgaacccccgtgggcttatctccgccacttctcagtctggtgctccgcaatgaaccatgctatacaaaaggtaaagccgttgcccacgctggcttgtggttggcacggtaaatgtttcacaaccgaaactcgtgaaccggtccttaattgtcatgagcacgaccatcaaaaccatctgctcacaacccaccattatcaagttttagttggcacattaattaattaaccaatcacgattgaccatcgtgagctatcagtaagagatcatgaaataatagtgagtcataagttatcccaatagtgtgctaatgtttctaagcatggctaagcaatcacatctaatatctagctgaaccaatatataaagctcaactagatcaagttataataacccaaggtatcaaggaataaagtaatcaagaacgaaagggctataacaaagaataggttaattccacccaatgacattcgaaaataaatgcaatagttaaatagaaacaatagctttaaataggatcaacatgctcaaagggttgtttgggatctgtgtgacttgccttgctggccttggaactcttcaaactcttctccggcgaaaacggactctccggaaacgacgaaatctaaacagaaagaagcaaaatcaccaaaacaacacataagcaagcatgaacagtacatgtggatatttttaacatgtagatctcaattttagaaaaatttagagacttgaaccaactaaatcggagctaagatgaattagttatgaatttttgaagatttaatcggattaaaacacttatatagattttaattgaattatgacgcaataatgaattatttttgaaaaggaaaagaaggtttattgcgtcagcggctagggtttcggtggaccgggcgcacgggcgacggttcacgcgaacggacggccgagatcgacttgatccaaaatggacggccgagatcgaacggtccacgaccggctcacggcagacggccacgatgacgtcagcgg

SEQ ID NO: 41006 - DNA, 1501 bp, Oryza sativa
tgcaacacaacacaatcatcctattgtcttctcaatctcaaataaactactggcggttatcatttgccatcacctaaccacttaccattgtgttcatttggtttcattagttcaaacattaaagatgtttttttcaccgatatatgtctgtatctaattcatcattcccctaatttcattcccattgcactatcttcggcctcttcgttgccaatgatgcacaagctattaaagagcacggtgttgttaggcaaaacacaaaccttggcatttgttgttgccattcgccaccacatatcacttgtcttaccactaacaacctatgttgttctcttcgagccccaccatgatactctatactaatagtaaaaagtagtctgaatcgttaatttcatttgatgaaatggtttaggtctatttatactaacaccttagttagcagtagtagaaacatgtagagatactgttgttcaaaagaatagatgcggatagatataatcatcatttaacaatgactaaaccttttttcttcttttttggattttttccatggaatattagcgatgccaacgtaatggatgatgatagatagttttagatgggaaaaaacataaataatagttactcataatcatgttattgtaaattactaatttacctataattagttggactctagctctagcctttatctaaaagttgggttacctgtgaacttagagtgatcctatcccagttctttaatgaatatttttagctatcgcttatattagccgctacccttgtttctcaatgaatatttattcgattacatagaaaatacaaacacacatacattcctaagcatttaacgacaatccaaaaccacaaaaacattacctaatgcattttaaaagaggcatgaacctataacaacttcttgactgtactaaattccgattcggaatttcactaacatgtacgcacctaatggtataactatgcacacacaattttaccacagtatagtcttgcatatttcaccgttttgttgtcgtcaattttaaaatacctgaggatataattttggtacaatccatccgtaagaaacaagactacaattcatgaaaaataataataaatgtatatttcctttaagtaaaaacctctccggactaatacaaacacatttctcctggtttcccgtttgccggggctgaaatgcaactgcactctacaggttcactcacgcgcaattagctggttttgatgggtcaggaggaaaaaggcgcctgccgaattgtaatgccgccacgctaaagacgaggggcggcggcgcggacagtcaaaccgctccctgactgcgccgagttttattccctgccgctccaccacccgcccgctcgcccatttcctctccctttttaaccccccacctcctccctcctataagtccctcctccccaccaccccctcatccgcaacaccgcagctgcacccgcatccgcaccgcaccatcagc

SEQ ID NO: 41007 - DNA, 1385 bp, Oryza sativa
cgaaccctggttggctcccatggcccacatctttcttccggatgctgacatgtgggccccacttcatgatgctccatgttttggcttcaaatgattgcacattttatatattgtagcttaaaaccatgtgagttcatcagagcaaaatatatttccattctttatgctcattctctcccaattttggtggttgatcacttgcatactaatatgcaccaacactcgtggaaattgttagaaataaatcctaccactatgttggatgtttcacatttatggttttatgtaggtattgacggcgttatttgtgcacttaacagctgtcaacaacctacctcaaacgtactgtgggatacacagcaattactagataacaataaactaaacaccatgtctcagcaattaatatctactttagtgtttataattcaccaaagcaatcactatattttagttgattatggtgaacaataattgtaacgccccgattttcgttcgggatttaaaatcaattaataatgtattttctagaaattaaataaaagttaaatcaatttaatcaagtgaaatattgagggaattaaactttcctttaaaaatcattggccgagaatattttgcaatattttttgtgccctgatatactaattttcggaattttcggagctcaatatctaattttaaaagtcacaaagttcatttaatcaattaaataaatctccccttcctccttgggccatttttggcccatgatcttttctccctccttggcccgctcgcacctctctccttccctcctccctctcgggccgacaactcccttctcggcccgatcgactccccctcgcgcaaatcgagccccactccgcccacgttgagctccgcgtcgccggccgttgccgccccaaattcgccactccccggcctccccgtgctctccttatccgtttcccccatttttcccaagcccgccacgccctccctcgctctccccgcgccgatccccatcgccgcccctcgctggcgaccttccatccacacgccaccaccactggcatcaccgcgctcctccacgccccgtcccctactccattttctctgttagcatccgaaacaatgccgccacgcgcaccacctctctccaccgcctttgccgactccgacagcgcgccacccctgccatagccactgctaagccgcgccactgccaccatcagcttcgccgcatcgcgtagcaccccggcaaccgctcctctccctcaaaccgcctctggaacaaccattccaccgcatcacccgagctccaccatacgccgcctccagccgcgtgccgccctcgccttagccatcgccgcgttgctccgccctcacctcttgcctacagc

SEQ ID NO: 41008 - DNA, 1501 bp, Oryza sativa
gcattcaaacggccagatttgctcccgcaaatctcgccggcgccattgatggcggccggacctcccggccggtttccttccttccccggccgccctctcccccttccaaccctatttaaaccctcctcgcgcctccctcgcccgtttccgccccttgccgcaccgtctcctcaccggaatcgagctcgcgccatcgccctctctctcctccgtcgccgacgacctccggccggccttctccgctcgccaggaccgtttcccgccccagcgtcgcctcctctggcttcgccgcaccgtcgccgtccccgtccaccccctcgtcgagctcgccgaccgccggagcgccgccgtccccgtcgatccgagccgcgccgctgccttccaccgctccggccgcctttttcgtcgtcgccgtcgacctagggtgagccgtggaccgccgcctcgtttccccctttccctcccctctctcggctgccgctccgccgtgcctatggccgccgccggcgaccataggggcgcgggcgcgccgcctcctgccggccgcgccgacgtggccgccttcgggcgcgccgagcggctgccgcgtggggcccggtcgtcagccgcccgcgccctcgggtgtggctgacgcgtggggcccacggcgccggccggtgtgagcccgggtgcacccggtccaccgtggaccgtgaggctgccgcgtgggccccactcccgtgaacccggtccgcgcgccctctcccctcggctgacgcaataaatccttcttaaattaaaatttaaatgaagaaattcgcaaatattcacttaaagagcatataaacttcaaatggccataggttggtcatttgaactcggaattggaccgttcaagtctctaattttttcttaagaagtcaagaacccatttttgtgctttgtccctgcttgttatatggagtttattagagtaaaagcctttttcctttccgttggtcgtgtagacgctgcagcttcggaagatccgctctacgtggaggttgaagccgacgtttgggaaagtgagcaaggcaagtcacatcatccttgaacatattgaatccccgtttataaaattgttttgatttaaattattgcattatcgctttatttaaattaccgcgttatcactattttgtttagccatgcctatttacctttgttatgaccttataattgttatcattattattaccttgttcaccctagaataaacaaaaccccaactagtgggtactctattcatggtaccactagtatgaatttaggtagatgcttcgctgtttaattaggcaacattaggtggttttacaactctagactttgggaatattcatgtcacctagacactatggaatggttggattattgtggaatcggattcacacctccccctctattcaaaatcctcaaaatggttttaggctgggctcggggtgcatggttttgatagtagcacctcggccacataaggaccggt

SEQ ID NO: 41009 - DNA, 1501 bp, Oryza sativa
ttgatatgtcctctccctcaccttcactcttgttgtcaatccctttgtccctgcactatccgtctctccagagtccacccccctcactttgctcagcacggcaacggcttctcctctgcataagattgggatgagggaactacacgagatggaaagctgataggaaagtcgttgttgcagagactaaaaacttcgaaacataatcaggcttgtggtagtggaaaaaggaatcgaattgctagcaatatggaagttgtgtgatgatggcattcaatccgtcacgatgtgggacgacataacaaggtaggggtgggtagaataagactaaaccaaaaagtccaaaatttattcggctaattccgtctgtggtcttggttaaccatagtgaccgatataaccataatgtcatttgtgatgtattgtatgtcgtatgaagttgacgactaaatgcatgatgcttgtgagttgatttattcttactacttgatcctatcatgtaatgtattgtttggtgtctgatgttgccttgtatatatgtgatatataattatcaaaagttgtcttaaaagaggtaaagttctgccaaaatttatcttctaaaattagcacagttcagtcaaaactgagactgaattaaccgatcctgacaattttgcattgttattcggttttcactttacaatgatcgaactgactaaatgactgaagaccgaatatcgagaccgggatttggtctgaccgaatacccacccctacaccacagtctaagtagaagtactataaattttcataacagtagagaaaaaatgttatgttcccacacgatacttttttttattattttgttgtagggagaagccgagtactagtgttttattctccacttagtacccgaaacatgtaaataacattatatgtaacattttgatctaactaattaaacatactattacctcggccccagaacataagaagttttattgttggacacagtttgtcggtgacatgggaccgggagtatcatgactagaggcttgaggcagacacaatcgcccacgtggcctgtcaccctcggggggcgtcgggcccgagggtgatgtgttcgccctcctctttgtctccccgaggggtcggaccgctcccgcctcggccccgagggccgaggtgccccgaccccttgtgggttttgcgccgcgtatatgaggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaaga

SEQ ID NO: 41010 - DNA, 1069 bp, Oryza sativa
gtactagtgtatcgtaataaaattgattacaacctttgtcccagaatatttttgtcattataggtctaaggttaaaagaaaaatactataatacccttaataaaatattatataggtagatgtggcatgatggtttaggggtatgattgggagaaatttgaattggaagtggttgatgtgacaataagtatttccaagtgacaattgttttaggacaatttttaaattccagagagacaagtattataatactatctccgtcttaaaataagtacagccatgagaatccgtgtccaacgtttgactgtccgtcttatttaaaaaatttataagaaaattaaaataagttaggcttaggcccagtttagttccaaactttttcttcaaacttccaactttttcatcacatcaaaactttcctatacacacaaacttctaacttttccgtcatatcgttttaatttcaaccaaactttcaattttggcgtgaactaaacacacccttagtctattattcatgttttatcatctaataataataaaaatattaatcgtaaaaaaattacaaataagacgaacggtaaaacatgagacatgaatagtacaaaactgcacttattttaaaacggagagagtaggactaagttttttttttccacggaaattgctgatattggagtaggactcggttgcttttagtactacactactatatggcgttgacagattggtcattgatcaatcaagtgattggccgttgatcaatcaagttaacacgatcaacggcacggggttggagtacgcccgttctccgtttcacccacatataagggtgcaagtaggtttacccgcgaacccgtttatagataaaaataatgcgtaatccgtcggtttgattagcggatacatttatttatatatttagatacgacaagccgggtcgtgacacgaaaatttataaattattatttatttaaactcgacggtcggccgcttgctcctcaacccacaactcgcgtcacctcaaatcaattctaccgcgcaccgttcgaccacacgtatgttcaga

SEQ ID NO: 41011 - DNA, 819 bp, Oryza sativa
tgctaggcaagtttgttatagaagacgcgacgaaagaagtccaccaagaagagaagaccgcccaacctatcttcttgctagcctcctcgaatctcggggacgagattcttgtaaggggggtggatttgtcacgtcctgataaattcatcccaaaattaaaaatcattcgctaaaaggaataaaagaattaattaaaattcgaaaagaaattggcaaacactaaaatacgtacaagaaaaattcaaatgtggctcggagaatttttgttaaattctccttggtctaaaaagagccctcaaattttagtggaattttcagagcacaaataataattattaagaaataaacaaagttaaaatgattttataaaaagaaaaaccctaaaaattctttttcccccccttcccctcttgggccggctcggcccacctccctccctctctctcctctcccccgcggcccaatcggcctcctccccgcgcgcgtgccgctgacgggtgggcccgcccgccaccctcgctgacgggtggggcccacctgtcatccctttcctcccgccgctcccgccgccgcgcccgtgccctagcgccgccgccgccgcgaattccgccgcctcccgccgtccccgcgcgcaataaagagggggaaatcactccccgtgattccctctctctttcccccctcttttccctctctctccctcggattcgtttggaatccctcccgaaatcttcgccggcgcatcaatggagcccgagatcgccgcgccgatttcattcctctccggccgccctctctcactcccacccctatttaagc

SEQ ID NO: 41012 - DNA, 1501 bp, Oryza sativa
tgtgagataaatgattcagatcatccaaagttccaaacagtgttggtgtttacacttttgatattgtaggaccattctatgtattactagcttgtaaagacgttattaaagccattctatgtattatctgtctgcctgggccgaacagcccatgcgcatctcaaccaaaaagagaaggaaaaagttcacttggtcactcatcttaccgttaggtttcaaaatcgcccataaactggaataccaattataatgtatccctaatattttaaaaccgggttacaatgggtctcattgtctcaagacaatatttagagcggtttgctgacgtggcgactgagtcagtgttgaacccacatgtcataaaaaaaataatcaccgtccctctcttccctccgctcctaatgtgattccatcaccgcagtgcccacgtccgggccagcctccgcctccgtgcccactgccacagcacttgtctctacctccgcacccactatctctcatctcgatgtcgctctagttctgcgacgacgatgactcgggcgacgtcgaccttgagccactttcctgctgcaatgtcacaccccaagccggaagagccatttgaggtagggctgctgtctccagctacaatggtgcttccctggtagtgaggtgggataacttctctgaagtcttgcatacctgggctcgggtgaggccgcaggtgtcgacgaggtactccttgacggcgaatggtttgagtgagacgcgcgcagtggtgaggggagacgatggagggagaagggccgaaaaatttcgacgagagggagaggggacacccaccgtagtagtagagaaaggatgtgtctccaaaggtgaattgtggtggcagcggtgcaaggatcatagccgcgtgaaatcacaaggcgttgtggtgtcagtggtagggagctcgccgacgcatcaagccacctccgcactgagctccttgcagccccgtcaactcaccgcacctctcctgttcggccatcgcccaccaccaacctcatggaggctaggagagagatgtgaaaagaggcggagagaggtagaagaagattgggccactggcatgtgggttccgtgctgactcagccgccacatcaactaaaatcattatcaatactggcttgggacttaatatgcctcagttttataatattagggatgtgctatatctggttttccaattcatggacaatttcaaaactcgatgacaagaagaggaacctgaagtgaactttctccgaagcagaaggccgaccagaaatcagcccaacatgagccccatataagttcgcacacgaaagcagcgcatcgctcgtaatccagcccaactccagagtcttccttttggtctgacacatttgctcgaagcgggaggaagaaaatcctctcgccgtttcagttttccctcccaaattttcgcccaaaattcccaaatcccacattcccctctcggccgcttcgacttttccccaaa

SEQ ID NO: 41013 - DNA, 1423 bp, Oryza sativa
caaaaattctccgggccacatttgaatttttcttgtacgtattttagtgtttcccaatttcttttcgaattttaattaattcttttattccttttagcgaatgatttttaattttgggatgaatttatcaggacgtgacactcgacaacaatagacttatcatgcaaaaagaacacccaagtatagcgagaataatcatcaataatcacaagacaatgactatttccaccaatgctgctataggttgttgggccaaacaaatccatatgcaagagctccaatggtctagatgtggacatgatacttttagtagcatgagaacatgcaacttccttgccggcttgacaagcactacaaagcttatctttctcaaacttcacatctttcaagcccacaactagatcacgttttgaaagtttgctcaattgattcatgccaacatgggctagcctcctatgccaaagccaacccaatgaagtttttgcaattaaacaagttgtcaaatttgcttcgctagaattgaaatcaaccaaataaagatttccatatctagaaacaaaaacttcttgtgggaagaaagcacatgacaagccaagatcacaaatttgagtaaccgaaagcaaattgatatttagagatttagcaagagagacattatcaattgccaaatcattggagatagcaattttacctaacccaattagttttcttttgctattgtctccaaatgtcactttctcttattctttcccttctacttcaaatgtggtgaacatagccctatcaccggtcatgcgttgagtgcatccactatcaagcacccaatgactccaaccggtgcggtagttcacctacaaaagaagatcaaggtcttttaggtacccaaacttgtttgggtccttggaggttagagatcaaaactttgggcaaccaaatggcattctttttaccactgagtataggggaacccacatatctagcaacaatgctaccatcatgagccttcctaagcatataatgagaatcaaacatgcatgtcatagaaggcttaccaccggggcaatcattcaccaaatgcccaacctcacggcacttggagcaatacttaccattgctcttgacaaaacgagtggcacagtgagaaggtttcttacccttctttgaaatgaatccaagtccctccttgttaaggatgcaccgttgctcactcaaaatcttgtcaagagtgttcttatccttgaagcacctctccaaactcttgttgagcttggccacttgctccttacgctcattgttctcaacaacaagtgaggcatcacaaatagaaacacaagagctagagctagagctaggcatatccacatgtcacgaccggaaataacccaacgggcgttccttacgtgcgtgcattattccttgtccc

SEQ ID NO: 41014 - DNA, 1501 bp, Oryza sativa
tccctcggattcgttcggaaagtttccccctaacttcgccggcgcatcaatggcggccggatcttccgcggccgattccccctcatccggccgttctctccccctcccaaccctatataaacgctccccgtgcctccctcccccgtttccgaccctcgccgctctctctccccgtcggaatcgagctcgcgccgtcgctctctctctccgccgtcgccgccgagctccggtccgccgccgtcgtcgccccggaccctctcccgtttcggcgtcgccttcttcgggttcgcccaacctcgccgacctcgtccacccctccgtttcgcccgccgaccgccggaacgccgccgtcctcatcgacccgaaccgcgccgccgccttcctccgctccggtcgccgttcccgtcgtcgccatcgacccggggtgagccgtggaccgccgtttcacttcccccttccctcccctctctcgggcgccgctccgccgcgccggtggtcgccggcggtgaccatcggggcgcgggtgcgtcgcctcccgtcggctgtgccggcgaggccgccttcgggcgcgccccgcggctgccatgtggggcccagccgtcagccgcccgcgccctcgggtgcggctgacgcgtgggacccacggcgccggccggcgtaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgtaaatatccatttaaagagcatatagacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagacccgctcttcgtggaagttgaagccgacgtttgggaaagcgagcaaggcaagtcacatcatctttgaacatattgaatcccagtttgtaaaattatgttgatttaacttattgcattatcgctttatttaaattcccgcgttatcattgttttatttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggcggtttaacaactctagactttgggaatattcatatcacctggacactgtggaatggtttggttattgtggaattggcttcacaccgctccttctattcaaaatccccaaaaatggttttaggctgggctcggggtgcatggttttgatagtagcacctcggccatataaggaccggt

SEQ ID NO: 41015 - DNA, 658 bp, Oryza sativa
cgccggccacatactccaccgccgttccccgctcctcccctggccggctccctccccgcgcctataaaatggaatccccatcctccgttctatagttttagcctcatcccgagcctccccatggtcgtatcacccctccccgccgtcgcccttctctttcccccgcgccggccgcctccaaccgcctgtgcggccgcgcgtgagcgtcggtcggccgtgccgtcgcttccctcggctctgtgacgccgccctcttctccggcctcacctcctcctcgcccgaagctcgccagagcggtctccttgtcggtgtccagtaccttcctgcctccggccggctactgttcctcatcggtgcggcagccgtcgtcgtcatctccttccccggctccacggggtcaccctccaccccgaccgctgcccgtcttcgtccggagcccgccgccgccgcgccggcctctctttcctcctcgtcgacgtcgctttcggcagccccttctgccatccccgtgcgccgtcggccgtgccaccaccacctccggcatcgcagcggcgagccagcgacgtcgtcttcggcatcgcctcctctccatcctggtcatcgcagacgtcccttgggtcggccgctcctcctcgccggctcctcgtctcgttgtgcc

SEQ ID NO: 41016 - DNA, 1501 bp, Oryza sativa
tggaaataaaataataaaattagtaaaataatgaagtgcaatttctaccgttagtgaaataaaataattaagtataacaaaaatatgtagtgtatgtggaaatatgttaaggaaaataaaagaactaagtgaaataaaataaaataaaattactgtaggcaaactcacctgtgacgggctcttattacggggccgtcacaggtgaccttacctatgacggcccagaatgttgggcccatcacaggtgaggccacctgtgatggctccacagttggcgcccatcactggtgacatcacctgtgacggccccatcgttggcgcccgtcacaggtgagtttgactagggttgacctagggttggacctcttatagatcgatccagatctggcacccactctcactcactcactctctcgaccgccaccgtcctctccgccgccatctccaccgtcgccgcctcgactccctgtcgccctctccgccgccatctccgccaccctctccgccgccatctccgccctctccgccgccctctccaccgccgccttgacctctccaccgccgccctcacggacgctcgtcctctccgccgtccgtccatcgacttccccgacctccccgaccccgacctccccgacaccgggatccacgacgctgggatccccgaccaccgccgccctttctgtcgccatcgccaccaccactgccacctcgacctctacaccgccaccctctccgccgccatcggctttcccgacctcgccaacgcctggattgatgacaccggcctgcaccgccgaccacctcgacctcttcgccgctgcctccccgccctcgtgttcgccgccaccgggatctaggacgactacggcctgcgccgccttctccaagtacgccgcttctccaagtacgccgccaccctcccccattcctccttttttcgatggatgaattgcattgtttagatgaatgaaatgtgatttgttatttcgattgttggtgctgctgtatagatgaattaaatgtgatttgttgtctgtggatgttttggatgaatgtaggggctagattttggatgaatgcagtattagagaaattattctattggtattagaggatcttagcatgaattttgctgcagtggatgttcttttctttatggataagaacagattatctacacttgttgatttatatacccttgctatctatgaataggtgaattgcatgaatttttgtttatatacatgatttatatacccttgctgtctatgaataggtgagttgcatgaattgttgtttatatacatgatttatatacccttgctgctgctgccacataaattattgtgggctgttttattatctacacttgcccctgcttgataaattaattgtgtgctgctgcctatggttgccttatgttaaatggccagtgatgaatgctcaaagtgatgaatgctcaagaacagaaatacctctaaacttgatctttttttaa

SEQ ID NO: 41017 - DNA, 1501 bp, Oryza sativa
gctctgcgcgttcatggctgatgcatctcccccctactcgatttcttccaaggaacttacaagcgccacgcgatcgaagacgacctacatgcgttaacgcagaacccggatgaatcctagagggattatgttcggctccttaatgagtgtaggaatacaatccccgagatcaccgacgcttctgtaatccgcgccttcaagtccggtgtcagagatcgctatactacccaggagctggcaacgaggcgcatcacgactactcggagattattcgaaattgtcgatcgatgcgctcacgcggacgacgcactaagacgcaagaacaacaaaccgaagaccggaggggagaagaaaccagtcaaggacgcacctgagtcaagcaagaagaaaaatcgcaagagtgggaaaaggaaagctcaagcggatgttctcgcaacagaatacgcagaccctcccaagtgcccagactcacaaggcagcgacacgaagaaaacatggtgccttatacacaagtcagacaaacactctctagaagattgccttgtcttcaaaaaatcgctcgcaaaacacatgacattggaaaaaggcaagcgagtacgtgtggtcgagaaggacgctgaggcggttactcaggaatcggactcagcatacccagactccgatctccatgtctcgcacatcttcggaggttccacggcatacttctcaaagcgagaatacaagaaggtggaacatgaagtctgttcgacgtagcagggggctgcgcccaagatgaagtggtctgagcagaagatataattctcagaagaggaccaccccaaaactgctgtcatcccagggcgatatccgatcgtggtcgaactcactattcagaatatcaaggtcgcatgagttctgatcaacggcggtagctcaatcaaccttctcttcgccagcaccttggacgcgatggggatcccacgaagcgagttgacacccaccgatcaacccttccatggaatcactcctcagtcatcgtccaaaccattgggcaaaattacattgcctgtgactttcggccaagcaaataacttccgaacagagcagatcacctttgatgtcgctgaattcgatacagcatacaatgccatcattgggagaactgcactcgcgaagttcatggccgcatctcactacgcgtatcaagtgctcaagatgccgggaccgaagggaacaatcagtattcaagggaacgctaagctagcagtgcaatgcgacaagcggagcctcgacatggtcgagcacacgcccagcccacccgacacagctgagccacccaagaaagtgagcagaacaaacaaaacgccgaaaccggacggcgcaatcaagatcgttccactctctagtgccaaccccgacaagaccgtcaagatcggggcatcactaggcgagaaataggaactcgcgctcatcaccttcctccgcgacaatgctgacgtgttcacttggcagccgtccgaca

SEQ ID NO: 41018 - DNA, 466 bp, Oryza sativa
ctataggtctagttgctgtttgtgctagcatattcttgttataggcaactagatctaggatttactttgagtttgggctgactccgaaaattactgcttccgcttttaattgaatttttgaattagcctattcacccgcctctatgcctaattgatactttcactttgaaatctaagattttgacattctaatcgggcttcccatttgagaaactcctaataaacatgccctgattagatagcctcaagataactttgggaggaaacgaattctcagttgcattctcgcgggcatggttcgccttgaccggctctctcctagagattgagtctgcggaggaggttagagcagttccccctcacgagtctcccgaggcccttctggaaaatgaagtccctgacttcatcaaggaagaagcggaacctagtgagactctcgaacttccaatcatggaactgccacctc

SEQ ID NO: 41019 - DNA, 1501 bp, Oryza sativa
tttgtaacttgtattttttcctatgtgaatttagcgaaatgttgttaacttaaaattcggtcaaaaattaggcattgtcaaaattttggtaatacatgatcatttaattgatgtcaaaattttgatgaaggtagcgtttttttaaagaccatcgtgtagggtgttcaaaaaactgtgcttacacagagcaagcttggtatgtattactgtggattgcgaagtgagcgtaactcaactttaggtttcttgtggtcgaactggccctccaggtttaaattctagatttaacacgggtgctcgaatttacggctaattattttttttagtgataaggcaatgcacccgtcgatagcaagatgtctatggtgacttcgtcaatctcaatatatcctgagcaattctttcgaaggtattgcaatacgatgttgaaatatatttttttaaaaaaacaattcttatatgtcggtttggattagtactctgcctacccgatcccttatattatgagacacgcttttaacccctaatcccatataatgtgggacggagggtgtcgacgggggatatccgtaaaccggatatagagggtattggagtacgctggtacaaggatctacgtaatacgacatcgagtaggcagaaaacaaagattatactggttcaggccccttgataggtaatagccctaatccagttgatatgggattatatgatggaaaccacatattacaaaggaaatagtggaactcgacgataccaatgagatcgtagtcgagttgattcgactagatcacccggcgacttggctcctgtaggctccggcttcgtaggctgtggtggatgtgttggcggtaagattcgatgctttaggtcctcccggggggtcccttttataccgcatgtcaactggtctccaagtagaactcggagacatcggacccggtacgatacaatgacgacccatttatatccgagtaggactccttccatctgtaaactccataatgaatttccttaacgtatgccgaaaacgtccatatacgcgtaagtataccatatcgatatgtgacgtatatcgaagggtagagggtataccttacccgtaaccctgacagtagcccccgacttctacttaaatgaactcgcgaaaccgatcgcgacttctgatgtcgaggttgtcatcgttctcggtgtgaggaccgagagacaaggagtgatcgacaacgccaggtgaagctcaacggtcatgagtgaattaaattgaagtccgaaaaactgccgcgcgtaacagacccagaaatttccggcggccatctctctcctttccttagaattcacaccgtcggaagtgcgtctatttaagggagttttggggatccaatttgaagtccgcctgttgtgaaaaaactctccagcctccaagtgtccctcgtcttctccgctcccacaaaaaccctagctagctcatctcggtcctttctccggcgatccccggcagcaa

SEQ ID NO: 41020 - DNA, 531 bp, Oryza sativa
aataaaattgcatgcaaatgatgaacgtcctacttgtgataatacggtgccttatttattgcttaaaaacccttaaaatccttgtacccctgattacgtatgagtccctagtcaattatgacaattgcttagaaatgctatactagaatcatgcatactcatatttatcaaatgctatatgcttgggcaattacttttgggaaggtaattgagatgcggcacgtggagacatgagcgccacattgccatgatgttgatgacatgatttgtgaaaggagaaataaaattaaacaactgttttcgactggggcggaccgaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggta

SEQ ID NO: 41021 - DNA, 323 bp, Oryza sativa
caaagcttttcgataacctcgcattggcagtacctgctccatgaacttaaatcctcatgcactctaggcgtccatgtttctagcagtgagaggagttctggcgctcccgggaaagagaagtctcacacacatattaaatttatggttcaagttaagttctctctcacacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctagg

SEQ ID NO: 41022 - DNA, 459 bp, Oryza sativa
caaacaccatcaatgcatttttgtttaatcaagggctgatgaccccaactctcatagatatcagcatgatcacgggtctggatgtcacctcatcggccaaccctatgagtttgaatacaaagaaccaatatgacttcaagaccaagagcataggcagctggttaggctatgtagcagcatatatgggctagggtccagttaccccccgagaacatgtggctttcctgttaatgtggttagaaaagtttctcttttgtgggtctagctgcggtcctacaaccaattggtagttcatagccgaagctttggagacaaaaggacaatttcctttaggcaaaatactcctcagctacttgtaccaaatgctgaataatgcatcggctaagctaattgtcagctcagtagtcggagcgggtggaccatggtggctgctgcaatcctggctaaacttggtagtca

SEQ ID NO: 41023 - DNA, 1501 bp, Oryza sativa
ttctcccttgatgaatgccgactggaaggatgcatggggtgattgcagataagaagatttttctgggcttttgatatctgtcattgttgatgtcttcaaatctgaagtcccatggattttccagaagtgttgagtctccatagagaaaccaaactcgagcatccttttggaacccctcataaaagttgcaaaaccagtctttgagcagctcagccgatagttttgctcctgcatcagttggtgtagaggcgtactctccatatgatgtgcatctccgatgagtgagttcttctccgtcatcgttgacagtcggctctaatcttgggaattcagtttctgttatagatggccgattgacgaacctcatgactaccaagtttagccaggattgcagcagccaccatggtccacccgctccgactactgagctgacaattagcttagccgatgcattattcagcatttggtacaagtagctgaggagtattttgcctaaaggaaattgtccttttgtctccaaagcttcggctatgaactaccaattggttgtaggaccgcagctagacccacaaaagagaaacttttctaaccacattaacaggaaagccacatgttctcggggggtaactggaccctagcccatatatgctgctacatagcctaaccagctgcctatgctcttggtcttgaagtcatattggttctttgtattcaaactcatagggttggccgatgaggtgacatccagacccgtgatcatgctgatatctatgagagttggggtcatcagcccttgattaaacaaaaatgcattgatggtgtttgaccagaagtaagaagcagctgccatcaagggttcatctttggccgagtttgctatagtgaggtcaagtgcttggccgattccaatttcatcccagtgaacccttttgcttgctgatacatgtttgaaccatgtggtccaacttttctcgggtggaactttctctagagacggccaagatttgaaggtattcttccagtgacctagatctggattggttaatctgaagggaatcctattggtttcaccaatgataaactcagtgggatcaggattgctaactgggccgagaaagtagtagttttcgtgtgataggcttggaatcgcaactaggttggagagatgctacaaatccaaaacaaccgagaaaaagagagcgatataagacaagaggaaatcgatctgctgctaagaaaggggatctagccaacgaggacttatctcagcgtactcggctgatggcgcatcagatgggttggtggaggacgacatcgctgcgggtggaaatctcgccgaagatgaagtcgcctggaaatcgctattgcgtcggagagatcgccggagagagagaggacaaagtatcgcttgagcggtgaaaacaaaagtcacggcgtgagatttcttgagggcaacggttagtatttaaagcgatagaataacggtcgaaaaacggcggaa

SEQ ID NO: 41024 - DNA, 1501 bp, Oryza sativa
gtaatcacgtgccacataccaccacggcatacggacgaaagacgtgacatagttcccaacccatcctagccataaacaagagtaccgacccaaccccacctacggccggaacctccgggacaggcaggcaggattgagcccctagcattaggacaccagccctgtgccatgacatctcgactaccgggccgcagcttgtgtagccttcatttgtcctagagatgtccatcgacccccgacttcgtccaactccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaaaagagggggaggtgtgtgtccaattccaacataagccaaccattccatactgtccaaatgatatgagaattcccaaagtctaaagttataaaaccacctaatgttgcctaattaatcagcgaaacatctacctaaattcatactagtggaaccataaatagagtacccactagttggggtattgtttattctaaggtgaacaaggtaataataacaataacaataataataaggtcataacaaaggtaagtaggcatggctaaataaaacagtgataacgcgggaatttaaatgaagcgataatgcaataatttaaatcaaaataattttataaactgggattcaatattgtcacgctcggaaattcactagtaatttccgaactaatttgtacataaaatcctcgtccaggaatcagccgaggtacacaaactgacaatttaatatacaaatccatcttaataataacgttacatacttacaaagaaaagaaaacagcagcggaattaacggtctagcgatggcttcagctccactcccacaggcagctcaactgggtataagccaaacgtcttctccttctggatcctttatcttcaggtgaggtttgatgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcatcaattttaatcaacactgaacagcacacccatgctgcacaggcccaaccatcctgaacaaccatacccggctgtacagatctaactccaaaccaggagctaagcaaattattaccagttataacatccataattattgtgaaaggtgtgagactaatcacgaaaaacattgctcaactcacccataaccgcgggtacggctattcgaatagattaaactctaatcagaggtgtaccactgtacccacaagacacaaccccacatcatgtcaccatgtgcctcaataccaccacg

SEQ ID NO: 41025 - DNA, 1501 bp, Oryza sativa
aaatttgcttaacaactaaaatatggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtgtttacaaaatagctttgagtaactaagtgtcttttaaatgccgttttctgcaaaacttaacccttattattaccccttgtacccccttgcattaatcatgcatctcccggtgtggcttgctgagtactgtggttgtactcattcttgctctatctttcccccccttcagtaagaaaagctttggagaagaagtcttaggtggagtcctggcttataccccagttgagcgcctgtgaagatggagccgtaggcctgctagtccgctgctatttatttttgattgtcaggcctgaagtgcctttgtaataatgtaaatattatcgatgtattaaagatgttccctttgtatcatgtttgtttggtgtaccccggcttttcctgggacggggattaatacactagcgttcaggataaggcaattttctcggtcgcgacaccaaccattccacattttagttgttaagcaggttttaagaattaaaacactaacttgggtacattgctaggcttgcccataaccgagggcgcggctattcgaatagattatactctgatcagaggtgtacatctttacccacaagacacgtcttcctcacgtgtaatcacgtgccacataccaccacggcatacggacgaaagacgtgacatagttcccaacccatcctagccataaacaagagtaccgacccaaccccacctacggccggaacctccgggacaggcaggcaggattgagcccctagcattaggacaccagccctgtgccatgacatctcgactaccgggccgcagcttgtgtagccttcatttgtcctagagatgtccatcgacccccgacttcgtccaactccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaaaagagggggaggtgtgtgtccaattccaacataagccaaccattccatactgtccaaatgatatgagaattcccaaagtctaaagttataaaaccacctaatgttgcctaattaatcagcgaaacatctacctaaattcatactagtggaaccataaatagagtacccactagttggggtattgtttattctaaggtgaacaaggtaataataacaataacaataataataaggtcataacaaaggtaagtaggcatggctaaataaaacagtgataacgcgggaatttaaatg

SEQ ID NO: 41026 - DNA, 343 bp, Oryza sativa
cgagttttataatcaagatttagtagggagttatagtgagcgtgttaggccactttatccgtccccataaaagagtttaaaaagcgatttaaggagcaattgaacggtggttatgaatcttaaagcgactaaagacgagatgagcggtaatgtaaccgaagtatagagatatatgcgcgcgtaggctctgtacagaccagtaagacactttatagtaggcacaaattattagaggataatacgctagataaccatcaccgctgaattcgatagaggcccccaatcggtaaaaagaatgtcaagcggtatgcagcaaagggggccaattgcaaatgggcggaag

SEQ ID NO: 41027 - DNA, 190 bp, Oryza sativa
cgagagaattcctctgggggacaccgggggagaaaaattagattcccgcgtggtggttaccacccatttgtgcgtgggcagatatcataaggaataaaactgggcagggtttaattgagatatcaccattaaaggggccttatcctgtgaatggctgtattgatggcgacaaagagaaatattgctagga

SEQ ID NO: 41028 - DNA, 581 bp, Oryza sativa
aggatccgcgcccccttcgccgcaccgccacggattcgcggttttggactctctttcaacaagactttgatgagtctgtgatcaagtccaaagctcatcccaccgttcccatgcaatggatcaactaggaggagctgcaggcgcatgatgatccggtgctaaactttgtgattgcaaattgtgagctcatgggaattcgctctttcgtgactttgcagcagaattggtgcagcgaagtcatcgctcaattatatgccaccgttttctttgatccttattgtgccatgcattggatgacccaaggctcttactattatgtctcctgtccgcgatttgttgagatttggggttttgacgtctgttccttgctaaaccttcctgatatgcatgatcttcccattcctgccaacactaatctcctccctctttacactccaaatgatcctaatgtggtgttgggtaaagtcgacggtctcaaaccgtactttgcctgcttgaaccggatgttttgccggtcctttgtgcctaaggatggtgatgccagcagcattaaccacctctccaggaccgtacttctcagg

SEQ ID NO: 41029 - DNA, 1501 bp, Oryza sativa
attcttctcctcttccttgtaaaatctaacattttcaaggagcaaaacactaccatttggcaattcagataccaatttctcaacatctggtccaataacatcttctgccttagtcacctgtttgcgaatacaaatatggtttaatcagtgtgatcaaattagcccgtaaagattcaattagaaataacagtaacgcagaaacctgtatgccgagaagttcagacaatcgcggtacaaggggagccaagctaaacttgggagtaacaccctttgggcgaccctgcacatttataggagaaaacgaataagatcacaattgattcatatgcaacgagtaaaaagattggtcacatattactttgctagattatttgcaacaacatttgataaccaattttagcctttcaaacagcacaacaagaaaaattcgtgcctaataagacactatgcacaacaatcatcccatggaatcagatgagatcacagcgactggcatcccgcaggttctgagatcctgcattgtatatctgtgacaagtagcgttacattgaggaaaaagatgagggacggaggctttaccaggtggctggagaggatgaccttggcaccgttcttgataaggtactggatggtggggatggcggcgcggacacgggtgtcgtcggtgatgttctggttgtcgtcgagcgggacgttgaggtcggcgcgcacgaacacgcgcttcccctcgaggtcggcggcggtgaggtccccgacgctcttcttcgccatggtggcgacggcgcgcgtcccgcgcgaggacgacgacgccgcctgccggcaccgcgacgcgacgtgggtcgccagccgcgggtccgcggccgccgcgaacgccagcgaccgcgccggctggcacccggccgccagccccccgcgccgtagcggcgacgcggcggcgggccccaccgccgcggcgcgcctggcggcgagggagagcgaggacgtggtcggcgcggccgcggacgccattgggggaggacgagggagcgcgcgcggaggctggaaccgcgagaaggtgggaggcgggagggggacgaggggttggggggttggtaaagaaagagggttttgtggacgagaggggggagggggagatttgcttatcgctggcgagaggttgggaacttgggaattgggatgggaggtgggggtcgatgataccggtggttgtgtgggggaggaggcggcggtgatcgccgcgacggcgacgtgtggggcttgctgccttccgtgatcgccgttgtttttttgtgtgatccgtgtgatcgaatcgatcgatcggagtttggagaaaacttgtccattttcgtgtgattcgttgaacacaatttttttctctttttttagacaaaacactttttttttctcgaggccagttcagcggtagggatttatcaatttgtcattggcatattctttgtcacagcatactaccatagcacatctcgtggaacatgctacg

SEQ ID NO: 41030 - DNA, 1501 bp, Oryza sativa
cgatgtcataaggcttcctgcaaatttgagatatgctattaacaatacttcaatagtgaatgattagcgatacaagagaaaatgctaagtgacatgtacctggatgacttcctgattttcggtatgggacgactggatgttttcttcttcgggttagcttgtcttggctgttttccagtcacccctttgctgccagccttttcaacatcgtcaccctcatcgtcactcagaactaatttcctcttacgagagtctgactggttagtcggcttcgaggtgtttggttgagcatcggaccggatttttggccttccactagcctgaccagcctgccgacagggtgagcggtgttgagcgatcggaggatcagacttcatcaaggaaaattcctatgcatgatattccaagttttcaatcaaccttgcagaagacaaaaggatgtttttcagagaggccgagatgttagatacaaaccggtggaggagtgcttgggcagcctcatctccaattggaagcaagttccaggtgtcttgatatactggaggaagacaggtgtactcaggaagcgctggttcaggattctgcacataaaaccaatttgcatgccaacccttgttcgaggttttagagggcatggagaaatatttctggctcaaggttccccttagttgaaaaccggctcccccaacaatgcatggcttgctcttgtttggctggggcttgaggaagaagatgtggcggaatagggcaaaatgcggtctaatacctaggaaagcctcgcaagcatggatgaaattggcaatatggactatggaattggggtttaggtgatgcaaactaatcccgtaaaactccagaatcccccggaagaatcttgaggttggaagagaaaagcccccatagaagaaatgagagaacaccacgacctcatgtgtgtcaggggtcggaaatgcttcgccgcatgccggacgccacccgatgatctccttcgccggaagaacaccatgcgccaccatctccttcaaatcttcctccgtaacatcggagggcgcccactgactttcgaagctctctctctcctctgccatggatgcaagtgggatgatgcgatttgatttggaagtggcgaggaatggatgggaggttgatgcggtggttgcacggaagattttgtggaagctgtgaagttctagagagatggattggagtggatttgtgagccctagctttcgctggtgtggttttgcattgtagctgagggtggggaaagtggcgaaggttttggcggggaagacaaatcaactcgacatgatgtcgtacaccaagtcgtattgtcggaatcggctgtatcacctaacccagtctgactcggacttagctgatctcaatcgtatccgatccggactcccgccgattcttgctctgtttccgcgacaatcctcgtcttagattccgtttcgatctaatcttcttttccaatgctgatattaccaaatttggt

SEQ ID NO: 41031 - DNA, 1501 bp, Oryza sativa
gatttatttgagctaaggaagtatttttaataaatggaattgcatttcatgaataattttaattgaaaaaggtttttaaaagtctcttttggctttgggccgaaagtcggcccaaaaccctctctctctcttcccccggcccaagtcggcccagtccgcagccgcgcgcgtgcccggtcgctgacaggtggggcccatctgtcggacccgtcgtcttcctcgcgtcgccgccgcccgaaaccctagtgccgcgccgccgccgtttccttccaaatccggccgctcctttcccgatccggtgaaatcgattgaggggaaacaatcttcgggatctcctctaccttttgattcgaggtcgattcggatcggtctctctctctctgagcccgagctttccatcccgccgcgggtcgccgtgggccttcgccgccgcctcctagcccctttaaaaggatccccggtgtctcctctacccgtcgccaccctcgccttcgtctctcgccgtcggaagagccctagcgccgtgggacctcgcgccgccgtcgttgccgccgctccagccgtgcgccgccgtcgctcgcggaggtcgccttcgtggtcgccgtcgcgtcgccgtcctcgtccgccccttcgccgtcactgaagaccgccggagcaccgtcgccgtcgtcaagccgaaggtctccgccgcttcaacctcgtcgccgtcaccgtccgctgctcctccgccgtttctttggtcaccggtgagttcgccgcgccgtccgctacccgtgggtgctctccgttcgcgccgccgcaccgtcgttcgccggcaagcttgcgcgcccgagccgccaagccgccgagccgctgccgccgccggcgatgacgtcaccactgacgtcatcgtggccgtctgctgtgagccggacgtggaccgatcgatctcggccgtccgttttggataggatcgatctcggccgtccgttcccgtgaaccgctgtcgtgcgcccggtccaccgcaaaccctagccgctgacgcaataaatctcttttttccttttcaaaaataattcattattgcgtcataattcaattaaaatccataaaagtgatttaaatcgatttaatctttaaaaattcataactaattcatcttagctcggttttagttggttcaagtctctaattttttctaaaattgagatctacatgttaaaaatatctacatatactgtccatgcttgtttatgtgctgttttggtgtttttgctcttttctgtttagattccgacgtttccggagagtccgttctcgcaggagaagaatttgaagagttccaaggccagcaaggcaagtcacacagatcataaatacaatcctttgagcatgttgatcctatatttaaattctctatttaattcaactgtggatttattttcgaatgtcactgggtggtgtgaaactattcctttgttatggcctgtttgcattgattactttattccttgataccttg

SEQ ID NO: 41032 - DNA, 599 bp, Oryza sativa
  unsure (1)..(599): unsure at all n locations
cgagccnaatggataactagtcgtacagnagncatcattcctatttgatcatgtatgcactaaatttaacttgcacaacgatatgtattttatttttgttctattgacatatactatgagctcaccctatatttttattcttgattcactgtcgtttcagacggaaaccaacactatcgttttcgtttccatatttttctcgaaatcataatcgaatcggaagccccggatataaaaacggaatcaaatattatagaatataaaaacagagcgaatacaaatcgtagcgaataaggtaatggatatttatcgggatataaaaacctctcgaactgaacttctcaaatcaacaaaaagatgtagcgtgttatttttctttctaaaataatagtcaacatttctacttttttatataaattttaataataataccactggttgtatgcttcaatacagagtggtttttttatctgcagaatttagaagcagagctgtcaaatactccgagacttgaaatttgaagccatgttatgtcacttactgtcagggttacggcttaggcatatcatttgcccttcgatatacattacatatcgata

SEQ ID NO: 41033 - DNA, 1501 bp, Oryza sativa
tggacccatttgcccttcgtcttcctcgccttaatctcccattctgtgtcatctcgttctctttattctttgtcttcaccaaaccctagctctcgctccccatccgattatacaccatgtggaagacagagtgttcaacgggagctctcgggtcggtgcccacaatgacggcgctggcgtcgttgccaaatggcaatgcgtgacgagggtgtcaaggtgggccttgtcgggggcggcgaacactatgaggaagacctccgtgcaggccacgagcacgcgcgccccgtggttgttctcggcgatgtccttggtgaggcgaagcgcgctgcagctggcggagcagccgtgcatgtagaggatggtgcgttggacggtggcacggaggccgaggagtgccgcgagccactcgtcggtcccaagggagtgggcgccggcgttagtggagacaacgaggtgggtgatgtccgcggtggggtggccccacttggtgattaccctcaccgcggtggccatggctagctttggcacgcgttcttggtgaagttgagccgagcgtcgagagatggaacggcgcggtcgaggaactctggatggccggcaatcatctcctccatgtggctcatatgaaccaaggcatgaaggcaatatggtctttctaactcttgactaacaactaaccagttcactggaacgatgaccacgacggaagtgttacggggtgaagaaaaaccggtggcatgtgcttctaatcgaaagcgaaaaattattgtgccattttttgtaccgctttctttcctatgttatggatcgaattttctattttttcccctccagtttaacatatacaacacaaaataatactcttgcttcctgcattctcagctaaaaagaaaggaagaaagttcaattgcacttttcttacacagccttgtaaaaaaaatggcatacaaaattaacagtcatgtgggtgtcaggttgatcaagcagtaaacaataatcatatactccgtagcatgttccacgagatgtgctatggtagtatgctgtgacaaagaatatgccaatgacaaattgataaatccctaccgctgaactggcctcgagaaaaaaaaagtgttttgtctaaaaaaagagaaaaaaattgtgttcaacgaatcacacgaaaatggacaagttttctccaaactccgatcgatcgattcgatcacacggatcacacaaaaaaacaacggcgatcacggaaggcagcaagccccacacgtcgccgtcgcggcgatcaccgccgcctcctcccccacacaaccaccggtatcatcgacccccacctcccatcccaattcccaagttcccaacctctcgccagcgataagcaaatctccccctcccccctctcgtccacaaaaccctctttctttaccaaccccccaacccctcgtccccctcccgcctcccaccttctcgcggttccagcctccgcgcgcgctccctcgtcctcccccaa

SEQ ID NO: 41034 - DNA, 314 bp, Oryza sativa
ttgatggattctatggatgtatggaatgatgttggaattgatggatggatgtatggttctctggatatattactgcctgtgaatatattattgcctgtgatgtgtgttgtgtgcaaagtctgactggacagagagcagtcttgctaagttttagcaggactgcaaactcagcgccagggaaaatggcgctgagattttcaccctcagtgccaggtgcactggcgctgaggtcccagcccagccatccagaaggcttgctgggccgggccatggccgattcggccaagtcccatccctaggtccagcgccattat

SEQ ID NO: 41035 - DNA, 274 bp, Oryza sativa
cagacttcaacgcaggcatggcaaggaagtcactggccattaaatgaaggttgaaatgggcgtccaccggaaaagcgggcgagcggggcaggaggcgtgtgctctgcttgtcagaagtcatttccggctgtagactagccctcattgtaaaaagcatgtttcctttcttaggcagctagaggcccatgtggtgacccctgatcagataaaaaggaggcccaggcctaaaagaaagaggagggaaaaaagaggagaaggaggaaggagtgctaga

SEQ ID NO: 41036 - DNA, 1501 bp, Oryza sativa; identical to SEQ ID NO: 32458

SEQ ID NO: 41037 - DNA, 181 bp, Oryza sativa
aggctctcatcctgacgggatgggccgaggcgtgcgtcagaccgcctgtcgccacctaacccacgatctgatcggtctgtgactggtcactgaccggataaacgagcgcggtgcactgcgttacatgcggcgtgacgcgctcgtccaaaccgcaataaatgtggttaggtgagccccgcta

SEQ ID NO: 41038 - DNA, 1501 bp, Oryza sativa
gagtattcatattttagttacaaaatatgaggctaaactttatgtaaataatttataaatcatggattcatctacatatatggtcagtgattaataaatagcaatggtactttctatgcttcaattaatttgaaacaatatttataattaatttatgtggttgttacagtgacaaaacatgttaaatataattatttgacatctactctactgtaaaatatcaattgtatttattaacacatttttaagttgaccataacctaatcatatgatattaattatctaataattataaatatattttattaattagtgagttatataccattggaaagattatgaatttagattcaagtttcactcaaatcggagctaaaatgaataagttatgtagtttaaagattcaaatttgaattaatccgagaaattgtaaaaagttactgtgcgcatactgtttatttttaatccaacattatccataaccaccgtgactgacatgtgggaccagccctggttgactagggtcaaactggcttgtttaataaccagtgggtcccgcttgtcatggacacaaagtctataattaagttctcttagattttaataacagggaccccacatgccattgagtgggctaatcatcattaggtggaggattactgtgcgctaattacatgtgggtcccgcacggtttctctctctctctccttcctttctttttcccgtcgtcttctacctctcgctgcggccgaacagaggaatggcacgcagcggtccgacggctcgagccgggacggctcggcgcgcggtggagaaaggtagcggcgcatcactggaaacccatcggcggcggcggcgaggcacggcggccacccgacgcgcggcgcgacggcgcgtggcggcaccgagatcgcgagaacggcggcagcgcaatgggtgtcgattcaagcacagaagacttcgatttaaccatctagggttcacatggagtatagaaaagcaaaaatctagccgattctacattggaacgaggtcccgccacggcgagctcaaccatggcgccgtggtggccggggtaggcatggctacggcggcgcgcaccccaaatcgacggggccgcaagttactaagtttctgggagttgctctaggcgcgagggcttaccacgggaaggcgagacggcggatttcggcgggcgcggcgcggtgcggacgaaacaggggcggctagctgtcgacgacagtcgcaggtgttcgacgcctggtctccctcgttcagcggctcccggctccctccaacagcagctacagcaacgcgagcaactcctctccacaccccgccacccacaccggctgagaagccctgtggcggcggcgcagccctcgctcaccaggtgttcgacacccggcgggcggcgcgatcttgttcctcttcggtggagcaaaaattttagggagaggaagagcaaatgggaggttgggtttggatgagaacgagccag

SEQ ID NO: 41039 - DNA, 1076 bp, Oryza sativa
tcacacaacacaatccaccacagcgcaccgttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccgatccttaattgtcatgagcatggccatcaaaaccatgtgctcacaacccaccattatcaggttttagttggcaatttaattaattaaccaatcatgattaaccatcatgagttatcattaagccatcattaaataatagtgagtcataagttatcccaatagtgtgctaatgtttctaagcatggctaagtaatcatatttaatatctagctaaaccaatatataaagcccaactagtcaagttataataactcaacgtatcaaggaataaagtaatcaagaacaaaagggctttaacaaacaataggttaattccacccaatgacattcgaaaataaatgcaatagttgaatagaaacaatagctttaaacgggatcaacatgctcaaagggttatttgcgatctacgtgacttgccttgctggccttggaactcttcaaattcttctactgcgaaaacggactctctggaaatgtcggaatctaaacagaaaagggcaaaatcaccaaacaacacataaacaagcatgaacagtacatgtgaatatttttaacatgtagatctcaattttagaaaaatttagagacttgaaccaactaaatccgagcaaagatgaattagttatgaattttcaaagattaaatcggattaaatcatttatttagattttaattgaattatgacgcaataatgaattatttttgaaaaggaaaagggaattattgcgtcagcggctagggttcgcggtgaaccgggtgcacggcggcggctcacggaaacgaacggccgagatcgattcatccaaaacagacggccaagatccatcggtccatgaccgggccacggggaacgacgacga

SEQ ID NO: 41040 - DNA, 1501 bp, Oryza sativa
aaaggttttataaaaagaaaaaccctaaaaaccctctctccctctcttgggccggctcggcccacttccctccccctctctcctcttcccccgcagcccactcggcctctccccgcgcgcgcgtcgctgacgggcgggcccgcccgccaccctcgctgacgggtggggcccacccgtcatctccttcgtcccgccgcctcgcccacgcctagcgccgccgccgccgcgaatcccaccgcctcccgtcatccccgcgtgaaatcaataggggggaattactccccgtgatcccctctccctttccccccatttttccctctctctcttgcattcaaacggccggatttgctcctgcaaatctcgccggcgccattgatggcggccggacctcccagccggtttccttccttccccggccgccctctcccccttccaaccctatttaaaccctccccgcgcctccctcgcccgtttccgccccttgccacaccgtctcctcgccggaatcgagctcgcgccgtcgccctctctctcctccgtcgccgacgacctccggccggccttctccgctcgccgggaccgtttcccaccccggcgtcgcctcctccggcttcgccgcaccgtcgccgtccccgtgcaccccctcgtcgagctcgctgaccgccagagcgccgccctccccgtcgacccgagccgtaccgccgccttcctccgctccgtccgcctttttcgtcatcgccgtcgacctagggtgagccgtggaccgccgcctcgtgtccccctttccctcccaccggtcgcgccgacgtggccgccttcgggcacgccgagcggctgccgcgtggggcccggccgtcagccgcccgcgcccttgggtgtggctgatgcgtggggcccacggcgccggccggtctgagcccgggtgcacccggtccaccgtggaccgtgaggctgccgcgtgggccccactcccgtggaccggtccgcgcgccctctcccctcggctgacgcaataaatcctttctaaattaaaatttaaatgaagaaattcgcaaatattcacttaaagagcatataaacttcaaatggccctaagttggtcatttgaactcggaattggaccgttcaagtctctaattttttcttaagaagtcaagaacccatttttgtgctttgttcctacttgttatatggagtttattagagtaaaagcctttttccttttcattggtcgtgtagacgctgcagcttcggaagatccgctctacgtggaggttgaagccgacgtttgggaaagcgagcaaggcaagtcacatcatccttgaacatattgaactctagactttgggaatattcatgtcacctggacactatggaatggttggattattgtggaatcggattcacacctccccctctattcaaaatcctcaaaatggttttaggctgggctcggggtgcatggttttgatagtagcacctcggccacataaggaccggt

SEQ ID NO: 41041 - DNA, 394 bp, Oryza sativa
ttgtcttcattagagttcacatgaaaaagttataaattatttttaaatataaagtcttttagaccgtcctatttggtccagatgatatacaaatccaagtttagaaactggtgtgacacaactgaataagttggaggacctaaacgagtgatctgcaagtttagggattgggatgacacagtcgaacaagtttgagatctgaacggtcgatttgcgagtttagagactgggataacacaacggtaaaagtttagggaccggtgatggactttactctaagaagtttttctagaggtttattagtaaaatatttttctaaaaaaaataaaaatcctgatggatcgatctctcacctgacgatcaaccacacgtatcatatccccgccgattcagg

SEQ ID NO: 41042 - DNA, 1501 bp, Oryza sativa
cttaggataccaaagaccatggttaggtgtgtgcactaaatatctaagaattctcttcacggccacaaggtgacactccttcggagcggcttgaaatcttgcacacatgcacacactaagcataatatcgggcctagatgcacaaaggtaaagaagtgagccaatgatggaacggtataccttttggtcgacgtctttaccttgctcgttgaggtcgaggtggccatttgatggcatgggagtgtggattggcttggcattttccatcccaaacttcttgagcatgtccttcaaatactttgtttggcaaatgaaggttccttccttgagttgcttgatttgaaggtcgaggaagaacttcaattcacccatcatggacatctcaaatcgtatggtcatcatcctactaaactcttcactaaaagacttgttagtagaaccaaatataatgttatcgacatatgtttggtagacaaaagtatcattatcatgtctcttttagtaaaaagagttgaatcggctttcccgatctcaaagccgtttttcacaagaaaattgtgaagacactcataccaagctctaggggcttgcttaagcccgtagagtgccttgtggagcttgtacacgtggttgggatagttcggatcctcgaagcccggtggttgctccacgtataccaactcgttgataggcccgttgaggaaggcgcttttgacatccatttgatatagcttaaaattgaggttactagcaaaagcaagcaatatgcgaatcaactcaagtctagctaccggtgcaaaagtttcaccgaaatctaatccttcgatttgggtgaacccttgcgccactaaccttgccttgttccttattacgaccccggcctcgtcttgcttgttgcggaagatccacttcatgccaatcacgttttgccgaggtcgctccaccaaagtccacacttcattccgggtgaaattgttcagctcctcttgcatcgccatcacccaatccggatcattaaaagattcttccacccttaaaggttaagagaagacacaaacgagtaatgctcacaaaaatttgcaatacgagaatgagtggatactcccttgttgatgtctcctaaaatgttgccggtgggatgatctcgttgaatactttggtggattcttgggcgagctagattgatcagtgagggtggcacttgctcgccttttgttaacaaccaaatttggtaatatcagcattggaaaagaagattagatcgaaacggaatctaagacgaggattgtcgcggaaacagagcaagaatcggcgggagtccggatcggatacgattgagatcagctaagtccgagtcagactgggttaggtgatacagccgattccgacaatacgacttggtgtacgacatcatgtcgagttgatttgtcttccccgccaaaaccttcgccactttccccaccctcagctacaatgcaaaaccacaccagcgaaagctagg

SEQ ID NO: 41043 - DNA, 1501 bp, Oryza sativa
aatccactcgacgcaggtcacttgtgaaggcagcatctccatccacatcgtcatcgtaatgatccagtgaatggtgggggatgtagcctcttgccgtgcggcgctggttgatagtttcgcaaagatcgacgggacgactgcgacgtggggagcgaggctgttcggctcgacgctccctgtgtcggtcaggaggcgagtggacatatcgttcgccatgatccctactcctgcggctagatccggcgccgacgacgctgaggcttggttggtgatagtcttgagatcgaagaggcggaactcggctgccagtcggcgtacggacacttgcagagttcaccgggactgaagcgacgatcatggtcttgatctgatttaagatgttgacgacgtgattggcctgattgagtgcatcttccttaaggagagtgtcgagaagggtgatcgctgcaaccgcgttctgctggggggtgcgaaaaaccgccgtcccttcgacgtcttgttgcccaataagttctcgtgctcgtcgcccggcctccaaggcgcgctgtcgccggtcctcagcctccttcgtagcccgttcgtgctcttgttgctcacgctgtagccgttctcgctcttgtgcttgacgctcctcctccagtcggcgacgttcggcttcttgtcgcacatgctgttcttctgcttctcgggcttgacgctgttcttccgtgtcattgtcggccatgaaaacgccgaagaagagaggcgcgtagttatcttcgtggccttcgtcgaagttgtcgaggttgcggtagtcgtagtggtagtcgaagtagtcgtactctacaatctccgttggtcgagaatcgacaccgggggagctgaggaagccatacaattcttccgtcgaaaccgtcccgagacgttggagtatgacgccgacttccctggagctaggctggatcgaagccgaggctggatctggcctaggcctacgggaagaagacgcccttgtggtgaagactgtggccaagtcgtcggggagactcatcaggattgagggataggccccattgtcttgatcaggtcgtgttgaagtagattggatctcgtccgactggtttgaagccgactcggttgagatgatcttggagtagatctcggccgagttcgggataccgaacggggcggagacctggcctccccccgactggttcggatccgagtcgaggagagaaatcttgccgaagtcgttggtgatgaagtcgaggctgccaaaccggaacgcctgcccgggagggaagacgaagtcgtcgatgccggagacgaaacccatcgcactagtcggcgaagaacttgacactaccctacctggcgcgccaactgtcgaaacaagatttcggcaatactaaaagggggtggctatcaagctggaaaagtggatgggtttaaagacaaaaaattttatacaggttcaggccttcttaataagaagtaataccctactcctgtccagggattg

SEQ ID NO: 41044 - DNA, 873 bp, Oryza sativa
gcccccctcctcacgccgcgagccggtggctccggcggcaaggtcgcccgcgccgaggacgcctccgcgccaccgccacccttcaccacgggcatggcgcgtgtaatcgtaacgcgtacgtgcaacgctcgcacgcgcgctgtgtaatcacccgcgatgtgggttactccggggcaatacacaagtactgctactcgatatcaaattggagattagtccggtgacaccgtgcgtgcgtctctgtgctttcgcgcgtcctcgcattttgtctcgtgtcatttatcttgcggtgtgtgtggtacactggttactggtacaaatcatgaagccgaaaagagaaggacgggggcaaagcggcaacggcgtacgaaggttaggaccggccggttcgggggccggagtcacggacgatacgggcgcgcgagttggaggggccccgacgcgcgggcttgcacgtacgcatgcgggtggatcggcggtgggtggttggcgcgcgcaggcggcaacgacgcgagcgagggccgagggagtgggactgtgggagtgggaaggcaaggcatccacctcgtcctcgatgtcatgcgtgcttgtcattccgcgtccatcagcagcagcccatcacgggcactgaattctgatgtccctttcaggtaacatgtacgggttcccgattcgccgtcctccgacccgggcggtggttgcttgtcagactcctacactgcaacaaaattaaccgcaagctgtagacgaatggctatattggaacaatggaactggctgtgtggtaaagtgtggcgaaacaatcatcacgaactgacgggagaatggatccaggggaaatatttttattttagttcttttttaaaaggggat

SEQ ID NO: 41045 - DNA, 1501 bp, Oryza sativa
acattaggtggttttataactttagactttgggaattctcatatcatttggacactgtggaatggttggcttatggtggaattggacatacccctcttcctctttcaaaacccctaaaacctgttttccggtggggtttgggtgcatgccagatgtgggaagtagcaccccggccaatataaggattaagctcgggcctctgttgcaaagcactaccgtactaaccacatgtctaatggataaggcttaactcggtgctcagtctagtcctgaacaaaaggacacggatagagatggatgaagtcgttgcgacgatggatatctctgaggcaaatgaaggctacacgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaatcctggcctgcctatcccgggataccggccgtaggcagggttgggtcggtacttttgttcacggctaggataggtgaagggttatgtcacatgtttacgacgggttccaaggccatggaatgcggagtaaggatgtgtcttgtgggtaaagatgtacacctctgatcagagtacatctattcgaatagccgtgccctcggatatgggcaagcctagcaatgtacccaagttagtggtttaattcttaaaatttgcttaacaactaaaatatggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtgtttacaaaatagctttgagtaactaagtgtcttttaaatgccgttttctgcaaaacttaacccttattattaccccttgtacccccttgcattaatcatgcatctcccggtgtggcttgctgagtactgtggttgtactcattcttgctctatctttcccccccttcagtaagaaaagctttggagaagaagtcttaggtggagtcctggcttataccccagttgagcgcctgtgaagatggagccgtaggcctgctagtccgctgctatttatttttgattgtcaggcctgaagtgcctttgtaataatgtaaatattatcgatgtattaaagatgttccctttgtatcatgtttgtttggtgtaccccggcttttcctgggacggggattaatacactagcgttcaggataaggcaattttctcggtcgcgacaccaaccattccacattttagttgttaagcaggttttaagaattaaaacactaacttgggtacattgctaggcttgcccataaccgagggcgcggctattcgaatagattatactctgatcagaggtgtacatctttacccacaaga

SEQ ID NO: 41046 - DNA, 1501 bp, Oryza sativa
ttccccgttaattaatggccaaagatgatcttatttttcctatgggttataatttgattagcatgaaccttatatattggattggttcagctaaatgctatatgtaagtttgcttagccatgcttagaaacattagctaactaaaggggttaattataaactatattatattatatcattattatggttatatttaatggtcgctcacgatggttaatcgtgtgatgttaattaattgataattaaaatctggttaaggtgggttgtgagcatatggttttgatggttgtgctcatgacaattaaggaccggttcgcgagctactgtagtgaaacatttaccgtgccaaccacaagccagcgtgggcaacggctttaccttttgtatagcatgattcattacggagtgccagactgagaagcggcgagaagtccgcgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgattagagtttaatctattcgaatagccgtacccgcggttatgggtgagttgagcaatgtttttcgtgattagtctcacacctttcacaataattatggatgttataactggtaataatttgcttagctcctggtttggagttagatctgtacagccgggtatggttgttcaggatggttgggcctgtgcagcatgggtgtgctgttcagtgttgattaaaattgatgattaattactctactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcaaacctcacctgaagataaaggatccagaaggagaagacgtttggcttatacccagttgagctgcctgtgggagtggagctgaagccatcgctagaccgttaattccgctgctgttttcttttctttgtaagtatgtaacgttattattaagatggatttgtatattaaattgtcagtttgtgtacctcggctgattcctggacgaggattttatgtacaaattagttcggaaattactagtgaatttccgagcgtgacaatattgaatcccagtttataaaattattttgatttaaattattgcattatcgcttcatttaaattcccgcgttatcactgttttatttagccatgcctacttacctttgttatgaccttattattattgttattgttattattaccttgttcaccttagaataaacaataccccaactagtgggtactctatttatggttccactagtatgaatttaggtagatgtttcgctga

SEQ ID NO: 41047 - DNA, 1501 bp, Oryza sativa
aagccaaccattccacagtgtccaaatgatatgagaattcccaaagtctaaagttataaaaccacctaatgttgcctaattagtcggcgaagcatctacctaaattcatactagtggaaccgttaatagagtacccactagttggggttttgtttatcctagggtgaacaaggtaataataaacaatagcaatgataaggacataacagggattaataggaagtgctaaataaaacagtgataacgcgggaatttaaataaagcggtaatgcaataatttaaaccaaaataattttataaactaggattcaatatgctcaagggtgatgtgacttgccttgctcagagagaacggccttccgaaccttcggcgacgaccgcgaaccacgcttcgagaaccttcggaacgacagaagctacgcgaagcacacaagcaaagctacaagcctataaagaagcaataacaatacataaaaagaaagcacacggttctttatgttataacaaacattaagagacttgaacgggtcgattcggagcccgtatgaccaagacatggtcatccgaagtttaatgctgttatatatggagatttgcggattattataattaggttttgcaactataaaacatgtgtaagcgctagcctggaaaagacaggaaggctgcgccgttgacatgcggaccccacatgtcaacctaaaggatcgcggtagaccgagaacacagagacggtccacgggtcgacggaagcgaaccccgtgtgtcaaccgaggcgagtggccgacaaacggactccactagacaccacacggcctgcacacgtggaaaccacgcggctaccgagcgggcacactgacacggtcaccacacgcacaagcgaacgactaccgcacaacgggcatgggcgacaccgaaaggacgaggacggggcagcgagaggacggacccttagcaccctgcgacgaggcgagggaacgacaacgacgaacgggcgcggcggagacggctcggggacgacggaggcgaacgacgagggaacgacttcggcggcgatccttgaacgaaggcgagacacggccggcatgaggcttgacgacgcggaggcgaggacgaagatgacgacggggctgcagcggctcgcttgacgaaccacgggcgacgaacgcgatcggcttgacggagggacgaacgccacgacgaccgggaacgacgggaggacgacgaggacagccggtagcggttgcacggagacgaggatggcgtggaacacgccgctgcgatgccgacgacggaggcggcgccgcgagacgacgagccggcgaggatgaacggtgaagacgatgacagacaccggcggtgttcggccgaaggggaagcgatgccgaggacgacgtcgcggctgtgatgccgaaggtggagacggcgacgtcggccggcgcacgggcacggcggaagaggctgccgaaggcgacgttgtcgaggaggaaggagaggccgg

SEQ ID NO: 41048 - DNA, 1031 bp, Oryza sativa
ccggctggagattgaagatgccactgtagcagggatgcaaactagacttttggctgggcttctacttcttggcccgattgaaagagggacacaaagcagacttcgggaaagagaggaaaagggctgcaggctgagaggagactgggccgagaatgagaggacttttcctaattcggcccgaaaaggaaaaggtgaattttaattactttcccaattaaattaatcactgaaatgatctttgaattgttaaaaatacttccaatgctcaaataatttcaagaaaaatcctgaaaatacttggacactcaaaatacttaacaaaattataatcagaccatttaatgattaatttaatatttaaataattgctgaactgctctttgtatgattaaaaattaggaattgagctccgaaaaatccaagaatattccagagagtataattaaccatggagaatttaataaaaattaaatccatccatgctttatatttagaaaattttatttcccacatttaacttcacttgtaaattaatgaacatttaatataaattctgataataatttattaaataattttataaatcctgaaacaaaaatcaggatgtgacaaatatgttcaaggattatgtgacttttcttgctcagagagaacagccttccgaaccttcggcgacgaccgcgaaccacgctttgggaacctccggaacgacagaagctacgcgaagcacacaagcaaagctacaagcctataaagaagcaataccaatacataaaaagaaagcacatggttctttaggttataacaaacattaggagacttgaacgggtcgattcggggttcgtatgaccaagatatgatcatccgaagtttaatgctgttacatggagatttacggattattgtgattaggttttgcaattataaaacatgtataagcgctagcctggaaaagacaggaaggctgcgccgttgacatgtggaccccacatgtcaacctaagggaccacagtagaccgagtacacagaaa

SEQ ID NO: 41049 - DNA, 337 bp, Oryza sativa
ccgatgatcaaagatgttaaggttgaagttgcagcaatgacagccgatgattggaggtatgatgtgcatcaatatttgtatagtccgtctcaatcggcttctaggaaattaagatacaaggcattaaagtatacattgttggatgatgagctttattatcggacgattgatagagtgttacttaagtgtttgagtgtcgatcaggctaaagttgcaatcggcgaagttcatgaaggaatttgtggcactcatcaatcggctcataagatgaagtggttacttcggcgtgcagggtatttttggccgacaatgctggaggattgtttcagatattata

SEQ ID NO: 41050 - DNA, 1188 bp, Oryza sativa
ggttgagaataaaggcacgccgctgcctaaggccattgggtcattggcagccaggacaagcaactggggcttggagtttgtcccaagacttagggtcctgtttagattccaacttttttcttcctctaactttttgtcacaccaaacttacctacacacataaacttttaattttttcgtcacatcgttttaatttctttaaattttcaattttatcgtggaactaaacatagcctagataaggtcatcaagtagtttttcacctctctagtaccgttctatcttcagattaaaaccttaatgaaatactcaatttgtatactaaggtttacgtgggcacacccaagataaaaaaatcttaggtccgccactgtccctgatccgatacgaaagtacatggttaagatatctagactaatgttcgattcactctcaaaaataaataaagggagaacggataaaaaagaggcgtaaagagatggatcgatctgctctagctggcttccacccccgctagcttttgctctgcccatccctgctcctgcttgctattttctactgctgctgctttgtgctctgctgcctgctgcctggtctactcttcgtttgttgctgccgtggttactgatgcaagctgggaattaaaaaatattaaaataacagatgtgccgagcaagctgagccagagaggaaagaagaagaaaaaaaagagaacagtggaaatgttgtagccaagggggaatttccactagttgtcgcaataaaaaccgacaacttttgaaaatgtccatttttaggtttggccttagatgtttttgtcaatggagatataacctctaaattcttaatattgttttcttaggtgtcccagtgtgaacggatgacgtgaaatatctacgttgcccccctaaatcatattctctctgaatctcctcaatctttctttctcctgcaaccattcacattactggtgatatccgaggatgctggtgaagcattaatttacatcggaggccggctggggaagaggatgcacaaccgagggtatggtccaaattgacatctaacttttcaaagcttcaccaaaattcgagcatacatggcctcctttgtgaagcatgacatctaacttttcaaagcttcaccaaaattgttaccctttgtggtgcttgccgtgttgttcaaagc

SEQ ID NO: 41051 - DNA, 230 bp, Oryza sativa
gtgagctagtggatctaagcatggctaagcattttctaaaccaacatcttatccgattaatacccaaattatcaatggcataaggtgaacaacatatggctgagtaataggacccatcccatatgatattgtaaaataatataacatttaatagaaaacggaacatttgtaaattgagtacatcatgatcatttgtaatgcatgacttgccttgctctcgcactgatagg

SEQ ID NO: 41052 - DNA, 1501 bp, Oryza sativa
tttaacgacgcctccgccttgtgatccgcgagcggcccgatgacgtctatcaaagggagagcttgcgtacatgaaggcacaatgcgatccaaggaaagaagaagtaaaggagccatcgagtacactcatgttgattgcagcttcgcactcggtcgtccccttcttgcaaaggggaacggggacgttgctcaccgtcgtagggccgctgactgacgcggcgctccacggttttgctgttcaaacctgtaggatcgagaaccagaactcgataagtcagcaggaacatgcacataaaaaatgaaatctgaaatacaagaaaaataccccgagaagaaacccgggtcgcgtcctccggcccagaatagtcaaaggctgggtgggctcgagcctggagcggctggatctgcctaccgatgaagttgacagcaacttcataccccgacaactctcgtactcggaggtcatcgatgatatcgatgaaagacttaagggagggagttagggcgggtttggcggtccattccggaatcttgtctggttgttcctcatggacaacaaagactggatccgaattttctatctgaagatagaaccacatcgctcgccattttctacgagaagaagggcactggaaggggatgtatcacgacttcaggccatcctgaagttagaaaccgacacatccagatacctttttaggttccatccagcgcaactcatagtagaagtaaaagagatcaagaaatggctctaccccaatgtagggcccacaaagataggaaaaaatgctaagaaatgcgatagaattggggttcagatgaagcaaggaaaggccgtagaaattcaagacaagaagaagaaactcagaaggcggaggaagaaaaccgcaaagaatgtaatcctcaaccgcaaccatgtggcctaggacaggtttggggtcagtacctcctgtttccctctgcatggtcccacgaccagggagggcaccgtcgtcctgcagcttcttcagggacgcattggtggatgtggatttgtcgaggtccatcactgccggaagatcgccggagaacaggacaagatgggaaagctagggcttttctacggaagcggagaagacgaggggcgtttgaaggccggaaagttttgcagcaaacggacttcaaaatggatccccaaaactcccgtaaataagcgcactaccgatggtgcgaattccaaggaaaggagagagatggccgccagaagtttctgggtccgttacccgcagcagtttttggacttcaatttaaattcactcatgaccgttgaacttcatgcaatgttatcgataactctacgtctctacggttctcataccaagatcgaccagttgagagcgataatgattccgagatcagaagtcgcgatcggtcacatgagttcatttaagcagaagtcgggggctactttcagggttacagaggtataccctctacccttggatgtatgttgtatattgata

SEQ ID NO: 41053 - DNA, 1501 bp, Oryza sativa
tcctcccacttttccctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctccccatcggaatcgagctcgcgccgtcgtcctctctctccaccgtcgccgccgagcttcggttcgccgccgtcgtcgccccggacctcctcccgcttcggcatcgcctccttcggcttcgccgcgtccccgtcgacctcgtccaccccttcgtttcgcccgccgaccgccggaacgccaccgtcctcgtcgacccgagccgcgccgccgcctctctccgcttcggtcgccgttcccgtcgtcgccgtcgacccggggtgagccgaggaccgccatttcgcttcccccttccctctcctctctcgggcgccgctccgtcgcgccggtggtcgccggcggcgaccatcggggcgcgggcgcgccgcctcccgtcggccgtgccggcgaggccgccttcgggcgcgccccgcggctgccatgtgggacccggccgttagccgccagcgtcctcgggtgcggctgacgcgtgggacccacggcgccggccggcgcaagccgcgtgcacccggtccaccgtggaccgtgaggctgccacgtgggccccactcccgtggacccggtccgcgcgcccctcccctcggctgatgcaataaatccgattttaaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatctttgaatatattgaatcccaatttataaaattatgttgatttaaattattgcattatcgctttatttaaattcccgcgttatcactgttttatttagccatgcctatttacctttgttatgaccttaatattgttattgttattatttccttgttcaccctagaataaacaaaaccccaactagtggacactctactcatggtaccactagtatgattttaggtagatgcttcgctatttaattaggtaacattaggcggttttacaactctagactttgggatattcatatcacctggacactctggaattgttggatcattgtggaattggattcacacctcccccctctattcaaaatccctaaaaatggttttaggctgggctcggggtgcatggttttgatagtagcac

SEQ ID NO: 41054 - DNA, 1084 bp, Oryza sativa
tggtaagtatcatccgatatctcgtaagtatcacgcgatacatagcagaaatcgtctgatacctgacatgatacctcgcgagtatcacgcgatacgaggtagaaatcgtctgatacctgacaggtatcacatgaaacctcgcgagtatcacacgatacgtggtagaaatcgcatgattcctgataagtatcacatgatactttgcaagtatcacctgaaacgtgtgtagaatcgtctgatacctgataggtatcacacctgatacctactcgggatcatcccgttcgaaaacgggattccgtcgtatccccttttaaaaaagaactaaaataaaaatatttcccctggatccattctcccgtcagttcgtgatgattgtttcgccacactttaccacacagccagttccattgttccaatatagccattcgtctacagcttgcggttaattttgttgcagtgtaggagtctgacaagcaaccaccgcccgggtcggaggacggcgaatcgggaacccgtacatgttacctgaaagggacatcagaattcagtgcccgtgatgggctgctgctgatggacgcggaatgacaagcacgcatgacatcgaggacgaggtggatgccttgccttcccactcccacagtcccactccctcggccctcgctcgcgtcgttgccgcctgcgcgcgccaaccacccaccgccgatccacccgcatgcgtacgtgcaagcccgcgcgtcggggcccctccaactcgcgcgcccgtatcgtccgtgactccggcccccgaaccggccggtcctaaccttcgtacgccgttgccgctttgcccccgtccttctcttttcggcttcatgatttgtaccagtaaccagtgtaccacacacaccgcaagataaatgacacgagacaaaatgcgaggacgcgcgaaagcacagagacgcacgcacggtgtcaccggactaatctccaatttgatatcgagtagcagtacttgtgtattgccccggagtaacccacatcgcgggtgattacacagcgcgcgtgcgagcgttgcacgtacgcgttacgattacacgcgcca

SEQ ID NO: 41055 - DNA, 216 bp, Oryza sativa
tattgatggattctatggatgtatggaatgatgttggaattgatggatggatgtatggttctctggatatattactgcctgtgaatatattattgcctgtgatgtgtgttgtgtgcaaagtctgactggacagagagcagtcttgctaagttttagcaggactgcaaactcagcgccagggaaaatggcgctgagattttcaccctcagtgccagg

SEQ ID NO: 41056 - DNA, 404 bp, Oryza sativa
ataaggcatggaataggtcatagggataggctgcttctcggggttaatattaattaatttaataatttgacctgttagcattgtagtcaacagattattggccggattattgtagtggattatatacacgattatggatataaattaagtattctaataaataaacttgatgaatttaccttacaacaagagaactaaacaatgcagtagaagaaacaatttccgtgacaataatccagtgaagtggctgaaaagagcagggccttagtggtgttaagttctggttctatgtgggataacagagcatccaaacaacttagtggtgtattacttgtcgtaacaatacaatattgtatcattagcacattgcatcttttgtaggtacgttttatgtcttgtgtcaa

SEQ ID NO: 41057 - DNA, 177 bp, Oryza sativa
gcttgggcaactaccttggggaaggtagttgagatacagcatgtggagacatgagcgccacattgccatgacattgatgagatgatttgtgaaagaaagttaaaactaaacaaatgttttcgactggggcggctggaggacttgggtggtgtccggtaaaggctagtgccgtcccta

SEQ ID NO: 41058 - DNA, 601 bp, Oryza sativa
agtttgtgtacctcggttgattcctggacgaggattttatgcacaaataaagttcagaaattactagtgaatttccgggcgtgacaagttggtatcagagccatcttgactgtaggataagccaaatggtcaaaccttaaggactaattttccgaaaacataatttgtgaaaattttcctttctttcttatctagaattctttgcaaatcgttttgtcattcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgtttgttgtttgctttgtgtgtaggtatggttgcattcccatcattggagaagttcattgatgagtgtgtgactatactaggttgcttgcttaatcaacttgaacaatataatggtctacacacatcagatcagtgttaacctggttaaggtcttgtctttagtgtaaccc

SEQ ID NO: 41059 - DNA, 177 bp, Oryza sativa
ttcaccaccccacttaataatcctcccaccggtcacaattcacaaccaaattccggtcgaacttttctttggggaagggaagaaacaaacaaaggttgtcaaggcagtcagcactcaacagaccatatgaatatagaataagacatgacattgcttaatttgaacaaacatgttagt

SEQ ID NO: 41060 - DNA, 1501 bp, Oryza sativa
aattgttttggcttcaaaagttgcgaggaaaaaaagagttacaggacatgacataatccctgcggatttgggttttcccatgcgccgagacaaacaaacaaacgggcgccggtctggtcactggtcaggtggcgcgcgcggtgccgtgggcgaggaggacgctggtgggggagaagacgatgccaccgccgccgccgttgttcgccggggtggcggccgcggaggcttccacaggctttcttgaacggccgcgtccgcggtggacgtgccgctcgcagtacttgtgccccggcaccacgtcgcgcgagcaccgccacttcttgccgtccgtgcgcctgcaccgccctgggtccggctccatgctgctccggtagtcgaagcacaggttccccaaccccatcactgccactcaaatgtcaaaaacggcgtccacattatcgaatgatcggaaagctcgacaccaatcaggccaaacgcaatgagaagaaaaagaaaaatatcttgttggcacgtacgggaagggaagcggtgcgggccgaaggaggaggacgcgacgctcttccagatggggagcacgaggtgcaccggcacgggcgcgcccgcggcgaagtagcggtagatgagcacctggtgctccagctcctgctgctgcatgaacgtcagcgccgtcgccttgtgcgccgccgccgccgacgcttccacgtcacgctcgccgcggctgtcgccgccgagtccaagccccagcccaagacccaccggcggcgggggtgctgccatggtcaccactcctacgaaaacacacacgccagacttatcaacacgacttgcacacaaacacgattacatgttcgctcaaaaaaaaaaaaagaacacgcttacacaaacacataccggcattcgggtcagcgccggagaggcgaggcagcttggacggtggctgcggcgagtcggcttccttctcctcatccattctgacaactcggcttgtaactcctcgctcctcggtttcgaactcaatggaggtaaggtttggggttcttggtgggaagaggaatgaagaaagaagatggggggcagtgagttgtcagaggaagggtgaaggagtgggcatatatttatgcgtgcgacggctccccgtcgtctggtcgcccggtaacttgtgcgcagaggtaataacggaagctgaggggatgtgtgggctgtacattgcttgcggtgggcgcgcgcggaggtgtcgcggcgtcggcccctggcgccgggagatgacacgaatgaaaatactttcgacattttctgggcgttggacggacgggcttgacagcctttttatcgcttctgctcgtttactacttttcgcgttggatggacgcagcaacgtgtttttgtgaaaaacggatgctcggatcacgtgttactatggttgataaaccaacgtgttattactactattgtcgctctctcatcgccaattctataccgggaaaaagtgcaccatgcattt

SEQ ID NO: 41061 - DNA, 951 bp, Oryza sativa
accaatgcatattgtcatcctcagtaactgccatgctgctacacactggataagcaactgaaaatcaatatttttcttttcttatatttaagatcaatctgatatttcttcacataagggctactggccgtagataacaaatttcgcacaggaaatattccaatattatgtcaattgctattttgcaggcaagcatctatggtgcttgagacctactttcttattacgtcacccaattttgcttgaacaagaggcatgcaaaacatttgaaggtagtcagacataattttattcaaagtaaatttcacagaactacatatattttgaacaaatactttgctttgggccatatgagctggacaaattatggaaggactatagcacacactgcaagaatatattgttcctttagatatctttgttcattgcattagtaacctgtgcgattatttatgaacaggatggatcatgatcaacggcagagggtgagctgcgccatgggtcgtgaatcaccgttgctattgcctccaacttgtcgctggagccacgcgcccaacagctagagccaagatgaattcctgagagagtatgtatgtatggacgtgccttgcacgtgcacgctcactagttcttaaaattggaacactttcttaaaaacactgggttgggcatccgatcctggttaaaaaatcgaatacccgcaccactcacttatatgtccttatttctctctttctaggtctctatccccttattctctctcttctctctctaaacctcacaccacatacatgaaaaggttgcggtgatgatggtattgttgtttccatggccgcctggtggcgatagtgacggggagaacgactgttgtggcgggcagagtaagaagacatctaggaggtcaccagtggagaggaggagggggatgaccccatcgtggcgaaccagcaa

SEQ ID NO: 41062 - DNA, 292 bp, Oryza sativa
ggtatagggcgatcaaatttgctagtttattttttagttttgccgtactattaagaggggtaatgacctagcaaagagatgattttaattgccacattaggtcattatgcatttagacttgtgctcgcttttcatcacacacacaatcacttgggatttcactggtttcggcctgatcaggggcggtcagaccggccacatagtggcggtttgaccggcgtgccctggccggtctgaccggccgcaagacggcggtctgaccggcgaataaggccggtctgactggcggaca

SEQ ID NO: 41063 - DNA, 185 bp, Oryza sativa
accaatgcatattgtcatcctcagtaactgccatgctgctacacactggataagcaactgaaaatcaatatttttcttttcttatatttaagatcaatctgatatttcttcacataagggctactggccgtagataacaaatttcgcacaggaaatattccaatattatgtcaattgctattttg

SEQ ID NO: 41064 - DNA, 998 bp, Oryza sativa
ctcatgagaaatggtgagtctctcataagaggtctttagctcctcatacaagacctccaaagaagcatgatccttctttagagccttgaacttgacaatctccttctcactataagcatggagctcctcaaacatactcacaagctcatcataggaaacatcatcacaatcatcatcactctcactatcactaagagatgttaccttagaggaaccctttgccatgagacaaagtggagcgaagagtgatggagcctccttgatggcaacaacggtcatcttcttcttcttggagcttgcatcatcaccaccttcttcctcggacccggatgaggcggagctctcctcatttgagtcccattccccgatgaatgcctcaatcttcttgcattccttcttgagcttcttcatgagcttgtagcctccactcttcttcttggatgacttgtctccatcatcatccttgaaagggcacttggaaacaaagtgtcccttctcaccacactcaaaacacctcaagttggagagagtcttgttgggtcttctatttctactcctatttgagttggagccccttcctctctcctttctccttcccaagagatcattgaaccttctagcaagaagggcaatctcttcctccaagtcctcattgacttcattcaccttgcccttgctcttatcttcaacttcggcttggagagcaatgcacttcttgaaaggtgatcaatcaagtgccacactagctctacaaatggaagcaatgcacttgactcttggctaattaaccctctaacacactagatggatgaacacaaagctcaagtgggtgtgagagaggtgcaaggggtgtatgcaattgaattgggtgtcaagagagaccccttgctgctggagggagagtatttatactcccaccaaccaaaactagccgttgggggcgaaatcccctaactttgtgctctgccggtctaaccgaaggtatgcggtcggtcaga

SEQ ID NO: 41065 - DNA, 1501 bp, Oryza sativa
gaagttcatgaaggaatttgtggcactcatcaatcggctcataagatgaagtggttacttcggcgtgcagggtatttttggccgacaatgctggaggattgtttcagatattataagggaggtcaagattgtcagaagtttggggcaattcagcgagcgccggcgtcggctatgaatcctattattaagccatggccattcagaggttggggaattgatatgatcggtatgataaacccaccatcaagtaaaggacataagtttatattggtggcaactgattatttcaccaagtgggtagaggcgattcctttgaagaaagttgattctggggatgcgattcaattcgttcaagaacatataatctaccgatttggtattcctcttacaactgatcagggtttaatgttcgtgtctgacgagtttgttcagtttgccgatagcatgggtatcaaattattgaattcttcaccttattatgcacaagctaatgggcaagccgaggcatctaataaaagtttgatcaaattgattaagcggaaaatttctgattacccttggcaatggcatactcggttggctgaagcgttgtggtcttataggatggcttgtcatggatcgatccaagtccctccttacaaacttgtttatgggcatgaggtgttttgccgtgggaagttagaatcggctctcaaagaatggaattacaaaatgatttaacagccgatgagtattacaaccttatggctgatgagagggaggatctggttctgtcacgtaatgataaattcatcccgaaataaaaatcattctctaaaaggaataatagaattaattaaaattcgaaaagaaattggcaaacactaaaatacgtacaagaaaaattcgaaagtggtccggagaatttttgttaaattctccttggtcaaaaaggagccctcaaattttacttgaattttcagagcaccgaaaatatttattaagcaacaacacaattatcaaagtttattaaaaagaaaaagctaaaaataatccccctccttcctttgggccaagcctccctctctctctcggcccgcggccaaagtccttccctcctccctctctttttccttccctctctctctcttgggccgccctccctccttcccctcggcccagctccctcctcctccctcttcctcccgggctgcctctccctcctcttctcctgggccgcctcggcttcgcccggcccaagccgagccgcgcctcccacccgtgccactcagtgcgcgcgcgcacgcgcccgttgccacgcgctgaccacgccccgcgtgggtcccacccccgggtcgtcgtcgtcctcccgcccggcctccttcctttctctctcccgtgcaaaccctagtgccaatcctccccaaaattgacgcgattcaaaacgggggtttccgaaattgattagggggttttaatccccattgattccttatcaattccccctaatttcccccttgat

SEQ ID NO: 41066 - DNA, 1501 bp, Oryza sativa
agaaaaattctcaattttatacactttacttcttttccaactactgttgagtggccacgtctttcgacgtatgccgttgtcctttcgacaacagctggcgccgaccgtggggacctccaagcgaaaccactgagagcgaatgccaccgaagagggtcgtgaaggagaaggttacaaggcgaaaggaaagcgaagccgggggggagatgtccgccgaagagggagcagagagccttcggcgcccatcgccgaagatggaggagcgctgtctgcctccacacctgcgccatcagtaccgccttcggctcctgccgcctctgcgtaggtgccgaacatagttgacatggcgaaggcagccgcgacggcaagggcactctagaccagggcggagatcctttcgacaagccaactgctggtgccccaagccactccgtcgcagccggcagcggcctcgactgcgctcgccgctgtacaagtgaaccctgaccccgaaacacaaaccaaagccgacatggaagccatgcgacataacatgacatgactccaagacatgcttcgtcagatgcaagaacaacagcaggcgtacgagtcagcgaggcggtccaaggtcgcttcggcctcaatcctccagtattcggcaggctacgtcccaccccaagtctatccacaagcaccgatctagccccttccgtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacgtgcaaggggatacaaggagggtttgtggctatttgcataaaggcggttgtaaaacattttattgagcaaaacagtaaaactgttgagtaattaaagtaatattgaatctccactgatcaacgctacaccacgttgaacaggcccaaccaacccacctgaactacagtgtattgagtcgatttattaagatgggactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaagaggccgtgacaggacccttcgcataaccccctctaaccgatcgcaccacaccttagggttcgcccccgtccccagcaggcaacgggcagcccccctttcgtgccgcgg

SEQ ID NO: 41067 - DNA, 1501 bp, Oryza sativa
ggtcgtagccgatctggactcagccgattcttactctgttcccacagcaatccttatctctgattgcgcttcgatctcatcttcacttccgatgatgatattaccaaatttggtcattaacaccgccttgcctgccgagaaggcaactagcgccttcgccccctccaaatccttcctcggtctgaaggggggagctgttcgattccaccccagtctcgttatgtcccggacttggagtaggagtgtagctaggggtgtcgacgcggttttcgaccgcctcgtccgcggccttttcagccatggcctccgcctcctcttcttcctccccttcctcctcgccatcacactcttcgacgtcgtccacgtcatcggaatcggaggaagcaagaaccctccgcttcctaggggcaagcttcacctgcccgcgcgtccgcaggaggcgaagagcggcaaaacaatacctgtcacatagacaataaactttatttgcaggaacaatgtaggtttcggcatgagcatcggtcgaaagggggcgccacataccataccacatggtttgcacggtctcggccgaagctccaatctcacccttgcccgtgaggggcttgttggcggtatggcaatgagggctataaatagtcccatagggcatgaggcccttcgaccaaacctgccgaagccatgcgaacagtggggattcaagcccgagacatcaaggttagtcagggcgaagaccccccatggcgaagactatggaataacgacggcaagaggcggggaatcacatgggtaccttgccaagccataaggcctcttgggcgaaggatgcagggcgaagagtatatgccgaagggagacgacttcgccgtagcaagttcgcccccgcaaggaccgaagaagtctttccagcccatcaagcctaggggctattgggccgatgatcgcccgacggcccatcaggggcccatgaatctcgattacactatgtacccatataaatgtccctttcataagggcaaccatgtaatttcccatgtataaccaaaaccctagtagtaagaaccagtaatgagggctataaatgttcccatagggtcatgtaatgggggatccgaagaaaaattctcaattttatacactttacttcttttccaactactgttgagtggccacgtctttcgacgtatgccgttgtcctttcgacaacagctggcgccgaccgtggggacctccaagcgaaaccactgagagcgaatgccaccgaagagggtcgtgaaggagaaggttacaaggcgaaaggaaagcgaagccgggggggagatgtccgccgaagagggagcagagagccttcggcgcccatcgccgaagatggaggagcgctgtctgcctccacacctgcgccatcagtaccgccttcggctcctgccgcctctgcgtaggtgccgaacatagttgacatggcgaaggcagccgcgacggcaagggcactctagaccagggc

SEQ ID NO: 41068 - DNA, 1323 bp, Oryza sativa
ctgttggattagtgccaccgctttggtgttggttaattaaaataaatcacatggtgggctgtgggtgcatggttttgctggtcgcaccatggcagttaaggaccggttcgcgagatgccctggaagaacttatcgtacttaccacaagccagcgtgggcaacggctgggcttgtagtgtagctttcctctagccgacgcatccaggcaagggtgggcatgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaacggtcctgtcacggcctctttccggtatgtcgtggtggcatgtcggcgcacggaaacgtgtcgtggggctgtgtcttgtgggtacagttgtacacctctgatcagagtaaaactattcgagtagccgtgcccgcggttatgggcggtcaaccagattcaccgggattagtctcaccctagtgtaatcttttgaatttggataggttaggtggatggttgggcctgtcgcaacgtgggatagcgttggacagtggttagttaataataattaattattacaactgtttaaatctttcaacttctgtgtataaatgctcgctttatgcaaatgaaccactctagctctcctttgataattccctgcatcatacccctattccgatatgacttgctgagtacagtgggtagtactcagtcttgctctattttttttcccaaccccagagttcgggtatgtgtcagatggaggtttctccgaggagtaggcttcgtccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacatcataccaggtggttcagatgaggagcagcaatatgttagcgtgcaggtggagcacgtggatgatcaggaaactgaaattgttagtaatgatgttaatgatactgttcagcactcacctcctgttttgcagccacaagatcaacctattgcacatcgcagaacaaaaaggagttgtggagctccaattcgccttattgaggaatgtgatatggtttattatgcttttagttgtgttgaacaagt

SEQ ID NO: 41069 - DNA, 372 bp, Oryza sativa
atagtaaagatatttttgttggctggcgcccgtggttttttctctcctgttatggaggggtgtttcacgtcaaatctcgtgtcttctatgattgatctattgttctttatcgtttgttcgcttatcgtttcctaacaagtggtatcagagcttgttctcagattagggtttcgcgatggcgtcgatgaagtatgatctatcgctgcttgactacaagacaagattctcgctgtggcaagtcaagatgcgggctgttctgatgcaacttaggatcttgatggggcgctggaaaccttcgggaagaagaaaacgactggctagaccgctgaggagaagcggaaagatcgtaaggctctgtcgctaatccaactt

SEQ ID NO: 41070 - DNA, 808 bp, Oryza sativa
gatttaatctttaaaaattcataactaattcatcttaactcggatttagttggtttaagtctctaattttttctaaaattgagatctacatgttaaaaatatccaaatgtactattcatgattgtttatgtgctgttttggtgattttgctcttttatgcttagattccgacgttcccggagtgtccgattttgcgggagaagactttgaagagttccatggctagcaaggcaagtcacacagatcccaaacaatcctttgagcatgttgatttcgtttaaaactattgtttctattcaactactgcatttattttcgaatgtcattgggtgggaataacctattgcctttgttatagccctttgatattgattatctatactttgtcgtttgattaataattggattagctagaacattatatggttttagctaaaagtgtttaggatgcttagccatgcttagagacattagctcatataaatgggataacttatgattcactattatttaatgatggcttaatgatagctcacgatggttaatcgtgattggttaattaactaatttgccaactaaaacttgatactggtgggttgtgagcgcatgattttgatggtcgtgctcatgacaattaaggaccggttcacgattttcagttgttaaacattaacggtgccaaccacaagccaacgtggacaacggctttactttttgtatagtatggttcattgtggagcaccagattgtgaagtggcggagataagcccacgggggtcactggggagtccatgccttgtttataagg

SEQ ID NO: 41071 - DNA, 180 bp, Oryza sativa
ttttactctggccagaggtgtaccactgtactcacaagacacaacctcaacatcatgtcaaccatgcgtcgcgatacttaacaagtacccgaatagagattgtgacaataccctttgcataacacaattcaaagtagtgcaccgttcttggatcataatcactcccttataaacaaggca

SEQ ID NO: 41072 - DNA, 155 bp, Oryza sativa
cagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagt

SEQ ID NO: 41073 - DNA, 348 bp, Oryza sativa
gtcttctgtatgggcgggcatcttaagtgatacacctgggaaaaaccatctctattccaactccttttatattctccactcccatctctctctttctcccactcctacctaccctggccactccccctctctgccccactcctcactccggccacctcctctccctacctaccgcaacagggcatcttaagtgatacacctggaaaaaaccatctctattccaactccttttatattctccactcccatctctctctttctcccactcctacctaccctggccactccccctctctcccccactcctcactccggccacctcctctccctacctcccgcaacaacagg

SEQ ID NO: 41074 - DNA, 222 bp, Oryza sativa
tgttggcgcgtccgttcccggtgattgggacgccgttcaagggggaaaatgggggaaatcaaagaggaatcaatggagattaattccccctatttaatttggaaaaagccggcttgaatggggtggatttggaggaggaacaacgctagggttcacgggagagagagagaggaaggaggccggcggctggaggtcggggacgcgcctggcaggcgggaccca

SEQ ID NO: 41075 - DNA, 1501 bp, Oryza sativa
cggcgacacgccggaggtccccctatccgcgagcgtgcgcgccgccgcgccgtgcgtgccgtcgtcctcgccgccatgcgcgtctcggccacgccgccgcctccggccccgtccgtgtgcgtgcgcgccgccgccgccactttgtgtcccccgcctgccgcagagtgcgacagagaagagagagaagagtgagatgaagagtgagagaggatataacaggtgggtcccatattttttttataaatagaatgctgactggactgccacgcgtacgccacgtagaccaaaaccaccgcggattgggttgagagggataattcgtcttttttgcatagttggggtgaagaatgtccggtttttggtttaggtgggtaattcggacgaccgcgatagttcgggagggtaattcgtactttttccataggagggagatttttttatgaaaaaaaaacaaaacttaccatgttctccctccttatcctcttttggaaacctgttccacatatgtgaaatatcaaactccctaagctatagtaatgtacagtaaatatataggtgtaggtgtatttattaaaatgttttgagtgtggtgttgcaagttcaatactttaatagtgtaaaaaactaaaaagaaagtaatatagatggactgtctatctataattcttgaccgttagattgctttaagattcatgcaagaaaacctaacgttaactccatccctcctctcgtcccccctcactcctagtgtcgccacgagaggagagtgcttgatgctccgcagccgttcagtcttgtcgtctggcgggaggacgccaatggtactggcgagaacactgtggctgtcgccccattccttctctccttaagctgatagctacaaggtgtcccatccctgttattttcctcgtctccgacaactcactgccaccaggtttgccaccatcggcagtcgcctcctaaccataaactttactttaccctgccgtcggcccaccgctatcctccatcctcgtggcttccatgccagtgccttgtcattagcccggccaccggcatctcgccgtcttccatgaccatcccttaaagcccaaagatcttcctcctcttcccttcccacctcccactgccactctaacccgggacactaaaccgtaacttgttagattgcagccggtcgctggagttagaggagaaaaactgggatttcagaacacgaatcgtgaagcaatcttaaagtcgaaaatttgcaagattttggcctcatcagtttaatgtcaaatgccatttagcgattccctattgatttactatgattgcttgcttaaccaaattcctgttttttgcaaaaataaacagacctgatagtatcctacctaactagaattggttaattacgacttaggagttaggacacatgagttattcagctttgcacggcaaaatcccattgatccatccatgcatcccaagcctaactccatcgtctccttccttgtgt

SEQ ID NO: 41076 - DNA, 1501 bp, Oryza sativa
cacaaaatcagaaatgtgtaccctaaactcacttaaatcgtacaaaggaggtcctatagcagtattttttccaggttttgctgacgtagcatcctagtcagcaaaaaataaaaagataaatacgtgggacccacatgtaagtgagaaaaagtgtgggatcaaccatcctactcagcaatcttcttctcttttcctttttatcttcttctgtttcggttttagagggggagcagtagcggcacgtggacggaggcaagcggagcggcggcgttagcgggcgggcacgactgcagagcgtcagcggcggaggcaagcggcgcgcagccggaacggcttcacggcgacggttgtacttcctcatcatctttgtgcgacagtggccgctgcctgctcgtcaccgtcggcacgcccctgcccacgtagcctgcgggcgaccgcccttcttcccacgaccgctggagacgggagaggaggccgggcggaccgggaggagatgaggccggccggagagggggaaaaaggcggcgccttgccgccactcgcccgccgtgccccccgcgtcccccgcccctctgctccattcgcgcctggagctgccgctcgccgatcgcttgccgttgccgcagtcgccgctccgcctactctggccacgcgctgacgccgcgtcccccgctcgcccgccgccgctccgccgactctggccgcgcaccgccgcccactgtcgctagtcctctgcggtcgttctcgcccgccgcctgctgccgccaacgctctgcagctgtgcccggagccgccgcttgccgccacgcccgtccaccgccgctcctcctgcctccggccatgcgctcgtcacggtgaagccgctcgcccattgccgcccgccgccggcaaagagagaagagagaaaagagaagaaaaaaattgcaactgacatataggccccacgtaatttttttaattttttttctgactaagacgccacgtcagcaaaattaagcaaaaatactactatgggacctcctttgaacggtttaaatgagcttaggggtatacatttctgattttgtgagtagtagtatatcttagacagtaattgaatatttacaatgaagtctcgacggtattcaatacatgaaaaacatatatgttcctcggaaaaaaaattatatatatgcgctttgattatttggcaaaagtttttgcatttttaccatacttgtgatactacaaaagtgctttcttgacatgaatacagccatgcaccctacttttgcagtggagaaaaaaaaaactcacctttgacacggacttgtgttgccctgctgcagtggtccagttataaaaacccttaaaaaaccatcagatcatcacttcgaactaagcaaaccacagtgaccacaaactccactgccctcttgcctcctccaccggcgtcgcctcgcctcgtctcggcttccaacgccaaccaccgccgcggatctcgccggagccaagaaaagcc

SEQ ID NO: 41077 - DNA, 155 bp, Oryza sativa
aacagttagataggctaccccaagtattatactggtgtgattatggtgaataagagcaataccggcttcggccaataggatgtagggttattatctgacaattcaggggcccgaacctgtataaaaatccttgtctctgtctcttttacctcagt

SEQ ID NO: 41078 - DNA, 692 bp, Oryza sativa
tttaggcgactatttccgtcaattttcaaaatggaaaattatttttgtaaaacttttaataaaaaaaattataaataaaaaaaattcgcgtcgcgcgggactccaaatttgccgtggcccaacaaggcccatggggcatcaccagtaagcccatgatgccgcgccacgacgcgacgcagtgcgctggccttgcggacaaaacgcaccggcggctttgcgcccgtcttcacgggaaatcgaggagccgagcgagacgctgctaggagagagcgacgtgccgtgttttgtcgcccaaaaacgtgtgggacggtgatggatcgaatcaaatgatagcctgtctggtttgcaggtgagacgtgagaccgcgcgttgtgtaatgctggaattaagtatattttgccttttttttaaaattttttctacaaaatagataattgaaaaaattattctaggaatagactttttttcaatgccaggaccctagcgccgaggcccatcatcaaggcgccaacgacactggcgctcataccctcgccccctgcggaagctaagtgactaatgtaaagagagttggtattgaggacttacagatagatccccgatgctagtgttattgatgccaaggacatatttataagaaaaaaaatatttatattttaacccattttggatttgttttttttacaaatagg

SEQ ID NO: 41079 - DNA, 1501 bp, Oryza sativa
taaggacgtggaagagtagtaacacaaggaaggagacgatggagttaggcttgggatgcatggatggatcaatgggattttgccgtgcaaagctgaataactcatgtgtcctaactcctaagtcgtaattaaccaattctagttaggtaggatactatcaggtctgtttatttttgcaaaaaacaggaatttggttaagcaagcaatcatagtaaatcaatagggaatcgctaaatggcatttgacattaaactgatgaggccaaaatcttgcaaattttcgactttaagattgcttcacgattcgtgttctgaaatcccagtttttctcctctaactccagcgaccggctgcaatctaacaagttacggtttagtgtcccgggttagagtggcagtgggaggtgggaagggaagaggaggaagatctttgggctttaagggatggtcatggaagacggcgagatgccggtggccgggctaatgacaaggcactggcatggaagccacgaggatggaggatagcggtgggccgacggcagggtaaagtaaagtttatggttaggaggcgactgccgatggtggcaaacctggtggcagtgagttgtcggagacgaggaaaataacagggatgggacaccttgtagctatcagcttaaggagagaaggaatggggcgacagccacagtgttctcgccagtaccattggcgtcctcccgccagacgacaagactgaacggctgcggagcatcaagcactctcctctcgtggcgacactaggagtgaggggggacgagaggagggatggagttaacgttaggttttcttgcatgaatcttaaagcaatctaacggtcaagaattatagatagacagtccatctatattactttctttttagttttttacactattaaagtattgaacttgcaacaccacactcaaaacattttaataaatacacctacacctatatatttactgtacattactatagcttagggagtttgatatttcacatatgtggaacaggtttccaaaagaggataaggagggagaacatggtaagttttgtttttttttcataaaaaaatctccctcctatggaaaaagtacgaattaccctcccgaactatcgcggtcgtccgaattacccacctaaaccaaaaaccggacattcttcaccccaactatgcaaaaaagacgaattatccctctcaacccaatccgcggtggttttggtctacgtggcgtacgcgtggcagtccagtcagcattctatttataaaaaaaatatgggacccacctgttatatcctctctcactcttcatctcactcttctctctcttctctgtcgcactctgcggcaggcgggggacacaaagtggcggcggcggcgcgcacgcacacggacggggccggaggcggcggcgtggccgagacgcgcatggcggcgaggacgacggcacgcacggcgcggcggcgcgcacgctcgcggatagg

SEQ ID NO: 41080 - DNA, 1419 bp, Oryza sativa
ccccccccccccccccccgagggggtcaggccacgtgggtgaccgcggctacccaagcctctagtcacgatacccccggccccatgtcaccgacacaccgcgtatggtttaatgacttacaacatgggatggagggagtcgtggaatctaatatttaaaatttagctctggttctgtaacgtacctgaattctaggattaaggaatttccatcaaaactagttgaaagggaagttcttcaattttataaaccaaaaatttctattttaaacctaggtggagttgatccaactcttgcaagaataaaatttgagaacaaattaaagactttttcacctttaacctaggacttggatgcaacccaagtgaaagcatgcatacttgcataaatcatattttgacttgagtccttcatatgcatttggattttcgatttgcatttcataataggtctcatgaatataattgcaatctagacaaacaactaaaccattagggcctagtgctaactaatggaaaataatacacagaaaccatacaccttaaaaaaaatcaacatggctaatgtcaagcctcacaaaactaatttggacatccatctgaagacatgtcatgaacatgaaagtgaacaaataaattatatcatatagggtatattctatcttaatcatctctataagcattctcttaatttaatactaaagtaaacttatgcataaatagggaaggagcttatgacatgtgtaaggtaaactgtaattctaacatatcaacatcacctcatgttaatgagagtccaaatataacttttataaacattttcatgcatttaggaaagggaaacacatataagacataagtcctgcgaattatctaaaataattcatgcaagataaaatcatgggaaaattcatgtaggctctactcaacacatacaactcactgtaattttggtataatttaataactaaatttggtacctcaaataaattagtcaaactaataaaaactagattaactgtagttcttaatcggctaaaaccatactttgtctaaaagtgcatttcattgcataaaagtgtataagtaaaataatttattcaaatactaggtaatttatcatgaataaaaataatttttccagaatttatcttctctgtttaggtctcctaaaaattcgaactagtttccaaagaacccatattcctctaatttctgtgagtaatctatccataatttttgagtgcaaccaaagaaaatggaatctaggtatcttcatctaccttgagaaaaatccacactaaattattctacccacaaattaaataattgaaatactaaagtgggagagagaaataatccttaaaatcattcaaaccttttgttcacccacgtttctgcccaaccctctcaccctagc

SEQ ID NO: 41081 - DNA, 443 bp, Oryza sativa
cgtcttattcaaaaaatttacgtaattataatttattttgttatgagttgttttatcactcatagtactttaagtgtgatttatatcttatacatttgcataaaatttttgaataagacgaatggtcaaacatgtgataaaaagtcaacggcgtcatctattaaaaaacggaggtagtatattttttgttttgttattcatgagtggcctaaaagatgttagtacattcattaggatcttctactccttaacatagctagtttgatcaccccttttgtttcttttccaaattatcgcagccctatcgatcatctaccatttgttgatctatcactatatatgtactacagatccaaccacaaatcatctctgacgggtcagcacgacttgtcatagatgtgaggttatctgtaacgggttgtaattgtaacctattacaaata

SEQ ID NO: 41082 - DNA, 1501 bp, Oryza sativa
gtgagtaccgttgggttcgtctcgtcgtcctctacgtgtacatgtcctccaaagtcgcagccgaccatccaatctccggcgaggtcgtcatgttggttcggccgccattgatgacgtcatcatgacatcatcggtttttctttttcccgtttttctaatagattaaatcttcggaaaatcataactaaataaccgtagatccgtttcaggtggttcaagttgctaaatttttctaaaatcaagatctacatgttaaaaatattcacatgtactgtttatgcttgtttttgtactgttttgttgatttttgttctttcgctttagtttccgacgttccggaggagagcgttctcgttgagcaaggttcggaagtgtttgcggaagctcaaggcaagtcacacagatcccaaataaccctttgagcatgttgaacccgtttaaagctattattttatttcaactatgcattattttcgaatgtcatcgggtggtgaacctttcccaattaattaatggccgaagatgatcttattttcctatgggttataatttgattagcgtgaaccttatatattggattggttcagctaaatgctatatgtaagtttgcttagccatgcttagaaacattagctaactaaagggattaattataaactatgttacattattatttttatggttacattaaatggtagctcacgatggttaatcgtgtggtgttaattaattgataattaaaacctggttaaggtgggttgtgagcatatggttttgatggttgtgctcatgacaattaaggaccggttcgcgagctactgttgtgaaacatttatcatgccaaccacaagccagcgtgggcaacggctttatcttttgtatagcgtgattcattatagtgcgccagactgagaagtggcgagaagttcacgggggtcgctggggagtccatgccttatttataagggggtgattatgatccaggaaaggtgcgctgtaatgggttatgttgtgcaaggggtattgtcacaactcctttccgaggtaccgtggtggtattgaggcacatcgtgacatgatgtggggttgtgtcttgtgggtacagtggtacacctctgatcagagtttaatctattcgaatagccgtgcccgcggttatgggcgagttgagcaatgtttttcgtgattagtctcacacctctcacaataattatggatgttaatatctggtaataatttgcttagctcctggtttggagttagatctgtacagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgtacttgcatatttgctgtgtggcttgttgagtatgtcatatgctcattcttgcaataatca

SEQ ID NO: 41083 - DNA, 981 bp, Oryza sativa
aacagttagataggctaccccaagtattatactggtgtgattatggtgaataagagcaataccggcttcggccaataggatgtagggttattatctgacaattcaggggcccgaacctgtataaaaatccttgtctctgtctcttttacctcagtctcgcgtataccctagtaccaacgatccccataccatgcaaataccggaatcgcgacatcaaacgtcgatagatccatttgataagctcttggcctgaaggaacataaaatttaatagctcgtcggacaacaaactaagattgaaacctacaaaaattaagaacacattggagcttctcatttcatatgttttttttctactgcacctccagtttactatattgacaacatactccttctgtctctcttgtgtagcaatgtgtctactgggctagactgtaccgagtcaaactgtattgctcattccctgccaatggcaatataataaagtttcggttgtcaagaaaaagatgctaaactggaatatgaaaaaataaactactgtatatatatacaacgttacttctttgctgtcattatgtaacagacagttgtattttggctgcagcaacggcattagttggtttgcagaaccaaatggaagttacccattagctaacctgccctaggtatgaacaataaacactacaaaaactctctaggattcttttgatttaacggcagagtgcaggacaccactcagaggccaaccacaaactcttacaaaagtccgaagtagaggataattaagtctatgaatagtttccaattctctgttcactgtatgctcaatattgtttttattgcctgatcaattcttctgaagcggagttccacaaagattgatatttccgtcaaacatcgatgttttgtgtgcgtttcagttatgctagccttcaatcagtaaaccaaaaaaaaaaaaggacttgattcaatgacttactca

SEQ ID NO: 41084 - DNA, 1501 bp, Oryza sativa
atacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctaatataacaagtccagagaagtcctcatttgcccaatcagtggccattacatcaccttcctcatcggatgatgcgtcgtcgtccgcttcctcattatcagaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttatattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttactgaatataatgaaatttcagagagagagggctgggcttta

SEQ ID NO: 41085 - DNA, 1501 bp, Oryza sativa
tttaagggtttttataactggaccactgcagcagggcaacacaagtccgtgtcaaaggtgagttttttttttctccactgcaaaagtagggtgcatggctgtattcatgtcaagaaagcacttttgtagtatcacaagtatggtaaaaatgcaaaaacttttgccaaataatcaaagcgcatatatataattttttttccgaggaacatatatgtttttcatgtattgaataccgtcgagacttcattgtaaatattcaattactgtctaagatatactactactcacaaaatcagaaatgtatacccctaagctcatttaaaccgttcaaaggaggtcccatagtagtatttttgcttaattttgctgacgtggcgtcttagtcagaaaaaaaattaaaaaaattacgtggggcctatatgtcagttgcaatttttttcttctcttttctctcttctctctttgccggcggcgggcggcaatgggcgagcggcttcaccgtgacgagcgcatggccggaggcaggaggagcggcggtggacgggcgtggcggcaagcggcggctccgggcacagctgcagagcgttggcggcagcaggcggcgggcgagaacgaccgcagaggactagcgacagtgggcggcggtgcgcggccagagtcggcggagcggcggcgggcgagcgggggacgcggcgtcagcgcgtggccagagtaggcggagcggcgactgcggcaacggcaagcgatcggcgagcggcagctccaggcgcgaatggagcagaggggcgggggacgcggggggcacggcgggcgagtggcggcaaggcgccgcctttttccccctctccggccggcctcatctcctcccggtccgcccggcctcctctcccgtctccagcggtcgtgggaagaagggcggtcgcccgcaggctacgtgggcaggggcgtgccgacggtgacgagcaggcagcggccactgtcgcacaaagatgatgaggaagtacaaccgtcgccgtgaagccgttccggctgcgcgccgcttgcctccgccgctgacgctctgcagtcgtgcccgcccgctaacgccgccgctccgcttgcctccgtccacgtgccgctactgctccccctctaaaaccgaaacagaagaagataaaaaggaaaagagaagaagattgctgagtaggatggttgatcccacactttttctcacttacatgtgggtcccacgtatttatctttttattttttgctgactaggatgctacgtcagcaaaacctggaaaaaatactgctataggacctcctttgtacgatttaagtgagtttagggtacacatttctgattttgtggttaagggactaaaaaaattctcgctgttaagttaagggaccttcggtgaacttattcgaaaaatatatagcgtgtgtacagtacggttgcaaggatcgcccttggcgtatgggccggataatagctgccgggacgtggccgtctaga

SEQ ID NO: 41086 - DNA, 411 bp, Oryza sativa
gctcatgaactcagattctcattctgtcatgcatctacatggagattgctgtactgatatttgtgagaagataggttgatcttgcatgcaaactgccaacacactgcaggtagggttaagttactgccagcttcagttgtgaaattataatatcatcacttcaaaagttcagagaaatggactgcaatttccctgatttttagcacatctgcgtggacattggagaccactgactgaatggattggtccagctgtcctatttttgcgctgtcctcatttggaggagaatctatcatgctgtttcatcggaactcatcgaataggaatggagttgaatatgttgtgcatgattcattgtcctgacacctaatagataaaaagtgctctctgtgttgaaattaattggataga

SEQ ID NO: 41087 - DNA, 661 bp, Oryza sativa
acaaggcaggaatataggctacatggtaggtactacatgtaggcactttgagcatacatgtgccttcgttgtgacatgtcttgggtagcatagcatttagacaaataaaaaaagttcaagctaagtaacaaaagggtctacggtactgactaacactaccatgcatgagtgctgagctcgacgagctattcgagctcagctcgttaaggcttgtgaatctcacaacaggctcgggctcggctcgtgtgaagctcgagtcgagcttggcaagctcaaatgcttcgagcttttctgacaaccctatatgtatattcgactttaagttgcctatttcggtgtaacctaagataaaagcccttaacaaaaaaaattttggtccaattcaaattttcatcttagtccaaggtccaaacacaagctcatggttacctccattgagtataaaagtacaaaccccactctggaaaaccctaatcctttcattttctccatgtcccctctcctatggcggccagtggttggttgagcaagctgccagctagctagaggagcgaggaagcacggctcaatcgtcctcctctgtctcttggctccatctcacatgttcctctccatcatcttctccttttgtcccccaatcttctttttcttctcatggagg

SEQ ID NO: 41088 - DNA, 1501 bp, Oryza sativa
ttcaactgggacaaagggtagagttggcctttttctttttcgttttttctttcagagaacaggaaaggataatattgaaaatgataggatggcatattagagcaacaagaaattgatatgctattttctttacttctacaaaattgagtggcatatctcaaaaggtcatttaaaatagagcatatcattttctgcaataaaaacatatatccatgaaaaaaaaagaaacgaactcttctggaatttttttttgaatttgctaaaaaggagcgcctctttggaattttacggtgcatattttttattttttgaaagtctactcataaaatttatttgtaggatacttcatccgtttcgtttcgtattataagtcattttacttttttttaatcaaacttgtttaagtttgaccaagtttataaaaaaaaatagtagagtttttagcataaaataaacatattatcaaaatatatttagtgttagatttaatgaaactaatttggtgttacatatgttgctattttcctctataagatggctaggaaaaaagttaaaatggtaatatgaaacggaagaagtacatatggaaaaccataaactttgtgaaaggaccgtgaaatatgaatctacgaatctactggtacaacttttatacccttagatgtgtatttgtactttggctggttattgaccaaaatctataaagtttgatcgacttgcttaaatcctaaagcatcgaataaaatttcgtgaagtttccccacaaaagatacgaatggcttgttcagtttgttgcccaaatcaaccctaacacattttggtattttggcattaccaaatttcgatagtgttgtctttgtttgctttgatgttttcaccaaattctgataaagttttaaacaaataagcttatataactctaattttttttgacgactcgcacaagacgatgcgaagttctattgataaaacaggagaaaaattacaagattataactctggaatgtcataatcaggaaaaataaaagaaaacgtataccacataactgctaaaatttagtaagatagtaatgattgaaatgtgtttagtatattgccttatccagatttggtaaaattaaaaatgacaacgaactgaacatggatgaaaaatcagcacacctgagaaagtggtggatccacagaaagctccccaaagaatctcactcaggcagaccggcaggagcaagaaggagagcacctcgcgtcgcgcgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcc

SEQ ID NO: 41089 - DNA, 1501 bp, Oryza sativa
tccttagacctgagattatcatggtttccaacatgtgtagtagcttacttagggactgctaaacgctactccgtaattgggtagttataaaagtagttttcgggtatgctatgaaacatgtagtgagatatgaataattaagatgggatttgcccctcctatggagagatatctttgggcccctcaatgttgtagattatggaagtgcatagccatgccaaaggtgattgaggagtcaatcacaagttatataatctatcaacatattcgaatgaatgattgagctattagaggatggcacatatctagccttgagcttaattgatatcgtgaggcaaaggggtttatacaaatatacactagaggttcagccgatatgatctttatgtatgcccggtgggtcaatgcgttctgctaggggccgctgttgatgcgtggatcgaaaaggagttttcaggttacagctgagtgtacatgaacctacagggtcgcacgcttaatgggccggaataaggggattggatggagatccaaaataagcttaattcggatagggatctgaataggagtcctacgggccttggaggcccgagtgatggatcctatatattcgtgaggggtgtgaccggcggaggtattgcttcacgtgagaaaccctagccgtcactcccctccccgagcaaaaccctagccgcgcgcgggtgctagcacatctgcgcgtggtgttccgtccctgtacgtgtggataccggtagaggcgccgctggtttgcggtgttgatcggcgtgggaatacggttgaggagaacgcacgaggaggagaaggtcgagtcggtgcgatcgactacttcctctacatcgacgcgcgctacttcgcgagaattccttcgacttcttagcgccttcttccgctgcgcagcgcgtcgagtggtaacgatttatgatctaatacttgcatggttcctggtttacgcgatagaaaattttgatttatgctattgtagcctacgcgtatcccaacagcacatatatgaagccataaaggatacaccggaaagttcttgaacatcctcttttatcaaatggctaagatttattctacctgttttgtttgctagttgatctaatggctattatttattggataatgtggtgcattcttgttctgttttggatttgtcttttcaagagttaagatgtgaaactttaaccatgccaagtgcgctagtaagcttgcagaagacccacctttattaattagattattacatagatatactagtaattcaaacctctaaaatttttcaaaattttcaacattaagatttggacttccaatacacattcgcccttcacaacattcgactgatggttgctataatcgactacagttcacaaacacagaaacacttgcgcacaatgcacaaagggtcgggcttgatcaggatcagagcttgctggagacggcgatgggcctggtcctgggccgggccggcgcgggc

SEQ ID NO: 41090 - DNA, 1501 bp, Oryza sativa
tccattttcaaacatatttgaaaacatagaactatacttatggcacacatactatgtcgctcataaccatgagcacaactaatcgattaattttagactctaaaaaatttgtacagcattaaccacatgatgtgaatcgctctaatttgtcttgtacccatcagtaccaccacactctatatgttcaatgtggtttagaggtcacaaagtagtctttacattacttaattcctagccttgcaccagcacagcaagtgtggatccaccctaggaatgacctagagtcgttaggtggcgtgcccacgccttaaacctaacatcgcggctacgaacacgtccgttcccccaggaggcactataccattgaattggacaaacttagatgcccaaactaccccaataaaatacaagtaaataggtagttcccgcttagactaattcattctttcctggcctaccaaaatacaaggccatcccataactagcaaacgtggatgcacattaaacaatagtttaatagtaggtgactattgacgaataatccgtgtttggccgatggtgccagatatgtgttagcgcgaactaagtcgatgaatacaatgacttgggagatcttcttagctccagtacaggtcctaaaatgagatgcgagagtgccagtcagtttgatccttcaactaaccagatgtatgaattgaagatcaaagagtcgatcgtcagatactagtccttattggacacaacttaaacttctttaaagataaaaggaaaaaacataagtcccgattgaacactaaacacactttcctaacaactgactcttattaacgttcgagagagatgaaggcaacgacgaggtcgagagatgcgagatataagggagggataacgaggcaagcgagacatgaacgggcgctcaggagttgattttttttactccgcgctgtttttttttttttttgcacgtggttgctccaaatttgtgtcaggtaaataaagaaaccaacatctgtagctttttttatttgtgtcagttttttaagaaaactggtgtttatttatactatattgtaaaaaaataaaaaattgaagatttttgtgctgaaattttggtgccggtgtttgagttggttataagttgcccgtatcttattcgatgtgagtttaaaataactattatacaccttctagtccaaacaaaccggcccataccatcccgccttctcatcccgcatgcctccactcagcgtcatttacccctctcccgattaatatcttttttttccttccctttttttttctttttctctatttctttaatccgggacatcctgatccttccaatctcctttttctccttttcctgcttttttctcttccaaatttctctcctcataaatattttttaaaaaattataattatttaaggtgtgtatgtggcaacattgttactttacaaatgcttcaattttcagtaattttttcactaattgtcgaaaca

SEQ ID NO: 41091 - DNA, 1501 bp, Oryza sativa
tcgttggatgagaaggtccccgagtgagatgttgagcagtgcgtttatgatcagagtccatgtaccatggttaatgccactcctcctaaatctctcttaattcttctagatttttcagtaatcacatgcatgtaactgaaccgagccaatgccattttggaggttattggttcaacatggaaatgaattggttacatgtgggttcaatctaaatgcatgtatacgcagtagacccacccgattatttttaagcaaaagcaatttcaatttactaggtacttccatcagttatctatatgcaaagattaatctgagaatgctacgtactgaaagtatgttatgtatttccacaacaatatcaaaccacctttatttaaattgttataaacctcactatcttaattatttatagcttttcttaatagttgattagagttgaaaattatacaagtgtagctattatttcttctaatatcataaaaaaactccagcatcattgtgcagggtttcatctagtaaatagaagaggaataggcgcgagtaaaacacctgacttgatgcatagaaataggcacatacaatatactaaaaaatatatgtgcattgtaacaggtgaagataattttcacattgataaaaactttgttaatttaaatgacaaacaaaaacaagacaaacaaaacaatgaaaaactaaagttaaaaaaatcatatatagcattgacgtagttccgctcgcttcatgcgtcatcacacgaagaatccttcctgtacacctttccatagcctcacaaatcaatcaggtgtctcttccgtaagttgacgcatgtattttactataccacatggaacatcgattaaaattttaattattcaattagtgtggagattatgggtaccccatacccacacggcatggttatccgactagttataggggataacttatatatataaaatatgtaacagatcatgacttgggtattacgtttccctgtatattatggaacggcctaaagtcctggtttgataagattgtaaagtagatttaggaaaccgataccgtattggttaaggtttctatcttataaccctgccccccaacctatataaggagggcagggagctccctctaggggcatgagacaactagatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacagttggcgcgccaggtaggggtaaacgccgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacga

SEQ ID NO: 41092 - DNA, 1501 bp, Oryza sativa
acgaactactgaaagtctttacctaaacatacacaagaaaaaggaaacaaaaagattcaatagccggcgtaaattaattgagtccatcttcaatactagcttcctcatccggtcaatccgtcaggtaggtgatcgacattccatgcttagtccaaagcatccttcaggcctagacaggcagcatatgggcggcaaggcaacaattcatcagtgcagcattgcaactcttctctctgctgactcaagatcatctactcaccacaagacgaacctaagggctccaccagcctccttactctgtggatcagccttcggcaaattgggcatgcctgatttttgtcttccgcgatcctgcagtaacagtaggcaatgtggtgttattcagtgagcttcatcaaataattatgggacaacaaatctttggctcctagctttacagagagataaatcataacagttcagaccgaggcttataatcggaatccaaaacttgacaatttatcaatttgtgagttgtgactttacagggatcaggtcccttttattctacatgttaataagacgcaaatatcaggaaatgacctaatatcaaataattagaaggggtgaggcttcaaacccatgtcgtctagcccaccaccttgtggagctagccggaagacccttgagtgtttctcattctacaagttaatcagattcgtaaaaagaaaaagcaatcaaatcaaagccatacagcagtaaactgactcctgtaactgaaggatttagatgagaattatacctccttgcacatgtaaaacatgcaaaaccatggccacagggtatgaagaagcaactccgtggagcatcatagcagatcttgcagacattctcactgcacatatcttctgaagagcacatgctcgactcaggctgctcttccgtcgctccatagctgaaaaccaccctttttcttggtagaattggttctgtttcattgttccttgcatcttgatcccgaactgtttgatggtctgtatcagaaaattctgccagttgcttcaggaagcaataaaacacagctactataacacctacagttcaaccaatggagacagaatcagtattatttaaaaagtgcagtgaaaagatctaatcaaggaatgagcaaattgaaaagcaatcatgaagctatatcgcacatattatgacaaagtatgatgccaactgggaagaaaaggataagtcaaccaacaaaagcttcattagcacctgaaacataaatttcaaaccacttagaaccagttttctagagaaaataaataaaaaggtggagagctgctgctacagtttaccttctgatgtattgatagctcaaacaaaattgcagtaaactagtaccaaggcactctacctggcaatatcaggaatgcaatttacagcggcatagatggtaaaagctagcagcgtgcggcacacaaaactggaggagaagataacagtctaacagaagaatgcagca

SEQ ID NO: 41093 - DNA, 1501 bp, Oryza sativa
tttagtagaagggcccgtcacttaaagggtaaataaattcgattttgctatatctttgtcgggtgattttttgtttggtatttgacgcttttctgtttgttggattgcactacgattcgtgctggaatagtgcaaaaatttaaagtgggtgagagccaaaaggaagagaggatgcgaaaaatttctagtgggtgagggaaaaaatgagaggtattttcccctgcggtccgcttaagaggtctacatacgaaaatcgatttctccgggcggttctcttaagtttatcccgtgcggttagattaagacacccgcacgggataatgtattttcctatgcgggcgaccgcccggcgctgttcgcctagtttttccaaatggggccacttacgtcccgtctagaatctaggacgtcaaaaaaattatttatgaactagtgtcggggtcgtccaatctgattagttcaaagaacgtgtgtgcaatctaacaggagagactgattacaccattggttttaccacgtggaatctctttttcctatgaagttaagatccaaagctgaaaccttagtgttccacgtcatcgctaattcttagccgttcgatcggtggatgagattgcatatgaatcgttggatgagaaggtccccgagtgagatgttgagcagtgcgtttatgatcagagtccatgtaccatggttaatgccactcctcctaaatctctcttaattcttctagatttttcagtaatcacatgcatgtaactgaaccgagccaatgccattttggaggttattggttcaacatggaaatgaattggttacatgtgggttcaatctaaatgcatgtatacgcagtagacccacccgattatttttaagcaaaagcaatttcaatttactaggtacttccatcagttatctatatgcaaagattaatctgagaatgctacgtactgaaagtatgttatgtatttccacaacaatatcaaaccacctttatttaaattgttataaacctcactatcttaattatttatagcttttcttaatagttgattagagttgaaaattatacaagtgtagctattatttcttctaatatcataaaaaaactccagcatcattgtgcagggtttcatctagtaaatagaagaggaataggcgcgagtaaaacacctgacttgatgcatagaaataggcacatacaatatactaaaaaatatatgtgcattgtaacaggtgaagataattttcacattgataaaaactttgttaatttaaatgacaaacaaaaacaagacaaacaaaacaatgaaaaactaaagttaaaaaaatcatatatagcattgacgtagttccgctcgcttcatgcgtcatcacacgaagaatccttcctgtacacctttccatagcctcacaaatcaatcaggtgtctcttccgtaagttgacgcatgtattttactataccacatggaacatcgattaaaattttaattattcaat

SEQ ID NO: 41094 - DNA, 1501 bp, Oryza sativa
taaaaaatatgcaccgtaaaattccaaagaggcgctcctttttagcaaattcaaaaaaaaattccagaagagttcgtttctttttttttcatggatatatgtttttattgcagaaaatgatatgctctattttaaatgaccttttgagatatgccactcaattttgtagaagtaaagaaaatagcatatcaatttcttgttgctctaatatgccatcctatcattttcaatattatcctttcctgttctctgaaagaaaaaacgaaaaagaaaaaggccaactctaccctttgtcccagttgaaatggaaaaagtacactgaaggttgctcaacttgtcatcgagttacaaatcgtcccccaaccataaaatcatatatataatatctctaaacttacaaaacccattcactttaggtccttgagtgattgtggccccagtttgtttgacgtggtggttgggtcagtgtgggtcccacatatcaggatgccacatcatcaccctctctctttctcatcctctctctcacttttctcctctctgcacggtgctgacaggtagggaggaggttgccggggcaaggtgagcgaggagatccggcagcctgcgacgcggcggtggcggttgcgattcgcgagcaggccgcgcgtgccgggtcggatacctccaatctcaccgagttcatattcgaggaagaagattatgctagatatcgactacaaagactagattatatcatcccaaatattatactcgtgtgatgataatatataaaggcaacattggcttcacccaacatgagtagggctattacctgtcaattaaggaaccgaacttgtatgattttttttctctcgtctcttttacctcaatctcacgtatatcttggcattgacgatcctcatactctacaaatatcgtagtcgcggtatagcccatcgacaatagtatgatgtatggcatgttctagactgtgccaccgtttggagctacagcgccatccaacttaattatggtcgcagtcaggatggagctacgtgtaaaaggaggtgcttaagaacttgatcaagaaaatattttaagcaatagtttatcaatttttatcatagatgcacccactaaatataaactcagatacctgatttaaaacagagtaaaccaagtggatgacaccactctccaattcaatctagcttcgtctaggatcctagtgtacttagccaaaaattattgatttaattcttttattaacgaaaaacattattgtacgtttttttgtttttcactgtaactttattcaacggaatactattactgtacggagtattatccatgacgagtataggtacagacgcaacaaaatcaccattcgagaagcttctcctctcctctactgctcctccatttctcgaacctcgctcgtcagtctctcgatttctcgaaccttcttatctgacgttgacgcccctcagaaaaatccactcccattttaaatccccac

SEQ ID NO: 41095 - DNA, 1501 bp, Oryza sativa
tggcagccgccggatccggcgacaacggtggcgctacttgtggaggaggctggcccgggcgaggcggcgaccggtcgacaagagacttgttgagttatttctttcttttctcctcctccatttccaacctgttgagttcttgagttgtttgatacttagttttggatggggatgatgtgatctgggatggtggtggtggagaagacggaaaaaatttggggtggtgatctaggatggggatgatgtgatagatgtgttcttggatttggggtgttgatggatgtgttcttaggtgattgggagctcctcggtgcatcggctcgaatcgagccgatgcgtctagctgtttctatttggctcgtggaaacatcttaggtaccggttgggaacccctcaacctgcacctatatttgttataggtgtccgtttacaaccggcactgatgagttccctgatctgtgccgccttcatggtgccggttgggaaaaccggcaccgaaggaggtttcccaaccgacgctatttaggtattctgtagtagtgttttctccttccctaattctgttttcctggtagataagtgcttgtcttgccaaatgtaaaattatatattgcatataggaactatataatgcccgctatgactgctaagtacaattggaagatgtttttttggccatgataattgtgaagacatatttacacaattgcactggtgatacacttgagggattgtgttatttgctatatttgagaaaaaataattgatgaaaattaccaacaatgcagtattttgtcagttagagaccttaaagaccatcttgaaatgtaaattttcaaaatcttattgtagatacatatttacgtgacctttttactaagtgatttgcaatcttttctaagaaaatcaatttaggcaagatgtggttttggaggttaattttggcctttctagtttatattttgataaacatttcattggcacatctttataactaggcaaaatttgctaatggacatttaaaaaagtgtaattggctgggaaatatcgtaaaaacatgacacggctgatggtcattacaaaaattatataattggctatagggcaccagtcacattattttagatgtgagaatttttcaaaataacgagattgtccctggcgccatcttccctcacccgaaatcacagaagttttgtagctattggcaaggtagctggcgcagaagcggacctggttggggagggacaggaggtggaggagcacgagctagcgactgctcgaagctccaccgtaggcggctccttgtcacaagctcccgtcgtggccgttgcctgcttgcctccacgtccggtccctgctcgcgcgctgccgtgtggagcagccgcctgcacgtgcgctgcactgcgacaccgcctccttctcccaatctcgcatgctgccgcccgagtcgctacatactccgctccgccgtacaccacctccgcctgctgctgctcga

SEQ ID NO: 41096 - DNA, 305 bp, Oryza sativa
cccccccccccccccacaaattttttatttttcttttatttgtttgatatttttttttcacgcttagggacaggcaagaaccaaccatagaaaaattgaactcaaatggacataatatgtgacctgtagaatttttcctctcatctcctctcttcgaactagtgcagaggagacagatgtgcaaattttttatttttattttatttttttgatatttttttcacacttagggacacacaagaaccaaccatataaaaaataaactcaaacggacgaaatatgtggcctgtagaattttccaaagc

SEQ ID NO: 41097 - DNA, 1297 bp, Oryza sativa
ggcgccccaaaaaggaccatttctgggataagttttttcaagggtctatttgcgaaataagtttttcaaaaggaccaaaatgtgaaaaatctagatgtttttcctatcctgcgtttcaaaggggccctaaatgaactttttttaggatgattcttataggttagaaataaatttataaagggggataaatgtaggacgaaagagaagaggatgatggcatagaatattgtgtttaaacctagtaagcgcatgaggaatcgatgtcgtatacggacataatttaatagtgccacacgcataaatcgacatcgattatatttgtaaataatggaacacacacaacattataacacgactatgacgttatttgatcatgaattaatcaacttatacatcacctagttcacattccccaaattttctcaacactattgcaattcggacaaagaaaaaaaaagaaacatacaagtcatcagcctacaccctccatttgaaaaaaatcaattcccagctatatatgaacttggacaaatgcttgtccatgttcatagctagaaattgattatcctttataaggaggaagcatatcgataagtcataaagaaaaggaaacaagaaaactatgttctcaatccgatcaacggtactgccctgatccatcaaagctaaaccttcaaaccttgctgatctaggcagctaattactgcagcacgtccatgtttagcaacacattaacaaccccaccacattaattacctgccctgacaaccttctgctggctagataggaagattaagataggagatattccccgcaaaccctcacgcttccggctaagcacatattccccgcacaaaaaagaaaaagaaaaagaaaaaaaaaagccaaaacggcaacccaaaacatcaccgctaaccaccgctcatcgtccctttcacgatcaacggtccagatcgaaccaaccgcatcccctcaagttccttccctaaaccagaggatcgagtccactggttgacgcatgcagccatgcaagcacagcccacgctagctgtccgcatacgcccgcgtgcgtcacaacggcttgaagacgacgcgacgacggcagcaaaggcaaccccagcgtgacctagctctcggcttgaagacgccgcgacgacgcccggacacgctccccccccccccctctcctcctccttaaatcccacacgccgccacccccatttcgccatccatcgatctccatcgccatcgatctcttcttcctctctctccacacaatctctcacgagtctcgatc

SEQ ID NO: 41098 - DNA, 1501 bp, Oryza sativa
gatagttgttgaacaaatttgtggttatacgcagaatagatagatcgtgttattgtacatatggagtttgatttcataaaattgaagatgtaatttttatggacaaaaagatataggaacaagtcccgtaaaaaaacatagaagatgatcttgaaagtttatttcatgagtaggaacgaaattgaaaccaaacaatagtcaatactaccacccctgatccaaaataaattaatttctaatcattatgattcaaaattagtatgaagagaaaaaaaaaacaaggtgaccctcattaatagaatactgttggttggtagatagataagaggtaatgatagaactcctagatttatggtcgagggtacgtaggcgatataaattacttatttggggataaatgctagagaataagagtgaacctattttagaatggaggtagtaaatttttataaatccctctatatgaaaacaagcaagtcaaaatcgaataaattgtgttttcctcagttatgttgagatccataccatgcacttgcatttgttgatggatgatggggagctaagcttgcatgtcctctttgcatcttgtcacatgttaaatttaatttgagcacccgatgagtgcacactgggataaaataaaccacccaccggtagcacccttttaacaacaaaagatgattcatatggtattgatttgaatgaacaatgtacaaaaagtgaggaggatgaaaggagaggaacgagggatcttgcaggagaggagaatgccggtgaggcagcaagaggaagaggtgagggtgtaggatgatgcgtttagagcctactatataggcgcttatatagggaattaattgccgccgtataacgacataatttaatagtgccacacccataagccaagccgatagcgggaaattacgcccatttttaagtactggaccacacaccacattctaacactatgatgacattaatcctgtgatcttgaatcaaatttatccatgacccagttcacattgtccacatttctcaacactattaattgcaattcgcacacaaaactagtgtttatcacaaagtaaaaaagagagaggaaagatacaagttatcaagtatcaacctacacattcttaaaaaaaagtcaattcctaactataaatcagacaagtatggttatccacgttcatatctagaaactatcattgattttttttaaggataagaacatagagagacctgtggagattatgggtaccccatacccacacggcatggttatccgactagttataggggataacttatatctatgtaatatgtaacagatcatgacttgggtgttatgtttccttgtatattacggaacggcctaaagtcctggtttgataatattgtaaagtagatttaggaaaccgataccgtattggttaaggtttctatcttgtaatcctgctccccgtcctatataaggtgggcaggaggccctctagggggcaga

SEQ ID NO: 41099 - DNA, 1379 bp, Oryza sativa
atagtgaatcctttattggcaccaaaaagtgttattccctcgtatggaatcaaataaaaaaattatccatctcgtcaatggtcttgtttggtagaacaccgcagcagctacagtggctgcagcgggacacgcttacagttctgcttgatgaccatccactgcggtgctgccgctgttctgctcgggctgtgctgtacagtaaaaagcgctgcatgttggcctacctagcaggcccaatgtgtgctcttccgggtgctacacaagcaccgaacaggatcattgcatctaggcaacaactgcctactgcctccacagagcaatgctgtctcggtggcaatgccaatatagaaaaaaaatgcatgacaaaataggaaaaaaaatattaccacacagcttaagtttttcaaacaccagagaaaaaaaaaagagtggtgtaatttcgaaatgtagttggacctgcaagatatggacaagctgtgaggaagtggttagctcagctcacacattggagaccgcaaagagggcatgtatccaaagattcggagattcatatcctgttcttccatgagccccaaatcagtgaagtttgtcatttcaggcctaccaggaggagctacacccagggtcgggcagcacaagtgccggcacacaaccctgctgcaacatgctctgcacaacttcatcgcccttaccatggttgacctcatctggaggaaggggcaccagagttgagtcacaatccaccatggcatggcgagcaggaggtggagtgtagcatgacggatgttaagtgcggtggcagctcaatacggtatccaaggctggtgggaggagcgagatttgtagagatgaggaaaaataatagataagagatgatgctgacaagtgggctcaggggcattttaccatttgcttacactactgacaaactctgctaatggcaatttttaacggtggcgtccgtagtggcttatgagggatgtgaaaaattgctcggtaatataagggaagcatctaatttagatgtcgaataaggaaacttgttaatttcagatgtcaaataaggaattttctcttcagatgtccttgttcttttctgattaagattcagattttaccttggtttctgttaggacgcttttcaaactactaaacggtgtgttcctgtgaaaactttctatatataagttgctttaaaatatcaaatatatccatttgtcaagtttgtaataattaaaatttaattaatcatgtgctaatggttttctcgttttacgtacgtcaacttaatcctcatcttcatcttcatcagtgaaaacttaatcttcaacttaatcattctctgttggtaatagtttgccttgttatttgtatgttgc

SEQ ID NO: 41100 - DNA, 1501 bp, Oryza sativa
ttttttgggataaaggaatttctttccctctaatggacagtaaatatagggtaccaagacctacttcatccgtgtaaaaataaaccaaccttatacttgtcacattcaagtacgatgttggtttattttgggatggaggaaatatttctctctagtttgtacaatacaagttgcacaaagttgtgatgggattttgttttcctatggaacacagagcggaggaaatgacctcaaacattagtgagtactattcagacattcctttgtttcaaacggtgcaacaatgaatgttttccgaaagaataaaatcccttccccccttaaaaaatgtatctcttcaaaaaataaaatccttttacaattttttgaattgaaatactccctccatctacttttgatagtaatatttcatcttggcacacagaccaaggataagcaattctacttatcattcatttaaacatggtactagtcattccttgtaaacaagcgatttattaatatttacatttctcaatgctcatgtagccaatcatgtgtggaagaatagagagtcatgcattaaatccgagaaagtcattaagatgataggttgttggattgaaatatgcctatcaaaaataaatttttcagatttggaaatatgactatcaaaagtagatggatggagtaaaactttaaggatgtgttcttaattcaaggtttgcgacctttactttatcgttttccgcgcgcacgttttttcatactactaagcgatttgtttttttttaaatttctataaaaaagttgttttaaaaatatattaatttatttttaattttttaagctaatatctaattaatcaatgttaatccgtctttccttttatacggaggagagggattcctaacccctcctcaaagaacaccactcaaccaaaatctcgtttggaatttgaggtttgtgattacctaagttttggagtataaggtggtgtctgaatctcctaaagatgaagatgaagatgaaaattaagtgtttcacgtaaaacgaggtggtaataacgtgcgattaattaagttttaattattacaaacttgaaaagtgggttaatctgatattttataataattttcatatagaaagtttttgcacgaaacataccgtttagtggtttgaaaagcgtgtcacgaaaatccaaaacttaatccatccttttccagaggaaatgaacggggtctaaagcttccagagtttcccaggtttgctcgggaactttctactacacccgaccgacgctctcccattcgcaccacgaaagcatcgaacggcccacgtcgcgtctctccacgatccaacggcccacgatcccatctcggctattcctcccctcccctccaaactcaaaacgccgcccgcgagcccaaacccaaacccaaggagagggcaaagaggggaaaagaaaaaaaaaagagataaaaaaaaaatctcctcctcctcgccgccgccgccgccgccg

SEQ ID NO: 41101 - DNA, 1501 bp, Oryza sativa
tgaggaggaggacgtcgtcggggagcgagctgaggcggtcctcccctccaccgccgatcaccgcgtcgtcgtcgtcgccaccggaggtggaggagagcttcacgcgcttggtgggggagacctcgccgtcgctgacctgcgcgcgcgcggtcccggagacgagcacgtcgccgtcgacgtcgacgtggtccatggccgagggcggaggcgagcgcggtggcgtcgccgcgtctccgagagagaagaatggagacacggcagacgagcgagatcggaggccgttatataaaaaggggaccaccaattctgacatacaccgtgcgatctagttctaacggtgtagattcgagaaggaaaataagagaaaaagattcgcgatccagctcagctgtgatcgagattggatttttacagagagcaccctgtgatgtgtgatcatttgcaaaccagtaaatttcacaaaactgctgataatttaaccaaattatcataaaactataaatttaaggtgatatattgatataacgataaatttatcatgaaactactgctttaagattgagcatcgcaaaactaaagatttaataataaaattattataaaactatagattttgaggtttaaatctttagcacaaatattatgattgagttataaacatccaagtatgtaagtaaattgacgctaaacttatagttttatgataagtttgatactaaaatataattcaccttaaattcgtagttttatgataaatttggtattagagttgtattttgtgatatattatctttaatttgtagggcatgttcagattgtagcaaacaataaacattatcaaattttagcaatgccaaaattttgacaatttgataatattgccaagtttttgcatgatttcttatatatttactaaagtttagaaaaaaaactaaatggattcacatatttaataattttatttaaaaatgatatggtttgaaatggcatcgatatgaacaacccagtagttttacaataattcaatatataataagttttgtgcaatttactcttgcaaattgcatcttgggaaacggctttcgggtcctcgccgccggctgccgctgccgtcggcggcggccgccaccaccggtccgtgtacttgcgcatgcggtgcgcatacttcgccatgaccacgccgccgctaccttcctccaaagcgcccgcgaaccccacccgcctgccaccatcgcgttccatatgcctacgccacgcacctcgccaaccttagcgcgcctctcccgcatgctcctcgacggttgccacgatcgcccccaagatggcctactcggtctcggacgactccctgcatcgaccctgcgcggctgcgcttatgggcatgggggagccacagctgcgctcatgctgttcgacgaaatgccagaccgcgcctccgccgtgcgtcacgttagaggcgatgcctatttgctcggaaaagatgggaccgaccaagtccgac

SEQ ID NO: 41102 - DNA, 1501 bp, Oryza sativa
cctgttcccctggctgatgatcgtcgggttcttgctccctccgatggcatacatgagccagtgcgtgtagtcgttgttcaccacgtggaaaaatccccatcggcatctgcacaatacatgataaataataatgaatgatgttatatatataataatataatattattattattaatattttatgtatggtgttctctactggtagtattattatgtgacctgggcattctttggacgaggccgcggccgaagtggttgaaagcgacggtgatctgcatgatctggtcctcgctgaaggagtcgctggagccgaagagcatgacgtcgttgtggttggtgaggtggcagttggagatggtgactccggtggacttggcgatgacgtcgatgaggccgtcctggcagttggagagggagaggtggtcgagccagacgttggtggagccgaagatgctgatgccgtcgccgtcggactgggtgcggaagccgaagtgctccggcgagtcgcggatcatcccgcccttgccttgcaagatgtcgtggatgtggatgttgtggatgatcacgttgttggagttctgcaccgtcacctgcgcgccattggtgatccgcacctgcgctccccgcccgtcgatcgtcttgtcgctgttgatcatcatctcctccttgaggttgatgatcatgtccttggcgaagatgatccacagtggctcgtcctggatgacaccccaccggagcgtccccgggcgcgggttctccacgtcgtcgtcggtgccgtccgtcaccaggtagaacttcccggccagccctccggtggtgttccggccgaacccctgcgcgcaccgcgccagccgcttcctgtccgtcacccagtcggcgcggcacctccagcaccggtcgatcgggttcgtcgccttgcacggccccgcgaacttcttcctcttcgtcatcgccagctccctcctcccgctctcctcctccgatctgcacgcacacgttactatcatatgttctaaccaactgagctattctcacgattgattgattgaacgaacgatcggcgtgcctgtggacggcgcggttgaagctgttggtgacctcgaaggggtcacgcttgtaggtagcctcggcggcggcatcagccatgagcttgcgcttctgccagtactcatcgtactccccgatgttggcctccgatgtggctgccgccgacagcaataagaagacggcgtacagcaccaaggagccggccgccggcagcttgctccaccggatcagcacctccattgctaaaactcaactcagatatgatctagctacgttaaacaaaatctcctctcttatacggttaccacaaaaaaaaaccacaattgatcgaaatccgtcgagctcccggccctcctcctacctttatcttgtatatgagggaattttttcagctgtgtgaaggtaggacgatgagctccattgctcggcctgtgcgaggaggaaatggatcaga

SEQ ID NO: 41103 - DNA, 402 bp, Oryza sativa
aagcggagaagacgaagagctcctgaaggcttgaaagtttctcgcaacagccggactccaaaatggattcccaaaactcccttaaataggcgcactaccgacggtgcgaattccaaggaaaggagagagatggccaccggaaatttctgggtccgttgcgtcaggcggtttcttggactttaatttaaatttactcataaccgttggacttcgcatggtgttgtcgaacactctttgtctctacggtcctcacaccgagatcgaccagttgagaacgacaacaattccgacatcagaagtcgcgattggttacatgagttcatttaagtagaagtcgggggctattgtcagggttacggataaggtataccctctacccttggacgtatgctatacgcaata

SEQ ID NO: 41104 - DNA, 400 bp, Oryza sativa
attcctgcagccctcttctcctccaatcccgtttaattaactctttccaataaatgatcttgcagcttagctgatagccatgacaatccattacccagagtaggcatcaaagaccggatcattgacatcctttctattgacctccgtttctggggatgcatgataggcatatccagacggtattacctcgacatgcgtctttccatcagcgacatgatccgcggcgttgatcattctctttaccataagctcttcataatatacaccttgtgtcttgtcaagtggattgctggtaattaacttttgcatttttgttccactcaattctacagtatacagtatcagagctggtcacaccacatattgcattgcaaaattcattagccttttcgtattcagt

SEQ ID NO: 41105 - DNA, 1501 bp, Oryza sativa
  unsure (1)..(1501): unsure at all n locations
gaaaccagaaagactctagcttagataccatactagcaatccacaccgcaatttctaagaaatcatgctacaccgtgaaataattaatattacacaaaagaattgaaaatatgtgagcaatgggattaatcgactatccgtgatcctgccttgcgaggggcgacacgcaagagctgtgcggaacaatgcaaccagaaatgaaggttgtaatattccctgaaagtgcatctagccctttaagtgggttttggtggattaatgacaaaccagttaagtgactaataatcttgtgaagaagtgtgtgcaggtgttagtccaaaatgaatggagacatccaaatctaattaatggaatttggagcgagaacttgaacagttattttaaatttcttttgtgttttatctcttgagttctaggaccttcgtattatcaagagggttctcaacagatgctcaatgtctacaagtgctcatagtcattctctggaagagagacacatgtttcgcacatgcacactgggttgtgccacctttttctatctgccaggagttctcaaagagatgcctggaaacctccgggcctaagtgttgaccggaagttctccgggggctagcccagaacttcgggctctgtttaagtttgaatttgagagcaacgtctagttgatgtcgcacgagtaactatatattccagcctctcccacctttgttgcctggcaattccactttagttttcttgtccttagactctcatatgatgttattcttggagggcaacctcctagatggataaatttcgcccgcgagcatccatgtcattgtggattgaccagggaaaagtttgtgaaggttttcctcgcctccgcaaggaaaagaggtagtttgagtgaaaattatgagctgagccttcggaagttgtcttggtagggtaatccacattcgtggtgttctctaggtatccaagttgggaatctttgtggtcatttgaaatctagagaagtacatatataggaatggtggattgaaaatcggagacttcttcctagggttttggttggtgagacaaggggttaatagagacccaactctttggagctcctcaatggagattaggattcttgtaatccgagcttcgggtgaaaaatcctgtgtctatcctcttgtgcagtttatgtttctcctttgatttactgctttgaattgttcattaatcattactgtcttttgcgcctttgtaagtcttggnnnnnnnnnnnnnnnnnnnngtgagtctcgaggagcgagaacccgaaaatttctggaaagaatcgtggaagttccaggtagccctcactgtcttcgggtaagagatgctaggaagttccaaaccctatatattaacctctttaatggaagaaaattgttcaatcaatcaatcatgaggatagctcagttggttagaacatatgataacgtttgtgtgcagatcagaggagttgagcgggagaaggaagctggcgatg

SEQ ID NO: 41106 - DNA, 377 bp, Oryza sativa
tgaacttgggtaaatgcatgctgatgtgagcgttttctggttatctgaatcgcaatcaaatggcatagatagatactgaacatggttacatggaaaaatgatgcttacattgcctccagatagcttcactcagatcaagcagaaacgctttgcattctctgcaacgatgctatcaagtaatgactcgcatgcgttttccagcagatccagcaccagaaaaacattgtgcaacgatagctgtcccctccctccccgccgcctgccttctctttccccaccgccgccgctgccctctcgcgcgccggccgccgcctgccttctctttccccgtcgccgcctgcactatgacgcccgggcgacggactggttggtgggga

SEQ ID NO: 41107 - DNA, 1501 bp, Oryza sativa
atggatagccaaaagctgctgctcgtgactggcacatacttaaaggatggggtgaaggggcacatcgatcagcgatatcattcatgtaactttggttcctccatgagagagctctgtgcagattaaagccaaggaaaagaaccaccaaattgattagataaagaatcctagccatgaaattatgtaggattttatgttactatggtgggtagcctaaggatttccaagaatcgaatagctatctgaggagcacagaaacaaagtgcacggtgctatattgggtatcttgtttcttgtcatgaagtacttaaaaaggtgaggcccatgaccgacattgtccattttggccaacttgtaggatggcatttacatgtgaacaagttaggaagataatgtgtagaggagttctttcgctacttatgggcacatattttttatgagagaatcatgagcatgcaacaggttatatattaattctttccaaaactaaattgtatgagtgtaagctatcgaataaaacagaagaaagaacatgtgtaaaatgactcatgccatattgatgatcagaaatgacacccctgtacgaacacttcagccctatcgtgtgaacccaaagtctgttgcagatcactaacaatgtttgagaagaaaacgcaacctcctttgatgcactagcagaatgaacaaaattttagaagctgccaaactactggcctgcatcagttgcgcaagtacgcccttcgaatacaccggcatttgtcagttcatcctggaaatagtaggatgctatgccatgatattcagcttctgtcaaagggaaaaataactctgtgtggaccaaggtcatcgtgggggcattcttcttacaacctatttgcaactccaagagattatgtatatgattagctaagtttagagagtaaagaggtctgtaaaaaggaaaaaagatcccaaacagaggggtaaaaccaacagcctagctaaatattgactctccatattcaaaagggtccacgtcacggctcccgttcttccggaccggttgactccgcgacttctcgtttctccgctgccgccgctggtttccggccatcgcttggacgtcgttcacagccggctgcttccttctgcacgtcgctgcctctcgttgcaccgcgtcgccggcggcagatcgtttatgcatgccgcgcgcctccttgttgcgtcatcacgccgccgccggccactcatccaacaggtgcgtgcactatcgccatgtagaggaagattggtactgcaatcttgcgtgaattcaattaacatcagtagaaattgatcactcttgcgtgcagggtatggagtctgatgatgaatttaatgagttcgtaatgaacgaattgattgatccctcttcgtcgaatgaggagcatgatctattttttggtgctgcgtaaatgatcattgaggaatcagtaaataatctgggtcgaattggatctgttcagggacatgaggtagtgca

SEQ ID NO: 41108 - DNA, 1501 bp, Oryza sativa
caggccggtggtgaagtcgtagacgcccaatagcggcggcataataggccagccgtgtaggcggaggcaccaatcggcggcgacggaggcaggccggcggtgaagtcgtagacgcccaacagcggcggcataataggccagccgtgtaggcgaggacaccagtcggcggcgacggaggcaggccggcggtgaagtcgtagacgcccaacagcggcggcataataggccagccgtgtaggcggaggcaccaatcggcggcgatggaggcgggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatttgagattaaaaatcaacatgataaataatgataaaaatcagattgagtttccccctgactgatttggatcaagtcagagaagaggagcttgaagaagtgatcgacggaaaggaagtgaaaactcccaaagcgaaaacgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggacggggagcaggattacaagatagaaaccttaaccaatacggtatcggtttcctaaatctactttacaatattatcaaaccaggactttaggccgttccgtaatatacaaggaaacataacacccaagtcatgatctgttacatattacatagatataagttatcccctataactagtcggataaccatgccgtgtgggtatggggtacccataatctccacaggtctctctatgttcttatccttaaaaaaaatcaatgatagtttctagatatgaacgtggataaccatacttgtctgatttatagttaggaattgacttttttttaagaatgtgtaggttgatacttgataacttgtatctttcctctctcttttttactttgtgataaacactagttttgtgtgcgaattgcaattaatagtgttgagaaatgtggacaatgtgaactgggtcatggataaatttgattcaagatcacaggattaatgtcatcatagtgttagaatgtggtgtgtggtccagtacttaaaaatgggcgtaatttcccgctatcggcttggcttatgggtgtggcactattaaattatgtcgttatacggcggcaattaattc

SEQ ID NO: 41109 - DNA, 1501 bp, Oryza sativa
tcgagagctggtacaggtttaccatatgccgacgagaggggtcgcagaccaacaacaggttaggtcccagaccatactgtgccaggaagcccaggggtcctccccgacaccaccctggcgaatccacttgtcttactctttaaaaattcataactaattcatcttagctcggatttagttggttcaagtctctaattttttctaaaattgagatctacatgttaaaaatatccacatgtactgttcatgcttgtttatgtgctgttttggtgattttgctcttttctctttagattccgacgtttccggagagtctgagtttgcaggagaagattttgaagagttccaaggccagcaaggcaagtcgcacagatcccaaacaaccctttgagcatgttgatcccgtttaaagctattgtttctattcaactattgcaattattttcgaatgtcattgggtggaattaacctattgtttgttatagcccttttgttcttgattactttattccttgataccttgggttattataacttgactagttgggctttatatattggttcagctagatattagatatgattgcttagccatgcttagaaacattagcacactattgagataatttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcgaagataagcccacgggagttgctggggagtccatgccttgtttataagggggtgattatgatccaggaacggtgcgctgtggtggattgtgttgtgcgaggggtactgtcacagctcctttccgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctcttggtttggaatggtacattcctggtttggagatagaactgtgcagccgggatggttgttcagaatggttgggcctatacaacagggtatgttgtatagcgttggattaatattgtttaattactacttaactattttattaaattctaaaatgtttattaaatgatgtttatgcaaatgaaaccctactatgccatcctttgttatcctgtgcacttgcatatttgctgcgtggcttgctgagtatgtcatatactcaccttgtaatcattcatcagcg

SEQ ID NO: 41110 - DNA, 1501 bp, Oryza sativa
cgtggtaggaatagtcttactgccgactgtcagctccacatttagaacacctttggtttccgatggattaccaccaaagtatttgagcaccatatttgtcttgatgagatcctcggcgttcctatccaacttcctgaacgtagcataaggcatcaaatttaccgcggccccaccatcgaccatcatcttagacatcgccttcccattgacgtagccgtttatgtacaatggtttaagatgccgattctatgttccctcgggtttctcgaatactgcctattctggtgacagaaccaacttagccgattcctcttccacttcatcgacatcggcttgatctatcccgaattcagctggcaatgtaaagaccatgttaattggtgccgctacaacactctttccttttgccaacctcttcgcctcatcggctgcagcatcatcggctacaggaacctgattcttaacacgccactcctgtcttggctttggtttcctcagccgatggttgatttcttgttcaacctcctgaaggcgctccctgttcctcaatctttgaacccttctcttctgattttttgtgaaaataccagaaggacaccattgattcttcctgattacctcatcctcttggccatgatcttgattcatcggacccaatctttgatgaataggaagtcttgcctgccttagccgattacccttattatatgaccggctcgagctctcgatgatatcactgcacccagggcagttttcgatagatggcaacctcatcccttcattccagaagaatctaaagaactcacaaccccaatgaggatcaaaaccatcgtcgtattcttcataatgcttctcctgctacttgtcatacttcctctgatacttgttgataatcttagccgaatttacttgaaaaccctttgcacggatcctatcggctgtttggccagctgtatgcaccatattaacaggaaaaggattaccatcgactttcattggctttttggaatcatcgaacctaatctttcccccttcagtggcaacctggatttgctgtctaaaaaccttgcaatcattagtagaatgagatccagaattatgccatttgcaatacctctttttgcccaattcctcagccgatgggattgtatgaccagcaggaagctgaatttgcttctctcggagtagtagatcaaagatcttgtcagctttggtaatatcaaagtcatacttctcttttttaggaatttttacccattggcatggtatgacctttttactcctcacccatttggctgcagctatttcagaatcgtcttccccatcatccgacccatacatatacggacaaacatgattaaccttcttagagcttttcctgacttccgccgacctatgctcatgcaaggttaccttctgtatgataagctatcaaagtcttcagacgagaatttctccctgattggagcaatcataccctggaaggctaaatcggctaact

SEQ ID NO: 41111 - DNA, 1501 bp, Oryza sativa
agttcctcttcccaaccggtttaaagttccagatttctccaagttttcaggacaagagggcgtgtcgacttatgagcacattagtcgattccttgctcagtgtggtgaagcatcggctgtagacgctctgaaagttaggttattccggttatctctgtctggatcagcttttacttggttttcctctttgccatatgggtcgatcaatagttgggccgatttggagaagcaattccatagctatttctacagtggggttcatgagatgaagttgtcccacttgacagtgattaagcagcggcatgatgaacccgtgcacgagtatattcagaggttcagggagatgaggaacaaatgctttagtttgagtttaaatgatgctcagttagccgatttagccttccagggtatgattgctccaatcagggagaaattctcgtctgaagactttgatagcttatcatacagaaggtaaccttgcatgagcataggtcggcggaagtcaggaaaagctctaagaaggttaatcatgtttgtccgtatatgtatgggtcggatgatggggaagacgattctgaaatagctgcagccaaatgggtgaggagtaaaaaggtcataccatgccaatgggtaaaaattcctaaaaaagagaagtatgactttgatattaccaaagctgacaagatctttgatctactactccgagagaagcaaattcagcttcctgctggtcatacaatcccatcggctgaggaattgggcaaaaagaggtattgcaaatggcataattctggatctcattctactaatgattgcaaggtttttagacagcaaatccaggttgccactgaagggggaaagattaggttcgatgattccaaaaagccaatgaaagtcgatggtaatccttttcctgttaatatggtgcatacagctggccaaacagccgataggatccgtgcaaagggttttcaagtaaattcggctaagattatcaacaagtatcagaggaagtatgacaagtagcaggagaagcattatgaagaatacgacgatggttttgatcctcattggggttgtgagttctttagattcttctggaatgaagggatgaggttgccatctatcgaaaactgccctgggtgcagtgatatcatcgagagctcgagccggtcatataataagggtaatcggctaaggcaggcaagacttcctattcatcaaagattgggtccgatgaatcaagatcatggccaagaggatgaggtaatcaggaagaatcaatggtgtccttctggtattttcacaaaaaatcagaagagaagggttcaaagattgaggaacagggagcgccttcaggaggttgaacaagaaatcaaccatcggctgaggaaaccaaagccaagacaggagtggcgtgttaagaatcaggttcctgtagccgatgatgctgcagccgatgaggcgaagaggttggcaaaaggaaagagtgttgtagcgg

SEQ ID NO: 41112 - DNA, 1501 bp, Oryza sativa
tacatttatcatccaaaagcaaaactaagttgataggagaaaaaggagggaataatttatatatttttttatctttggttgactattgaaagaaaaaacctaaacattataagatgatatggtttataacaaaactaaggtgatgcggtgcaatgagaaaagaaaaataagggagataatatagatgttatgatccaaaagcaaaattaaggtgatataatttaataacaagaaataaagaggaaaataaatttggaccgtagatcaatcatccatgtggcttcatgacaaagagagaaatagcattaactacacttagtggggatgaactggtgtttagtacctagaaacaaaataatattcacttttagatgacttgagctaaaatgaaaagaaatacacattaaaggaatcaagatactatttataatatttagaatttcttatgatagttttaatttttctttgttttttttaaaaaatagatggttaggacaaaaatatgttgatgattagttatgcagatgttttaatattgtgagaacatcgtcaaatattgttggtaccatcctaatcacaataatgtatttttaccaacacaaattcaagccacaacaatagtatgatacattcataatgaatatcttaacctttgtggaccatggttgctcaaaggaattgacacatgcatggggaggtaacattttagggtcataaatagaaatacttaaaggaatttaatttcttagttacacaggaagataagagtcatctctctcctaaacaatccaatagatatcatgagctacatgtgcatttcaagaatgatccaattgttaaggtttaaacggtgacgtgggtcaatgtatgttgatgagcttgcttagatgaattgacacatgcattgggaggtaacattataaggtcatgaatagaaataattaaaggaatttaattcctcagttacacaagaagataacagtcatctctctcctaaacaatccaacagatatcatgagctacatgtgcatatcaagaattaatgatacaatggttaagatttaaagggtgatgtggctttatgtatgttgagcttttggtcccaactatataggatatatagatatataatttgtagctagtgttttaatcatttactacaggttggggtttgccataatttcttaattttgatctgactcgtcacatattgtttgccttgtttttttatgaaatattgtttagcttgttttaccacaagtgtggccaccaattttggtgccacaatccatatataacttaaacatgtcgtggttttgctacaaaattgtggcaacttctggaagtgaccaaacaaagccccaaaattaggctatttggggctaatgttctgttgatggccatacactaacctgtagattgtcatcttgttggaaatgcaggggtacatccaagccaccaattatcgggcgtgacgaccagcagcaggaactagaggcaa

SEQ ID NO: 41113 - DNA, 358 bp, Oryza sativa
tagagtcgacctgcaggcatgcaaggctttggatttttgtttaaatttaggcgtaatgattagcaaatgttgggagtcactagtactattttaagtattattccaatgttattgtctgtgacctgcacaatggtgctgcagaaagacaggaagtataggtagttctcgatggatgcaactttggataattaagtgcaccaattatgctctagacctctaggtttgtagtttgtgcccaaggctttgagagagtttgtatgttcttaacgaatgaactatgtgttgcatcagagtagggaggtcagaactattgtccaaaagcgccttaacttgaagttgtaatttttctctgtgtagg

SEQ ID NO: 41114 - DNA, 427 bp, Oryza sativa
gtgtatatagccaagaagtcttcttcagtagggtatatgatcagtcatccgttgtaagcgtacaggtccaaacctatctcgaatgcagacaaattaacagctcaacggaagcaaaactttgctactgcgattatgatgctcgaaggcaccaacgccatgtcctaatatatcttaccgtatatagtaatctaaacacgtgtgtagaactacaaccaaagaacgtccaagtttccaaacaactgatacaaatattgacgaataagaatatcacatcacacatacaacatccgtgggatttgtcattgagtcaaaaacaagaggtcggaacagaataatgttgcaaacatacaaaagtatcatcttttcattacagccataccctagcgtacaccaaacggatacaaatatcacttggaaagaaaataca

SEQ ID NO: 41115 - DNA, 321 bp, Oryza sativa
cctttaaaaaagattatcaccagtcactccactaccaccacagagtttcaccatgtcaacttcacgagttgatttcaacatcaccaaaagaaaaaaaaacaagtcggaataaaatcagttgtggaaaatcaagggcatgcgggagccaaaaatgataaggaatacctttcgaagaaatagaacatggcaaaagtttcattggcactgctcagagcctcagacatcatgacaagcacagcatcaattcacaccgataaaacaagtgaccatttctaaagcacagccttctcattcactccatctcatctccattacactgca

SEQ ID NO: 41116 - DNA, 760 bp, Oryza sativa
tgagaatctgcataacatctgatatgcctcacttgcttacctttttcggatggtatcataccactcccgctatttttagcgggtagaggttattctactagcctgggtcaagcctttcctctgcagggcccttgtgatccttgtgcagtaaacccctacgggtggttccccattgtcatgatgtagcgaacaccactgcaaaactttcacaaagacaccttaagtgctccagcttcatatgtgacaagcaacgccgaagaaaaggaaaaggataatgtatcatcttttcagaagcattccactgccactgggaccatgttgtattagtggactcgttcttgcttctccttggtactgttcctaactctccgagtagttagaatgttgaattttccatactcagcaacaacagaagaggaaacatttgcatgtttgttagttaccttgcgttttccttccccttcccaactgaaaaatataatcaccctcccccccagcaatacagcagctatgatttggtttacatgatttcatttgttggtcatgtcaccaggaagttcagtgtgaattgtgttatgtctgtaaatacagatgacttagaggttattggcctaatttccccaaggttgagggactacatctgcatctttagtattatgggctaattgtgaagagcaaatggcatggggtggttatgtatgttatagtttactgacatgttttatttgttcaatacacagttgtttccgcaaagaacatc

SEQ ID NO: 41117 - DNA, 526 bp, Oryza sativa
cgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtgtgtggaaagatcgcgtacca

SEQ ID NO: 41118 - DNA, 410 bp, Oryza sativa
tcctgcagcccttaaattactgctagaactttgtctcgcagtgtgattttcattaaaaggaaaagtatttacaaaagataattacaaagagagcactgaaaatattataatggttataaccaatcaaaaactctttactttaaatgatctttcattccgcacatatgcagaagaccttctttcttgaacaaaattctccaggcctcaaaggaagaattcttgttctgaaatatctttccatttctttctttctaaatatgccgggcagcaataaagaaatttccaagaagcccttttgccggaaacgcagtcacgctaccacaaccatttgaaagaaattgagattaggatcccaaagaatgcctaggtgccgtcaacatctctgactgaaaggacaaaagaagaaaaga

SEQ ID NO: 41119 - DNA, 1501 bp, Oryza sativa
tagttgctttcgcactcttggttgtgggggtgttttaagttcctgtctatatgaaattatgaacaatgtttctccagatttcccatccactagtatgctgcaatgcggttatatcaatttctcttttaattcaagctgaagtgtttttcgtgtttctaatcaaggacccctggactgtgctgtcattcttgactgtctaggaatctggagcagtttacttaggggaattatagtcctctaggttgatgttacgataattaaatagaacatggtgtttgcatatcatcatatgtggatctgctaggcaagatattcgttacttgaaatgcatactgtttttccttggacactttcggtcttctgagtttgtttcggattacaggaaattagcacatgcatttatattttgtcttcatgatacaactttattgttttttctaacatatgtgcatttcttctctcgctctttttctaaaatgttgtgggagctcttgtcaaaaaaaaaatgttgttggagcatttagatgttactcggctatttttatttcatctcgaacatcagtcgatttttgaccaatgacaagttgacccataatatgtattaagttccatgcatgaagggaaactcagctgttttagttcattatttccgtcaggtttttatttcttataatagaggaaaaaaatcgactacgtcattgttggattgctgttcaaaaaaattgagtgaacaattctcttattgtagtcaattgttgtttagaaatttcgtttttttgtactatatatttttatgaggctgacaaaggtcctgtttggttccatgggctaattattagccctgaattagccctaaaggatctaaacaggtgggctagtttggagctaaagtgaattagcccccctcaaaacattagcccctccaaggggtgctaatggagctaattttctatggagaccatcaaaaagcagccctatctccctctctcttctctctttccaccttttagccccaaattagtctaaggatccaaacatgtcaccctacattagcctaccaattcaagactaaatattagctctcaaaattagccctgggctaatcttccaaacaggaccaaagtgacaactgacaaggctcagtccaccgaggcgcaaaccaaatcattttaaatacagaggtggggggtataattgtgatgggtttgcgctggggtggtcgatgcccaggtatttgtattgttttgctcccaggaagaaacccagtatgagcacagagcactcttaattcaaatgtaatagggaatgagaatcaagtgaggatatatatgtcagcaactgcagggacttttacatgtcatcaactgcctacagtgtgtagttgatagttagaacatgttgtcatgcatgaaagcaaattaaagacgagaaacagagcatgcaaactaggaaggcagcacttcctcttctatgggttacacatttttaagataacaataat

SEQ ID NO: 41120 - DNA, 1440 bp, Oryza sativa
ttactttgtcatttttaatttattgtaattatttctagctgatttaactattttccaattaacttagttttcaattattttatataaataatcatataataattccacatagtattcattttttcattattttaaaatttctaaacatactttcattgtttttcaatatttatatatatttttccttttttcctataacatatttatccaaattattttaacctaattttccctctacaagttttctctctcatcatttcccaccatataccttattggagacaatattgaatacaaacaaagccataaatgtaacatgctaaacatacatcattagatggtgttgctaaccttttcgattcctccgatttgtatattatcaataaaaatttcattaaaaattttggtagcacctccctccctcaaagctccattttgcagcaatggctcgagctagaggaggaagaagggatatataaagttgggtctaaagatctctaatgtctttagtcccggttccttggccccctgacagggggcacgcctaatgggcgggcagcgatcacccatctgtccccctactcccccctctctctccccgcttcctcctccccttcttctcttcttactacagtaaaccacaaaaaaaaatctaaaatacaaaaagttagaaaaatttatgtatagaaatactatgtataaaaaaattgaattcaaattcaaatttgaatcgggtatgtaaacttttgacttataaacttcaggtctataaactttaggtgtataaactttagatgtatagaaatactatatatagaaaatatttgaattcaaattcaaatttgaatcggatataattaaaattcaaatttgaatcgggtatgtaaacttttgatttataaactttggatctataaactttaggtgtataaactttagatgtatagaaatactatatatagaaaatatttcaattcaaattcaaatttgaatcggatataattcaaattcaaatttgaaacgggtgtataaacttttgacttataaaatttaggtctataaactttagatgtatagaaatactataaaaatatttgaattcaaatttaaatttgaataggatatataaactttcgatttataaactttgggtctataaactttaggtgcataaatttactaaaataggaaagtaatgcggtgccaaaaaaaggaaacgtggagggagggagggggggagaggtggtgatcgctacccgatcgctccgcgatcgatcgcgcattagacttttcgcctgacaggggtctagcatgccctgttagggggcgaactgggactaaagacgattggtgttaccaaccgggactaaagatcacttagtcccattggagtaataaaccgggactaaagaaacctctttagtaccggttctttataga

SEQ ID NO: 41121 - DNA, 1501 bp, Oryza sativa
tataaacaagaaaatgatcatgccatccagcacatatggttccacaaaaaatatgtaaaaataacaaggcacttctatgactacaacgtgcgattatattaaccaaatgttgaaatttaaatcacactatactcaggtggccaaatattcaaactcgacaaaaatcagaattaagtcacttgtttgtaagagaaatttttttataaactgtattgttaataaaaaagaaatcttagacttcatagtgttcacttgagatctaattttgtagcggaaggtgaaatctagttggactgtgaaccaagaggatgatatgcttgtgcaggaaaataaataaataaatataaaaactttaacatgttaagttagtggtaaaaattgtaaatgtagcaaatactaactcttgatttgttcaatatataaacataatgaaatgggaatttcaagtatatcgaattgacatatattgcaagacttcggatgcaatttttaaccaaactaatatatatagccttggcaatttagtttattgagattcatacgtttaattataaaaaatgtgataaattttatgtacagatgtacgtataagaataaaaagacaggacatgggcactcaaacctttaccaaaaaagaaaccagaaaataaccgaaaataaagaggttgtaggtagtcacctgaccaaagggttgcctcatgatggcagtcagcaatgtgtatctgcgtgctagaactcctggatggcactttgtcagtgagcatggtcacatgtggcagttgttttaggattatcatgccacagctaaataataagctgttctatgtgcattttagatccggttagtaaggtggtctattgtaggcttatggatctcccaatcggttgacttcagcatgggaaaaagccccttactgttccagtttaagcgtcctacagttaatccttgcacgctttatcaaccatcctctcataagtgctagcacagttctattttcgatttcgactgtattaatgcttctgtagtctgtaaaatcttgatctgaatttcacccattgtgacccccattccattatatggtatagtgatttcatctatatcctttgacatcctagccaccattttccatttatgttgtgtaggtaaagaagaaccagaagagcagcaatccattatccaaaatgaatttaccccttactcaagctgggcaatcaaagccgaagtacaatagaacagacataaaacagattagagatactgtgggatatttgcatagcatttgtgatgatgttcacaaggctctcttgctagataaacttgatgcaattaaacaagctgctcaagatgcaagtacagacaaacgtgagactgtggataacttcactgaaaatcctagaaataaggtgttcccaagggaagaaatgaaagatattatagaactaattaatagtgctgcatcgagtgatcaagaacttttagttgttccaatagttggtgctg

SEQ ID NO: 41122 - DNA, 1501 bp, Oryza sativa
acacgcacgtaaggaacgcccgttgggttatttccggtcgtgacaaacctccgtctagaaaacaccacaagtgtgagttgctctactaggaaaacctctagggcttcagcacaaggttctttactcacttacctcgtttcgttgcagaggtgagaaataccttcacaaacttttctgggacatccacagttgctaagaagctcgcgggtgacacctaaccgtctaggagatgatctccaagagtaataagcaccgagatgtcaacccacaagataccccaagtggtcacaccaatcctagtcttcaaaccttctccaaaacttctccttcaccctcaaaatctcactctctctcaagaatggctcaagattgggtggaggaagcaaagaaacttttgggagaggcttgcaacagctatagagtggagaaacaaaagtgaaatggccaaagagtgagctggggacgttttggatatatatatatatataacggctaggtgacgtcttctagccgttactcacatttttgaactggaatgggtctggaacttcctgaccaccggaagttccggacaacacttgggaaaattttcacctttcaaggtctggaacttccgggtccataggaccggaacttccggccggcctgatctatcctggtagggccattttccaacaaagctcccaaaaatattttgacacttgggtctcacaaagagcacttgttatatcctagaaccacacctggaacccctcttaatagtacggtttttcctaaaattcgattgcaagaaataaactatcctatgcacccttcgagttccaattccgcttgaatataagttgtgggggttctccaagcatctcttgaccacacaatatcatcttgggattaaacacctgagaatggtcaataaaactcattagtcccttaaccctatttgtcattaatcaccaaaacccactagggggataaatgcaacttcatagccatgtgtagagtagccatggttgatatagccaaagtcggatatgttgatgtcgaggtagctgttggcagctgttaaatgccgattctataccgccaacatctgcataaagatcagataataaaacatccaacatagtgataagtgcttaatctcacatattctacaagtgttggtgtatatttgtatgcagatgataaaccccgatgttgggaggaaaatcagactaatgtgaggagaattatgtattcatacaaggaggggttgtgaacttcatcaaaacatcagtgaatcaacccaaaactccgagaaatggacagaggagagcccagggagttcaccgactgaaggccagaccaggaaggcccagcccaggttcggccgaaccccctggttcggctgaacccccctgatcactgttgatcctagggtttggcgtggacgttccagatgttctcccaatgacggttgcggggcagttcggacatttccccttctcacaaccgtcataac

SEQ ID NO: 41123 - DNA, 1501 bp, Oryza sativa
ttagctatgcctatttacctttgttatgaccttattattattgttattgatattattaccttgttcaccctagattaaacaaaaccccaactagtggacactctactcatggtaccactagtatgaatttaggtagatgtttcgctagttaattaggcaacattaggtggttttacaattctagactttgggaatattctcatcacctggacactatggaatggatggattattgtggaattggattcacacctccccctctattcaaaatcctcaaaatggttttaggctaggctcggggtgcatggttttgatagtagcacctcggccatataaggaccagtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcagtactcttgtctatggctaggatgggttggaaactatgtcacgtcttccgtccatatacagttgtggtatgtggcacgtggttacacgtgagaaagatgtgtcttgtgggtaaagatgtacacctctgatcagagtataacctattcgaatagccgcgccctcgattatgggcaagcctagcaatgtacccaagttagtgttttaattcttaaaacctgcttaacaactaaaatgtggaatggttggcctgggttggcttgggacgagctgggacccagggtcgggttgccagttcggtctgaatcgtcgtaggccttgggttaaagcaggttcgtgtgggttcacggccttgattaataatattgtatagctctagaatcgtgtttacaaaatagctttgagcaactaagtgtcttttaatgctgtttactgcaaaccctaaccccctatattatggctcccttgtactcccttgcatttattctgtaattgtgggtgtgtcttgttgagtacggtggttgtactcagtcttgctcaatttttcccaatcccagaagtggagttcctggaagatgaaggctttggtgtctagctcgtgcctgccgtcaagcgcctgtggtcgtcgccctagtcttccgctgtttcccgtttgtctttgtgtgtgctgggctttcgccgcccatgtaataaattaattatttacgcttccgcttgataaactctgaaatgtatcaacttttggtgtaccttgcctcctgggacaaggaataatacacgcacgtaaggaacgcccgttgggttatttccggtcgtgacaagttggtatcagagcccccttgaccctagaacgagctttagatcccaagccttagcaatattttcgaaataa

SEQ ID NO: 41124 - DNA, 228 bp, Oryza sativa
gaagaaaaatattgagatagtttgggcctatttgaaagtagaaagacttatttggaaatcatggatatacacggtgatgtaataactttgtaaattctatttctctccctatttgtaaatattttatatatatatatatatatatatatatatatatatgcgcgcgcacatggtggcgctacgaaggaagtagcgcgcctctcagcgctcgccttcctggcttttagt

SEQ ID NO: 41125 - DNA, 153 bp, Oryza sativa
atctttggcacgatggagtagagcctggagaggcatagctccgccaccaggttcttggacaacatctcctccaccctcttctgcttccatggcgtcatcattgtccaacgctgaacctaaaacctaaacccactgtcgctgccctccaccagc

SEQ ID NO: 41126 - DNA, 1501 bp, Oryza sativa
ttattaccagttatagcatcaataattattgtgagagctgtgagactaatcacgaaaaacattgctcaacccgcccataaccgtgggcacggctattcgaatagttttactctggctagaggtgtaccactgtacccacaagacacaactccacaatatgtcaccatatcatcatgtgcccatgctgaacatgtcaccatatcatcatgtgcccatgctgaacatgtcaccatttgtgtagttgtgacaagacccctcgcataactcaacccaaagcagtgcaccgttcccggatcatagtgacccccttataaacaaggcatggactccccagtgacccccgtgggcttatctccgccacttctcagtctggtgctccgcagtgagccttgttatacaaagtgtccagccgttgcccattctggcttgtggttggcacggttaatgtttcacaaccgaaaatcgtgaaccggtccttaattgtcatgagcacgaccatcaaaaccatgtgctcacaacccaccattatcaagttttagttgacacattaattaattaaccaatcacgattgaccatcgtgagctatcattaaatatccatcattaagtaatagtgaaacattagttatcccaattgtatgctaatgtttctaagcatggataagtaattatgtctaacatctagctgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggaactgtgtttgggatctgtgtgacttgccttgcaataaagggtcttcaattaatcttcttaacacttccggcgcactcacgaaccttcgaaacgacggaaacgacaagctaacacgcaaaacgaggaaaaagactaataaaaaccaaatagacaatacataaaaagtaaacaaacatgtagatcataattttagatgaattatgagacttgaacggccttattcggacttcatatgaatttattacaaattttacaagattaaatctaattaaaacctatttaaaaaggattaaataaatttaattcaatttatgtataattttaatatgtagatctttattttatacaacttttgcaacttgaaccacattaaactgagttacaaagaattagttatgaatttttaaagattaaaccggattaacgcatttttatggattttaattgaattatgacgcaataatgaattatttttgaaaaggaaaagaggattattgcgtcagcgggctcggctcacggaggaccaggtgcatggcgacggttcacgaaaacgaacggccgagattcatccatccaaaacggacggccaagatccatcggtccacgaccggaccacggcggacggcaatga

SEQ ID NO: 41127 - DNA, 1501 bp, Oryza sativa
gaatcggcctgctcggatggcactcgaagacatttcttgagttgcgacacatggaaacatcatgcacgttgcccaaggatgcgggcagctccaactggtaagcgacttctccgcgtcgagcaatgatacagaaaggacccacgaaccgaggtgcgagcttccctttcgtctggaacctgtgtacaccccgcaatggcgtgaccctaaggtacacaaagtcatccactgcaaattccaggttacggcgtcggttatctgcatagctcttctgccgggactgtgccacctttagattatcccgaatggttttgactttagcttcagcttctctcaggatatcagtcccgaacacttggctttccccaacttggtcccacaatagcggtgtccggcatttgcggccatacaacgcttcatagggtgccatttgtatgctggcttggtagctgttattgtaggagaactcggcataggggagactcttatcccaggtcttcccgaaatctagaacacaggcacagagcatatcttccaggatctgatttagacgctcggtctgtccatctgtctgcgggtgatacgcggtgctgaaatttaatcgggtacccaactcttcttggagcttcttccagaagtgagaggtgaattggcttcccctatcagatacaattttcttaggaacgccatggagactcacgatcctagcgaagtagagttcagctagtttgttccctccataggtggtcttcacaggaataaaccgagctaccttggttagtcgatccacgactacccatatagaatcataaccaccctgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccaatatttttctttcaagtccaagtacgtcttcgtgctgccaggatggatggaatagggactttcatgagcttcctgaagtatcaactttttaagttccctgtcgtctggaacgcatacccgatttccgttccatagggttccgtgttcatcctctgtgaaaccagcggctttaccctgtttcatattcttgaggatcccatgcatatctagatcattcttctgagcctcgcggatttgatcgagcaaggtaggcttggcttccagcgtagccaagaatccatgaccaactatgcttaggttcagggcttccatctgttgattaagttccggtggaatgtcacggacgccaagagtgttgcaacggctttttcgacttagagcgtcggcgaccacgttggccttaccaggatgatagtgaattcccacatcataatcgtttatgagttctaaccatctcctctgccgaagattcagatccgactgagtgaagatgtatttcaaactcttatgatc

SEQ ID NO: 41128 - DNA, 1501 bp, Oryza sativa
aaaactttcgtgaaatatgtaaaactatatgtatacataaaagtatatttaacaatgaatcaaatgataggaaaagaattaatgattacttaagttttttgaataagacaaatagtcaaacatgtttaaaaagtcaacggtgtcaaatatttagagatggagggagtatcttatatctatacatatctctcaaagctcgttacaatcaactagtccacaatatattctctctgtattatttgactttgacttctggacattttggggaattctcaaaagatgggtttggagatgagttttacattttcttcaatgaattgaagtataaatttgaggtaaaatggggaagttttgggagttgctcgaaggaacttttgtatggggattttaaattttggtatgaagcttgtgttctgatttttttttaaccgagggggaactttgttccagcttttatatttggaagaagagaaatgacccagtttataaggaaaatcaggtaaaaaaccaaacaactgcacggttaattacatgaaaccggctcaaacccaccgctacacaactaacaatgacggtggagcccaaacgcaaaacatcgctgctatgctaaacataaatgcgacacaacagctccgacatcgcagaagaggtgttatcattccctagctagccgcccaagcgacccaatagcgccgacttcacaatcgcagcgacactgaagccacgaaagtcgccaaagcgaaaaacagctcgaacatccaacaatggacatcagccaagccactgaggagccacttcctttgcacggccagcatcacaactccttaaaatagactgcaagttctgaatttttgggtctttgatgttttgtgtcaatagaactatagaaggggatagttgttgggtcttatgtcagcagatggaattttggatgctaaaataggttttactaaaatatcttatccttccgctgcgaaggatatgcgagaggtttttcctaaaaaaaaaaagatatgtgagaggaaactcctaggcccaacagattgcagtttgtcacgagaaagggcgtccaggaaaggaaaaggccatctagttcggtgtggagacaccaaccgttttcctgtttgtcctaacttctttggcttttttttattatgtttcctaagcaccaggattttgtaataaaagtacaaggaaaatcgtccactccttgtcattttggtaacgctcccgctcatggatccctccattcacgtgaaacaattatcgcaatgctacatctacacttaagttgcaccacgaaccttccagctacaaattgggtacctaggtggtattcggcattaggagaaagaaaaaatgcagcacataattttcctcgaaatgagtctgcattgtatgattaaaaataatgtttgcatttcagcacatgctcatttgcccgattatcgtattattctcgtagagctgtatgcttttaatcttccttgtcatatgtatt

SEQ ID NO: 41129 - DNA, 650 bp, Oryza sativa
acttgatttaaccatatttatctcgtatgcttcattgacatgttaaatctaccctttatattaagatctggtggcatttaagtatattaggctctttgtttggtatattttacttgctttaatatctttacatagagtagtatcggagtattagccgatacatgctagatccatctgattggctatgctatgaacatatatagtctcgttgttaatatatatttcgatctaagtgatttatactatctcggcatggcgaccgatctatcccaatcacttgatttaagtatatattgacataaggattatatatcgttaatatctatagtcgatctagtagattttgttatttcttacttattaatgattgccgatcgatgcatatatgacatcggctcaaagataaatgatatgtcatcggcacttagccgatcggctatcgtttatggattcaaccgcagtttctttgtctttgttcttgttgattgcaggatcaaatcaactggcacgctagcacacccgaaggtgagttttggacctacactggagttaagcagatctcccaggccttgtgttttcacatcaacacgcttttggcacgcccggtgggaccgatcggaagtcagaatcacaacagctgtttttcctca

SEQ ID NO: 41130 - DNA, 546 bp, Oryza sativa
ttcatattggaatcggttgtcgtttgccgatgtacaatggtcgatattgttatgtcgcccttagttcaagctataattttatcaatgcttttgacattgtaaaattaggggggcacatatatgaaaaattgcaaatttttgacaaaatatggagttatgttgaatcggcatgaaagttattaagataatttcaatgaagagtcaaagttttgttagccgattacaaaaattcctaagacctattatacaagatatcactgagacaaatattgctggatagcccaaatagctctttgcctgatttgttgtacttcttcaatggcttgggtatcttgagcatcggttctaaggatgacttttaaagacttggtcagatcaacaacattcttgatagccgattttagtcttgccttctgctcttcgacaaactttgggagattggctagctttttatgttccatgtccaactcggcgttgcattcttgaagttgtgccaaaagctcaatcttgcgagcttcgagccgatcaatattagatttgatcagg

SEQ ID NO: 41131 - DNA, 1501 bp, Oryza sativa
agtaaacttgttgatagttgtaggtggattaaatatttttttggagtagtagctttgggacaatttaagttatgcattggttataatatgtcggtttggactacgtttaggaagaaagatttaatttttgttgcaaagttacatttgattttttggtgtagatggatagacttgttcgtgtttactacggtggtagagtggtggaaccttatgttggtgcacatgttgagtttgaggatatgtcattgaagaccattttgtttcctacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttacatcaaagttggtacgtaccgtagaaaatttggatctaaacaaatctccttcttatcattacgttgagaagaattttgtgacatattcttctcgtcgtgaaaggggtgcaagtaagactgagttggtacgagaagacttggaggaggaaggagagaagaagagacctttgtttggaaatgaattaggggaggcaggaccatcaaagagacattgcggtagtgatgatatggatgcagcgagaaagatgaaaagggagttagtacaagaggggcttgatctaagtgaacatttgtcggagagtgtgcattggtcgttgtacggaggcaaccctgaatacccgacgcaagtagcaggccaatatgtgaatccagatgattactttgatgtcgaattgagtggtggtgcaaatttagttgttaacaggtggtcacgattctgtctcagtagaagtcaatagagaggaggttgacgaggaggcaagtgttgagcaatatgatgttgaatttgctaaagactctgatgatgaccgtccattccctccactaactaacaatgacaagttagcattagagaaatgtcgtgcgtttgagaaggtgtttgggaggaagccggacattcctgagtttagggacctaacacatgcccatggtgcaatactagatggcggcatcaacctagatcaattgccagaaccattccagatggatggtctcagaaagggtttagagttcccatccatggtcgcattgaagctatgactccaggagtacgccatcgtgcaccatcgtccataccgagttgtcaattctgccgcaaataggaggtacactgttaaatgtgaaaacccacggtgcaaatggaaggtccatgcaactaagaggtctagtggaacgtggaggatatcacaggttggtaaggcacatagttgtgctactgccaaaggttcagggagccaccggcagctgacatccaagttcatagcaaataggttatgcaatgccataaaactacaacctacactctctgcttcta

SEQ ID NO: 41132 - DNA, 247 bp, Oryza sativa
gtctcttagtaagcttcctagaagattcacctaaaatatcaagagtacaaccaatagtcaagctcacaaaggtgtgttcttttaagaatgctctacaggatagcatctttgctaattaaagctaatagaactcattaaggcatatagccaacctgccttgcagctcatgagagtacatgcatcttcacttaaagaggatttagattggtactctcctccagttgactaatggcttgttcttcacagg

SEQ ID NO: 41133 - DNA, 408 bp, Oryza sativa
agcctcgcgaacccacttcagaagccatttcgtggaggccctttcacatttttagtcttttcatttccatctcgaattcacacctatctagcagggctgttgctagtgtaaataacccctaagaccattgcaaactcagacttttgataatccaattcggaaccctttgttcagctgtgtgctaacaaaccccagagagagattctctaccccttttctcttgtgttttccttcgcggagattacagaagcggccgcgtcatcggcacccaatccgtgctcctgatcctcgagtttaggttgcgtaggttggttctttgagagtgtggttgggcgaatccttggttcaggctgccgtatagagacggtggttggctccttgtgcgtgtcgtcaggttgcactaattat

SEQ ID NO: 41134 - DNA, 440 bp, Oryza sativa
ttttgggacgcgacaatcttctacctccagccgccggcacaggccgagcccaagccgtcgcccgagccgctttcttctcctctcaaatccgctccaatccggcctcttttcttccggatttttgaggggttttgatcctctcgttctcctctatcttttcccccaagttttggagcaaatcgttgtgtatcttgttcgaatcaaactcgttttcgagtttatctccaaaaccgagttttgattttctcggatcgattcctctcgtttggagtctgatctcttcaatccaaggctatataaagcatcccctcgtcgccctctttcgtttgccccctctctcgtcctctcccgtgcaccgtagcgccgccgccgcgtgcacttagccgccgccgtcgccggccggtcttcagtcgtgtcgcgtcgtcgcctccgccgttagg

SEQ ID NO: 41135 - DNA, 755 bp, Oryza sativa
tttttgtacttgcataatggttttttttttgccagatacttcctcctaagcatattttgccacagtccatcctcattgattagtttaaataaccatgtacttaacatacacctattttggatttctaagttttgaatccctaggcccccgcattccttagagcaaggtcaatagtgtagccagctactagctccaataatatccatgtcattttatagccaataccaaaattaactagtacaataggttggctattatatcaacatgatctcattattcaaacaataaactttacatgtgcatgatcagaaacgccctcaactctgtggcctatatggccatttgtattatgcaataaacatgggttatctactactctacctgaaaaaataacgaataacaacacacttgataattcacatagtatatcacaacccactgccgcccaactgcataatctatacatgaaaaaaggagaagaacaaaagggaaaataaaaggagctataggaagagattagaacggactagatgcaacagatgagacgaagaatcggtagaacagacatagacgacaagcattcaacagaccaagggagaagaaaagaaaagaattagaccaagccaattcaaatcaagaagttgcttgttgctttgggtgccagctgcatgcccgcaccaagcgcttctcaatcctcctctcgctttctttgccgctgagaactgggattactaactttttgggcgcactggagc

SEQ ID NO: 41136 - DNA, 984 bp, Oryza sativa
tattgttgaagaaattttgatgatttgatatggatctaatggttgaaattgttagttagggtgtgtgtgattcactaattaaagtagtttgcaacacttgagttagtcatatttgatacttgatgaaacccgtgctgcaggagttttgtatcatttaagatagctagatgacaactttatatactttatacaatattcatctttgatcgactatttaaaaaaaactatgaacggtagtttataacaaaactaaggtggtgtggctcaatgagaaagaaaagaagggagataatatacatttatcatccaaaagcaaaactaagttgataggagaaaaaggagggaataatttatatatttttttatctttggttgactattgaaagaaaaaacctaaacattataagatgatatggtttataacaaaactaaggtgatgcggtgcaatgagaaaagaaaaataagggagataatatagatttatcatccaaaagcaaaattaaggtgatataatttaataacaagaaataaagaggaaaataaatttggaccgtagatcaatcatccatgtggcttcatgacgaaagagagaaatagcattaactacacttagtggggatgaactggtgtttagtacctagaaacaaaataatattcacttttagatgacttgagctaaaatgaaaagaaatacacattaaaggaatcaagatactatttataatatttagaatttcttatgatagttttaatttttctttgttttttttaaaaaatagatggttaggacaaaaatatgttgatgattagttatgcagatgttttaatattgtgagaacatcgtcaaatattgttggtaccatcctaatcacaataatgtatttttaccaacacaaattcaagccacaacaatagtatgatacattcataatgaatatcttaacctttgtggaccatggttgctcaaaggaattgacacatgca

SEQ ID NO: 41137 - DNA, 1501 bp, Oryza sativa
agttgtatcatgaagacaaaatataaatgcatgtgctaatttcctgtaatccgaaacaaactcagaagaccgaaagtgtccaaggaaaaacagtatgcatttcaagtaacgaatatcttgcctagcagatccacatatgatgatatgcaaacaccatgttctatttaattatcgtaacatcaacctagaggactataattcccctaagtaaactgctccagattcctagacagtcaagaatgacagcacagtccaggggtccttgattagaaacacgaaaaacacttcagcttgaattaaaagagaaattgatataaccgcattgcagcatactagtggatgggaaatctggagaaacattgttcataatttcatatagacaggaacttaaaacacccccacaaccaagagtgcgaaagcaactaaaaatccacttgttcacataggtacatgaaaacaaattaagtatgcataagtttttctactataaaaatcagtgcttcatacattaagactcagtaggatcggggttgatatgcagcagttcattcaggaggaaataaccatgtcgaattcatcagtcttccatctggtgtctaaattttgtcctctgacatgtctgcagtaattggtgtcattgtaccatctttcatgttgtacacagatttatcaaaagagcggtcatgcataaaatagataagataatctttgactacatcataatgagataaacgaaaagacttgctgctgagttggctgataaagttgcagtcgccatccaagctcttgatctcagtgaatgtggcagggtttgtgctgcagtccacctcatatactctaatctcaataatgttgtgcccaaattcaccaaagtatgtcacaactatcagtagtttcccgcgccactctactatgctccaagtctcattagcggtacccatgaccccaggcagtttgatcacacaagactcaacacgagaaaccatcaagccattgtcatcttcacagatctcaaagactaagaggttagtggtgaatttgccgaaactgagcatgtggaggttcccttggcatggcagaagacaatatcaatggacctaatgatagtatcaccatcacacacgctccacgacttcatcccaggccgccagagagcaagcttaactgcatccttgaccatggaggtggcggccacaacacacttggagccagagtcaggcgacgaggacaagacgaccttccagaacaacatcacgcacttcgctgcgttgatcgtgcaatgcaagacaccagagccattgatgatggggagagacctagtgtaggcatcagcggagcgggaggctcccgaaggtagcgggagtcggataacatcccgggagaaactgttcatcaagaaacgccggcggtcaccgaagtagcgacctttgttggccttgacgccaacgagccatccctcgaacgagcccacgcagcagacgctgccaccagccgccatctc

SEQ ID NO: 41138 - DNA, 1501 bp, Oryza sativa
cccacctcctccatcctgctataaaccaaccccaagatttgtcaccctccggtaggtagtaccactccaatcccaatccaagcctgaatcctcttttgatgtgatggcagtggagcgcggcgagcgccgtggcggcggcattgggtgcctctcctgctgcttcggcggcggggacggggacggggaaggagaggagctggggcagcgcgcggcgagggcgctgcggacgtcgtcgcggtgggtgcgggaccgcgccgtggagctgccggagatggtggcgctggccggggggcggcggaggaagccgcatctgcagcatcatcagcagcagcagctggccggggagttccgctacgaccccgtcagctacgcgctcaacttcgaggaggacggcgacggcgaggcccagccgttcaagtacatggccttctccgcgcggctgccggcgtccccgccgccgccgccgccgccgacggcgctgcccgtcgaccggggttcttgaattgattgttaggccgttcggatgtacatacgtacgggagattaaagtttgggtttctttctcttttttttttgttgtttgattccttcgatttttgttggcgactacgagcgctgatatgtgtacaggaggatttgaatcgtttcttcttttggtttttttaagcagagatttccttttctattacaagttatcttggctctgaagaacgttgtttttttgttttagtgctagtatatgcttctgagaagaatgttgtttattggggtagcaaaatctcaagccattgccttgttctttgaaaatactaagttatccatgtgttatattgccagcacctggaccaatagattcggtagattcatatttaaaagagttttagtatctaacatatgttcacatgcttcagctgtcagaatcacacaacctactgcaactgaaactacagagtacagactacagtttgtatacagatttaaactacaggttgtatacagatttaaagaaggctttaaagaatcacagcatacggttagatgacaaacaaaccattagcacatgattaattaaatataattattaaaaaatatatgtttctttgattttaaaataaattttatataatatattaaaaaatacagtttaatggtttaaaaaacataatgtaaacgaaaaggttgcaaaacccagactctaacgaactcggctcatgtcatcccagctctaaagtaggcaaaagaagcccaacccacagctcactagcccagaagcaatcagaatagaagggtcactcaacattatttatgtttggaaaaagtatactttggctccctcaactatcgcccgagtacgactcatgtcctccaaccacaaaaccgggtatatcgattcctccaactattaaaactggtgcagacaatatccctcggtggttttcgaggtggtcctacatggcggtcttgaccaagtctttgtcctacgtggctcttacttggcatt

SEQ ID NO: 41139 - DNA, 1501 bp, Oryza sativa
aaattaaggacatcttactggtggagccggtctaagtcacaggaaacgcggaacgtgggtgcgttctacgttccgggaatttcgtctcgaaacgaggaacgggaacgaagcggaacttcgttccaaaaacggaaggatcgtcgacccaacacttggtacgtcaatggaggaacgagaagggtggtacgatggaggaacgaggtatgttgagcaaaagctagtggagagtggagactcacccggatctacattggtggagacagggcgagcagcgcagttgttccttcgctgctcgccgccgccgtcgaacatgggaggttggaccgttggagaaatagaagggcgctggcaagcggcgcgccgcgcgccgctgccgcagccgcgtttctccctccatcacgcagctaggttggagtggaccgttggagaaatagaggggcgccggccggccagcgagcggcggcgcggcgcgccacaaccgcttttctccacagatggcgccacggctgatgaagccatcgcgcagccgtcgtcgttgcatcgagcttgtggtattggagacttggactacaggagacggcggcggtggctgggggatagggaccactgacgaggagttgaggacgaacgaagtgctagggctcacttttacgttctcttgatgggcttgtttgcacgcatggcccaaaaattttctaggctggtctgctgtcacatgaatggcaaaaaaatctgctgtcacatgaatggcaaaaaaaaaaaaatggtctgctgtcacatgaatggcaaaaaaaaaagaaccagagggtcgaccacgcgacgtcgtcttcgcctatgaggcgccatgaccagtgtgctaacaactacaccttgagtgaaatgtgtatgttacttaaataacttaaatagaaacgtgtaaattattttttaacaatttttggttaaacctttagtttttttattttttatgatattataacaagttttacttaatattgttgtaaaataatactttttaagtaaacaaagaactatgttaataaagaaaatgataaaaaaatagtatttatggcaaatttttctcaaggtatgacagcaaaacgcccgttgttacttcttcaatatcaagatatatactagcccaatcttccggagatgctcataaaaataaggtgtgagtgttgtggtcaactacatttgtattgtgctttagaataaaaaaaaaaggtcatgtgtatatatccgtgaatatacccatttacttggaggataaggttggataggaatcatgggatagccttatccaacatctttatagaatatttttatgtgggcggccatattccacctttaccatgaaccaaacaccatacaaaatgtggcgaccatatcccatcacccaaatctcacgaactcatgcatatatcagcgaatgtgttttgtaacacgctcgagctggcaacaatcaatggcaaatctctagcctcactgtgtactccat

SEQ ID NO: 41140 - DNA, 356 bp, Oryza sativa
cttctgcttcttgggcttggcgctgttcttctgtctcgttgtcgcccatgaaaatgccgaagtagagaggtgtgtagttatcttcgtagccttcatcgaagtcgtcgaggttgcggtggtcgtagcggtagccgaagtcgtcgtactctacgatctctgtcggtcgagagtcgacaccgggggagctaaggtagccgtccaattgttccgtcgaaaccgtgccgagaggctggagtatgatgccgacttccctagagctagactggatcggggccgaggtcgggtcccgcctaggcctacggggagaagacgcccttatggtgaagatggcagccaagtcatcggggagtttcatc

SEQ ID NO: 41141 - DNA, 418 bp, Oryza sativa
tggtgggccccacccgtcagcaagggtggcggacgggcccgcccgtcagcggcgcgcgcgcgggtatagtccgagtggcccgcggggagaggagagagggggaggtagatgggccgaaccggcccaagagggggagggagggaaaggggacctttagggtttttttctttttataaaaccattttaactttgtttatttcttaataattattatttgtgctctgaaaattccactaaaatttatttacgcattttaggcttttaggaaatatacaaaattcctccaagccttatttgacttttaactttgcacattttaatttttggaggctttcacacagattttaattattctaggtataatttagaggatgcattttagagtcgttttgggacgtgacaatctgcacgttcacgg

SEQ ID NO: 41142 - DNA, 212 bp, Oryza sativa
tagaatcttttcttatatctgcaagccctacattggggtagagcccttccttgatctctaccgcttttactatgacttgcgtcggatggaacccaacagtgtatctggatgtgtcggattccgacttcgggattgcctgaagtcgcgttacatccccttccagtgcccctcttcttgcagcaaatggcgggcgagatggttctatcttcaga

SEQ ID NO: 41143 - DNA, 787 bp, Oryza sativa
acgagcatagatctttgaggcggtacatcttagaaagagaaaaaaaaaacaaagccttttgaggtagtacaagaacaagcgctctggtccaagagcaagcacggatacatatatgctcacgatatgtagcgccgtactgagccggttgcctcatgggagaaaagaaaacggggattaatgtgcagccgtagctgttacacttgcatgggagaccgggatctcgcttggtaatcgttaaactagctgttttgttgcgtgtagattttttacaggtgcatgcagatgcagactctgcagacacatgaaagtttaatttgaggctttggtttttgaaaacagagaattttgaggtgaaactgtaacgattatgaaaatgccacgaggtttctgggagcgcactacacatttgtagtcaagagcagtgatcaagatttcatattttattgaacgtctacgaatgtagtaacacacgcttgaactactggtgaatagatttatacttatacacccacagttatagcatcaaactctacggtaatcttgatatgtgtatatggacacttgaccttagatttggcctaatgtcaaagacacgttgagatgtgatgaacaagaaaaggactccgatatgttatacgtagaacatgggttacaaccagggctaccgtgtccatatatatgtatactgtacatggaacaaattaacgagttgagagacattggagtgactgagtggtatgatccgtcccctcaatcatcacatcaatcttgagcccttcaacgcagg

SEQ ID NO: 41144 - DNA, 243 bp, Oryza sativa
ctattttccgtccctcctctttgggctgacatatgtatacctaaaataagtctattttctgtccctcctcttcggctgacatatgtatagataaaaaagtctattttagatccctattctttcgttcatggcatataatatgtctatttttacttccctattttttttgtaccgggcctagctgccagcccatcgtgccgggccgagccaacgtgccggtggaggggcccaggcacggcccga

SEQ ID NO: 41145 - DNA, 274 bp, Oryza sativa
ttgtcaaggcgtcaggcgaggaggagccgagtgcaagcgccaagctgaagatgaagcctgtgccggatggtgagcaggaaggaggagaagaagacttgaggccggccagagtcattaggcctaatcgtaaatatgttgggccggaatgggccatgtaacctgtatcgctggcatgagctggcatctgtcttgtgagaggggaaggaagggagttggtagcgagagagagtataagaactgaggtttctaaattgtaagggacttttggcaatct

SEQ ID NO: 41146 - DNA, 1501 bp, Oryza sativa
tgacggcgatggcatttttgggacaaaatggctcgtacgatggcatttgctggaagtcgcgttcgtcgatggcatttcttggattagggtgtttgtcaatggcatttcatggattttctctaaaggtaaagtagtacgaagacttcttactactcattttgtatgaacattatggatgctctaagacactgacactggacttgccacgcagtgagcattttgatgaattgttgtacagcaaaatgtgcaatactgggcatttcgcaagtttttttttttttgtggttttggttggtttctttgtcacggatgggttgaagaatgttttctcagatgggcgtatatatatgggaaaatatatggcggaaacaaacctgacatagaacattgtagagctaaccctaaacaaagtttgaaagagttggaattgcaaagtattcttttaatttgaattcagttatgaaatacaattctgaacttaattaactattttcctaaaatctaaaaaaggtatattaggctataagaatttgaccttcttggtaacacatatcaaacggatcctatgtatctataaagttcatccccactaagtatagttaatgttaattctctctcttatggagccacatcaccttaattatttttagcttttggatcattcatcaaaagtgcaaattacatctcctctctacaaaagacatcccatacaacctaatcatttacaacctttgaataattgatcaagatataaaatatataagcacatgaaagaaaatcatatagtaaaaaagtaagaaacttttacaactcatatctttgatttttatcataattttctcgtaacaacgtgcgaggtaccatatactctctccgtccctaaatatttgacgccgttgacttttttaaacatatttgaccgttcgtcttattaaaaacttttgtgaaatatgtaaaactatatgtatacataaaagtatatttaacaatgaatcaaatgataagaaaagaattaatagtttttaataagacgaacggtcaaacatgtttaaaaaagtcaatggcatcaaatatttagggacggagggggtagttattatcgaaatgattccgatgatgcatgcccttcttaatttctatcaatgtcgttattatgtttgtccaccaccctctagtactcctgattgcaatggcagtccatgtaaccacacctcttattgatgttgttatatggttgccatacacatcagagtttcttatcatgctcctatgacattgatttatctatttaatgttttgtgggagcgccgtgaccttctggctgccgtatgggcattagtgtacgttgcaccgcaaatgtagtttgtgccactcatttcttacctcaatcccacttcatagggatccatatccacttagagcaagtctaatagtacagctcactactagctccaattcatctatatttaatctaatagccaattcatataataattgctta

SEQ ID NO: 41147 - DNA, 843 bp, Oryza sativa
aaccttacgaatggcaaagtatccaaataaatgatcaaaatgttgctttgagaatattgaacgacacagcatgacagtttaaaaactgtcatgctaataaacagaacaattcaaggtgaaagaggtacaagcaagagaaactgaccttagtccaccctctgtgctgttccaattctcaatcggaagatgtctgctatacgtaacagacaccataaaaggttgaaaagatcaacaaccttgatgtgcttacgttgaggtctgcaattgaaacttctcaacagttcatgggtcatgaattcctttgtccatggtgacaaaacaccaactctacatcagcatctcacctgaagaactcatagattttcttttgatcatatacattacatcactaatttcttttatcaagcctttgcagcagtcctttcacactagaattccatgtagtcattatgctagaagtatccgcataaaggtttgatggttataatctgacaaaatacaaactatctggtggcatccaagcagttattcaaccaaatatccttaaacatttgcaggtcatgaactcaataggtcaatcttcccttgcagacagatgcctaatgcctctgtagacatgtaagtatgcaacccccaggccccatcacatccaccagtaatcgctttgatcgattgtgaaacacagaggtgctgaatactcttcaaatgaatcaattcaataagcatatcttgcaaccaaggagatgaatagagtcacaaacaaaactctgcacaaacttatcagcggttatcatcattaaacagcaccttgtaaaaactcctcctctctctcctcttctcagc

SEQ ID NO: 41148 - DNA, 985 bp, Oryza sativa
taagtcctcgtatctcttttgtcatcaagatcaaggaaaaattaactcatcccctcatgtatcaaaaccaagaaaacaatatacatgcatacaacctataaacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaaaatcatctttagtcccggttcgaatgctgtcagggcctgtcaggcccccccgggatctaacaccaaccgggactaaagatcttaactttagtcccggttggtaataccaaccgggactaaagatcccggtgatctttagccccggttggtgctaccaaccgggactaaagtcacacccctacatatatgtcttcttcctcctccagctgcccgagcaagcttcaaaatttcttcaaaaaagaggggaggtcatgccaaaatttctattgaatttattttggtgattacatacaaatcggagctgcctaaaaggtttacaacttcatcctccaatgtttttttttgtcatactacatttgcacctatgttttgcacactttttttgtctccaaaatttagttgtaagttgatgagagagaaaatgtgtgtgggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttataactttacaaatagcttttaagaattatttggtgtaatattttatgatttttgtatgaataaagatatcttataattattgtatgactgtcattattgtaagaataattatttgtgtacggtttttttgactcatgtaga

SEQ ID NO: 41149 - DNA, 1501 bp, Oryza sativa
ttaattgaattattttccttgtcattttggttaagtaacttgtcatggtgttgacctttgctttgatacaaaaccatgaggaaaaaaagataaaattcttctactcgagcatacatttatatggtgtaacatatacttttctttttcatttgtaacatatatatacagttatgttcatttattcaactctccatgacgatacctatatgcatataattgaagtcttgcaggctgatgtaccataattacagctggtagacttctggcccaaagaaaattaaatagacaaaaactctctagaagcagttaatgatctgatccggcagcgtgtatgttggactagctaggaaattctatggaaattgctgtcattcagataactaaatattggactaattgtcatatgcatatatacaatgataaaaggtggaaaattgtaagattattatatatatattatttgtcaattgtcataaataaacttgtggtcaaattacaatagtaaaactactagtggtaaaaaaaaaactactactacaatagaaaatcaacaagtgttcatgatcatgataaataaatcattttcaagaaggaaacttgcaaatcccaaacgcatgcatgcaaggatggatgaatgtctattttaactgtctattcttgcatgttactgtcgaccaagcatgcttcggagagttatttttaacgagaagctagcgttgtcaataagctaatttaatcatgttaatttactcacttcatgaattctgtccaaatcaacgtgagaggaatggagggacaagatctccagaaatctttgcctggttgtggaaaaacgacagacagacatggatcaattaattatcgcgttgaccagcttaagcagatgcagtccaattgattaattatgctgcttaataatatttatttatttatggcaatgtctttcttgacactattacattggattaaggtgcatctgcatgatatggatatatccactatacttacttacttcacaggagtgtcacttactgaacttgcaagtaaagaaaccaactaccccaactaatcagagatagagttcagctaattaagcttctgtggttaaactctatagttttaccaggtcaattatggtttattatattatggccatacatggagaaatgtacctgttatctgtatcagtgacgatgtacgcacacagtacatgacccacggtttcttacatagttacatctaccttataatattaatatattgtatggtatattaattggttgacaaacaatttcgtaccttagtgaggattatgcaatcactttcaatttggctactctaaaatgttcaactcaacctgaataatatgccctcttttggttttaataatatgctagacacgattagaaatgtcatggtccataaagttgaacggtcatttattggaaaaagtacgaattaccccatgaacttttgcggtcgtccgaattaccccctcaaa

SEQ ID NO: 41150 - DNA, 524 bp, Oryza sativa
tcctgcagccctcttaaactacattcaaaattcaaggataaatatcaacatcagacaagtctactgatcagtcaattcttttgttacagttaagagaatgtgttgtaaaatgctgcctttctgctgcctccccagatcaactcacatagtgcgatagtctgattgattgcctctggagttggagtagaccggttgtggaaagataggaaagttttggatccattttacagtttaatcccttatgtccaaactaaccatgaaaaagattctttgaccatcaaaagggtctcttaggacaagttgtttgtttgatcactgattaccctggagcaggctttactaatggattggccaatgtgacctgtctcaactccagcttgatgtttccctcagatttttcctgctaatgcaagacatttgcaagttagttatcgagttattgcgtgatagctcagaagttacccactggacagttttacacctgcattgcacttccaaaataacgagtttatgctgtttctagg

SEQ ID NO: 41151 - DNA, 1501 bp, Oryza sativa
tgactatatatattgatattattcaactttcatatggtttaaacagttacatgctaaatctttggatattaatttgtcttcccaattactacataatcaattattagtaattatgacaggaatactcggtgaaactaattacctggccatttagtttcattgaaattagttaaattagataatgccccgcgttttgttgtgggatatatgttagataatggagaaatgatgaaatgatttggattgaaatattatgaaaatgatttgagaatgatgatttaccatatgtatgtttagttttagaatgaagtaaattatagatgtaattactatatgcttgcatgttgagctttgtattcttaatgggttgatgtggtatgcttgcatgtaggttttatgagtgctaataaatactatgcttccatattgagctttaggtgtttagtggaacataaggtttatagaacgaagagatatagattgtatcgatagccatggagccagctagctaagtaatttgatttctctatgttcatcctagtgaattcaaattatgtcatttggagctagctttcaagttaaggatgctgacctagttaaggcaatcctttaaaacttattgcttaattgtgatgtcattgggagaccaaaatatgtaatcttggtttacatgtgcatatatatagtaagcagtttaaaactcaattttagggttgatttcgaggtttttttttctattatagtttatttttcagtattgacttttacactgctaagaacatagatacataagttttccccactaattatttcttgttgtttaactccaatttcaaccgcttctcagcatagatgaattaatccaagcatttttttaaaaaaaacatccttcatatgccttatacctttttttggaatgttgcaattttttatgattttaggaaaaaaaatccatacttgagcaaaaacataaaatatatatactccttttctctgcatatcatcaatcaatcaatcgtcactctatctcagtggctgtcctgatagctgattgggccacatggcgcccttaagtttgcaaatagatccaaaggaaaaaaaatgctaagaggaaataaacacttggtaccagaaggggctagaagagggttaggagggtgaccaggttttataaaatcacgtggttattatgcagttatcgagattattacatgcgataaccttctcaatttttgaaaccacatggtatatctcacagtaaccgccgaactgtgaagggggggggtggtaatcccatcgaaagcggtttggtaaaaaccctagaggcgacatagataaattgatatagacaaactaaatactgcatcaatatttttgttttagaaagtgtgttgcatgatataacgttgtaatagaaaattaattagattataaaggaaaaggtacgaattacccccctcccaaacttttgcggtcatccgaattaccccccgaaccacaa

SEQ ID NO: 41152 - DNA, 1501 bp, Oryza sativa
acgggtacgagactgtcgttcggaggttgaagacgctggtgtagcgcgtgggtatagtttggcaacgagaggaggtagccgagtatgctagctgggtctgcggctccacttgttggctgaaccggagaggcagactgagcggaagtaagagttgttataccgctgagaaaacgtttttacttgttgcaacacactgacattttttctagttaaataaaacaagaaaaatacaattaccttggtatccaattattcatgctttaggtgcatggtattactctctccgatgagaaaatacatgacatatgggtttttcccccatggtctttgatgtgcgactttgctaacaattttatattaaagtaagcttacataatctaataaacttaacaggttgtaaaagtatatttcaaggaagatctacaatcaccatttttatgttttggttaaaattaatttactaacgaccaagtttcaaaatttaacctgatattaccaaagcatcgaatatttattaccggatggggtgcatataggagtattgatttctgcgttactttgctgtatgaactcctctatgtgtactaatgtctgactttatattttaaatgtgggctttaatgcttatcacaagaactggtggtatatgtgactcttgttttaattagaaccaccaaatagtactacttcacacgtgtttgatatgtcttcgtgaagttagtgggaaatccaaaaatcaaataattacctttatctgcaatatgctaggtcttagactcagtagaaatatgtttttgacaaagctccaattaagtctcacatgcgagtgctctttagacctaccgattggtgctgacattggtcgttattgcaaagttgtgaagatgataaggacaagatgaagcatgtcgaactttagagacaatggcgacacaaagttttgcgctctaaggtttaataataggctagacttatttgagcaggtttaatagcagagcttgtcgcctgcagtaaatttggccatgtcatctagagctttagtttataatacttcatgcagtagggagctgcactatatggtctgattatttgtcagtactttggatacaccaattagtttgccttctcttgaagttcacgtatagccagcgacaatataagcgttcattcacactctctttctagctcattgcttttgctagactcgatattttaccaccagtttaattattctattgtacctgctctattatattaccaaattttattcgtagccttatgtcccgcaaaaattgtaataattggtcgtgaaattctcaaaagttttgctcatagaattttcgtgaaacatgctaaattgcagtctaataaaactagacaacataacgggctttcacggcccagcccacgacatacccaccattggccatttgggcctggattgggcatctccgaatgacccactcacagtctcgctcgtcggagcagaagcagccaagaa

SEQ ID NO: 41153 - DNA, 1501 bp, Oryza sativa
atatgtttccatggtatttaataatatcggatatactaattttgttaaataatcaaccatctgcatactagagatatatttgaacatggttcaaattgatgaatctatctggtgttacttcaagttttcttgtagaaagagaaatttgatcaatcaattagggcacaaatcataatgaacagctagcataataagaaactgtagcaatacaccaatgcctgccatatggcaattggcaagaatagttagtggatggcatgtttgacttcaactgttgtcaactactctagactcatgttaatttctatcattcaatttgatagagaagagatggctattgatgaagctgagcttgaccctatagagtttgctgaaaaaatacatgctcagcataaattacaggaacaggtaaggcaaattcttattacgaagattttcaggaaaaagaaatgtctgtcatgtttgtttcagggagctaatgtcatggtggattactattacagcaactgaagatgttgattcagatgagaaaatataacccagagagccaatccgtcatactcgaaactgtatgtgctcttactactctccctagccgttttccatccctcaccgaaacatatctcagttggacaaatttatgaatttcgtccaagttcattatcagaagcaatttatgcttatttgtatctaatcatcgatgcagttgcgcaaacagttggagagtgctaatttcgataccgacgcgtcgatcttgactccggagcagatccaagagattgttgagaactagatcaaaaaaccatatcaacagctattgtgcatatgttctgtttaaatctgattgctgtacatttctattgctcatacaagatataccagcttaattaagtgttactcagctctcgccatggtttatggcatccattgtgttatcgtgttaacttttgtccacgtatagtactttctatacataattcaagattttataccccccaaaaaagatcaatcactgaaacaccactaagcgcatacttgtcttctgatcccattgacaagatcatggctactaacaagataaagctccaggaaggcacatgtgcttactgctagctcattgtgtgtattttcataacattttactgtatctaagattgacattatgatccacattacagtaaaattataacgagagttttttctttcatcacctagatgagcatgcaggtgcaggtaggcccaaagtgtgaccagcaacaacatgcattttttcccctcgaatctcttttaatttttgtttctttttatggtttaacatcgttgcaagaagcatcaaatcgacacacaacgaacctagaaacagcataaactcgttattttggaagtgcaatgcaggtgtaaaactgtccagtgggtaacttctgagctatcacgcaataactcgataactaacttgcaaatgtcttgcattagcaggaaaaatctgagggaaacatcaagc

SEQ ID NO: 41154 - DNA, 1501 bp, Oryza sativa
gacaacaaaaatatagtgtaatataactacattttaacaacactttatataccttgttgctgcaaattgttgagccctgatagtagtacataccctctctgtttcaaaataaactaatctagtatgggatgtaacacatcctaatactatgaattgtctttgaaaaacctcctatccagattcatagtattataacatgttacacccatagtactataatatgtcacatccagtactaaatttgtttattttgggatataatgagtattttaagtgttagatgggtataataatttagcattttaataaccaataacatcaacagtattctatgtactacatcaaatgcacatgaagcaaatagttaaggaagcgggaggaactaggaagccaagagtagttagggagaggggggaagccaagagcagcgagggagagcaccagagcaacggagggcccaagaaatgagcattgaggaagagaagagcatagaaataagaacagaaaggagtagctcagcagatgatgaagggggagaggagatagtactcgttgaggggagagtctccaccatcgaaagagatgggtacgtcgttgccagatgcaaagagcgctactgtcagatgtgaaggggagggagcaaagtcaccaaatgtcatattgctttgctagatgcccctctctatgtttcctatagtgcatgggctcgttttcacttaaacttcttttcacgaaagctaattttttcactagcgatatagagcgcgagactcccaggtgtcgcctcaagctgtcttaccttggtgcgatgccttagagcctcagagataacttggagtatatcctaaagcgacactttacagtctcaaggacatcaagtcgacaccttaggaacgccttaacctccatactgcctcctacccaactagatttgctggcttcctctaggagatgaaggattttatcaatttgaacacaaattaaatggatttatatggacgttttacaaaattacagtaaaatccatcagttataaatggatgcctaatattcatgatctatctaaattcataaaatcatattacttgttgtttaaaatctgatactatggttgtgtttagttcgtgtgccaatttttttttaagtatacggtcatacacttgaagtattaaacgtagactaataacaaaacaaattacagattctgcatgtaaactccgagacaaattcattaagcctaattaatctgtcattagcaaatatttattgtagcatcacattgtcaaatcatagcgtaattaagctcaaaagattcgtctcgcaatttatatgtaaactgtgtaattggtttttttcatccacatttaatgttctatgcatatatccaaacatttgatgtgacggagtcggaaaagttggaactttaacgaaaatttttttaatctaaacacgccctatatacgtatttttttgggaagagggcgacgcagagaggaggatt

SEQ ID NO: 41155 - DNA, 1102 bp, Oryza sativa
gtctccttctcatgggtggtgtatagcttttggcattatcaactgttcaactccctgtcagtcaagtttgtcacctttttcttttgtgttgtgattattgattacttcttatatttgttatctatgcaaacgctttgcacaaacataaagctgtcgcagttggcagaatttgtgttgcttctgtgccattgaaagtttcaatcaattggcatcactgactgctacactgcagctgtgcctgttcttttccatctagatctagaatcggatgtaacatatcctaatattataaatcggtactgtgttggttttttatgggacgaagggagtacacttcttctagctactaaatgctatatttttcttaaaaaactttctacatatatatttcttaaagttattattttaaatctattttttaactttataatagttaatttatccgtttgtacctctcgaatcattcatctattaagtattccattcaggtcaaaagaagacacccaattgaagtaaaacatgctagctgtatgatactttataatatatgattagtgtattttgcttgcacttggatgaaggggctattttaatattagaaaagattttgactaatggtgatgcctcgcttcgggatctgctcaaaatatgtttcttcttttctaaaaattgtttttgggtacagatggaccgtgtaaacagatcattgttcaaagccaactaggaaagtaaaataaaaattatttacatgttaaatgttaatgactagttattgactgctgatgaatgtgtttaacatgtgaattatatattatgaaaatatttctaataataaatctaaaagtataaattttatgatgttaaactatataagtttatagaaatctatggtcaaagattaaaatgttacttaaaataaaaacaatcctaggacgataaataatttgaaattgagggagtaccgtgtttgtactctagcagtctgactctaaataattgaacaatcatgaaaacttggccagagaacacaatccaataagtaaggcccccaagcttaaagttattccaaataatgtatttgactgatcattctgcaagcagt

SEQ ID NO: 41156 - DNA, 1501 bp, Oryza sativa; identical to SEQ ID NO: 23421

SEQ ID NO: 41157 - DNA, 1501 bp, Oryza sativa
agtaccaccttggaagtttaggtgggtgagggcctgcttataagccttggtgctccaaccatggtatccccgggttatcctttttacacgaggcgaggacgaaagtgtaagcgggataccatgcgaacgtgggtccgctcaacgtgtagagcggactaatgcggattttggaggcaaggtgttacaccaagtttactgctagaagtcaagagatgaagttttgcatgttttgaatttgaatttgaatttggacctcataacaacatcaacttcaaatgaatctggccgctgatctagaagggcttttgggcccatgagtactagttggaaaggtaatggattctattttaagatgatactagttccacataaaaactcattcttagcagtcagagatcacaagtcacgtatatcttttagttcgagtctgatttggatcttgagccttgttattgtgccgtgtactaagcccaaggaggtgagcgccctaggcctaaccctaggatgttactacccatatttattcagtagtcatcatcgtttagagctgaactttgcttagattatttctgtcattgtagtttcgccgctagctagatcgttttgtggaacccccaactttgagttcttaataatttatctacaattgtcttctaatctttcttgttcttgtttgtattcttcgatgggcatggaggggttagccttctcggcgaggtcaatcgagttttggcatggttgagaaccagaggaaacatgttactgtggttgcagagtttggatcgtgttgattgaaagctggaccgtgtgtctcaggtgtccgccaaattaatagttatcttcacctgacggacgatcgtgcacccccattgccatcaaactgtggctagaaaaagggactatcactagctgaaccaaaacataaagaaagtgtggcacgtagaagttgtaagaacaaaccaaacattagcaacatttggttagactcatctacttcatcccataacataaggaattatgtttatcctataatataagagattttatgatcccaagatcatactttatgtctcatatataaactcttgtactatttatagcataatcccttatattataagatggagtatctcaagtgtggtaaaacgtggcaccaaccaaacaagctcgaaatacatcatgtgattttaaggaacgcctaaacaattaattgctgtaggacagagctagtaacatgccatatcaaacatggattaattaattaaatcagtttactagaagtgggtaggcattgaacaaactaatttaactagtcagttaattatcaaggaagacgcatatgcatggagaggcaacttgcacaaaacttccatgctaatctctccataaatacagcccccattcggccattccaaagcactcacaaacaccactcagcaaccaaatcttgcttaactagctaatttcctttcagccatggcgaggctaattgcatcatcgt

SEQ ID NO: 41158 - DNA, 182 bp, Oryza sativa
cctgcagccctaaatcctaattaaccattcattctccctctttcatttagtcctaaccctacatttattttcaattccaatcccacctctcatttccaattatccaaacatagcctacattctcaaaaacattttttcatgcataatacctcagcacaagcaagccacgccgtactacttca

SEQ ID NO: 41159 - DNA, 265 bp, Oryza sativa
aaacagttaggctaatatcaatcttatggagaatttgtatcatagtccagcacgactccgagttcatcatagaggtcaacgattatcccatgcaccgtaaattaataatgagtgcaggagattttttttttcgcagctctaaattgtaattagatccaatggatccccctgcaaaggaaaattttcagtttcatcgagtattgtcttcaataattgacatttcattaacatgagtggattacctgttcctgatcttggttccagt

SEQ ID NO: 41160 - DNA, 1501 bp, Oryza sativa
ccggctgcgcgctgcccgcgcccggagccggtgcagctcccgcctccggatggggagaggcgacgccggccgccgctcctgccgttgcggcctcacgggcggtcgcgccggccgcctctttccccttctctggcgtcggccgcctcctctctcccctctcctgcttcttcccagcgcgccgccgtcggccgccatttgctcgcctgcgcatgcgaaccgagaagttgagaagagcagagaaaaagaaaagaaaaaagagatgtggggccacatcattttctctcactgacgtatgggcccccacatatttattttattatttttactgacaaggataccacgtcatcaaaaccagccatctatactgccttaggacccaaattagacggttttgtatagtttaagggtaaagatttctggttttatggttaaaggaccttaaaaaatctcgctgttaaattgagggacctctagtgaacttatttcgagtggtttcgattatgagatccaaaagtttatttgaatttattggaattttgttttgggattacttttggaggttttctttcccgtcgtttttgttatctggctccattttaaagatcattgaaaagataaatgaaatatccacataaaattatttttggaaacatatgaaagtactccttttttcaaaatataagtcgctttgatttttttaagtcaatttttttagaaagtttgacaaaatttatagaaaaatatagcaacaactgtagcaccaaattattttcattatatctaacattgaacatattttgataatttatttgttttgtgttgaaaatattgttatatttttctacaaacttaatcaaatctaaaaaagtttgatttataaaaaagttaaaacgggaaacataggtagttatcttttattaactattctaaaaattcagtaaatattatttctaactatattttaaagcattgttggtaaatccctttcaaaaaagaagggaatttaaatagaatttattccacagctgccaaattcatcctcttcagtactcccagtttgaacctttctcatggagataaacccgaataaattcacttgtgcacgacatcaaaacttgtctctgaatacgacaagagaaaaatacaaaaaaaaaaatcagatgctatgccatcacgaaatatgccgttcacgactcacctggccgccccgtgaccccgacctcctctcacagctacgccatgaacgccttacccgcatgagatcccctcactgacatgtgggacccacaacgatcactggccctacctgctgatacacgtgttagcgagctcgctcacacaccagtgagaaaaaggactagtactagtaacaattattctctgctttccgcgattccctccaaacacgtcactgacatgccggtcccacataaaaaaattagttaatcagaatcgcgcgattaattaggaggcactaatcgagccgccctactgctactct

SEQ ID NO: 41161 - DNA, 1501 bp, Oryza sativa
ggtcttggtaattgtaagttgaagatagtgtttcttttatggtgcagacacagatgaggatatgagcttcaggcgtcctaaaaggcacagagctaattttagaccaccaagggaaccaagaacaccaagaagtgatgatgacggtgatggtgccacgcctagttcacctggaagatctcagcgtggaatgtattctggaggggatgtacctatgactgaccagactgatgatgatccatatgaggtattgatgtttgaactaaaattaccttaagttcctttagattttccaattggtcgccgtcctatttgctgagcatattttatatgcaggatgaatttgatgaagaagatgagatgaacatgtaccgtgtacaaggaactcttagagagtgggtcacaagagatgaagtccgccgctttatcgcaaagaagttcaaagaattccttctaacatatgtaaacccaaagaatgaacaaggagagtttgagtatgttcgactaatcaatgagatggttctaggtatgattctcttttcctttttgcatgaaaaaaggccacatttgttggcattgtaagaaatgcttgcttacctaatgtttcctctcctctttgcagctaacaaatgcagcttagagatagattacaagcaatttatttatatacatccaaacattgctatatggttggctgatgcacctcaatcggtgctagaagttatggaggaagttgccaaaaatgttgtttttgatctccataagaactataggaacattcatcaaaaaatctatgtccgaataaccaatcttcctgtctacgaccaaatacgcaatatcaggtcagtacatgctttctttagtatggtatttagaagtcaaattgattgattgtctgtgcttatatgctacttgccaaatttcaggcaaatccatctgaacacaatgattcgaattggtggtgttgttactcggagatcaggtgtttttcctcagctacaacaggtcaagtttgactgcagcaaatgtgggactgtcctgggccccttcttccagaactcttacactgaagtcaaggttggatcctgccctgagtgccaatccaaagggccattcaccatcaatgttgagcaagtaagttgcctgggacgatggtagttctgatacatttgggctttcttctctgtcttaatgcatgaacatgtttttggttctaatattcaaactgttctcttttaataacagttgatttatttgtctcacagaccatatataggaactaccagaaactcactcttcaggaaagcccaggaattgttcctgctggcaggcttccaagatacaaggaagtgatacttctgaatgatttgattgactgtgctcgaccaggagaggaaattgtaagtcttctgcatgtaccttttttatttctacatcttattgtagaaagcatgttctaattgactatctgcccatgttcaggaggtcactgggatatacacca

SEQ ID NO: 41162 - DNA, 1501 bp, Oryza sativa
gggcggactcgtcgaggcggccaaagggtgaggggttatttagcactccagcccctcaaaaactttaatattataatttgttaagaggagaggctctccctggctccctgctgtcctggccgctcggtttgtccaagagccggcggccgttggatccaatcgagtggatcagtctctactctctagtctcaagtaatttgccctccggctccaacaagaggtcagagcaatcagcaagcatgtatttatgttctgcctctccagccaacaaggggcggttgcaaaataggagttgacacctcctccctcctactagtggttctcccaacgtttcaaaataagtacaattttgacactgtttatatccaatgtttgatcgttcgtcttattttaaaaaaaatatgattagtatttttattgttattacataataaaacatgaataatattttatgtgtgactatttttttaatttttttataaatttttcaaataatacgaacggtcaaaacgctaaacgcggatatctatagctgcacttttttttgggatggaggtagtagtatatatctggaattctggatccttggacagtcctaccgaccacattcaggccttgttcaggtaataataaggccatgtttagttttaggggtcacatcgaatatacggatatatatatttaaagtattaaacgtagactaataataaaataaattatagatttcgtctgtaagctgcgagataaatttattaagcctaattaatttgtcattagcaaatgtttgctgtagcatcacattgtcaaattatagagcaattaggcctaaaagattcgtctcgcaatttacatgcaatctatgtccaaaacattcgatgtgacacgatgaaaagtttttgcatggaaaacatggcctaataccttttacctttagcatgaagattgaggttatgtttgtttggacatgatggttggggacttctttccctcgaaaaaaaatgggatagctcgtcaacacatgattaattaaatattaatttaaaagaagtttaaagaatacatgttaatatgatgttttaaagcaatatttttgtagcaattcttttcttaaaaaaaagcatgtcgtttagtaatttgtgaagcgtacagacaaaaaaaaaagggtaataggagttgaggtcagagtaaagaacattttgagataataaagatatggaattaatcgtcctcaatttctttctttccgttgggaatcaacccaataagttctcaaatgaaaacatggtagtccgtcgtccagccatgagtgttcagaatgtgatttcgaccattactgtttgttgctactccatccgtttcacaatgtaagtcattttagcatttttcatattcatattgatgtaaatgtatctagacatatatatatatatatatatatatatatatatatatatatatatatatatatatctatttagattcattaacatcaatataaata

SEQ ID NO: 41163 - DNA, 1501 bp, Oryza sativa
tgaatggtgggggatgtagcctcttgccgcgcgacgctggttgatagtttcgcgaagatcgacgggacgcctgcgatgtggggagtggggatgttcggctcgatgctccctgcgtcggtcaggaggcgagtggacagatcgttcaccgtgatccctgctcctgtgattggatcctgcgccgacgacactgacgcttggttggtgatagtcttgagatcgaagaggcggaactcggctgccagtcggcgtatggacgcttgcggggttgaccgggaccgaagcggcgatcatggtcttagtctggttcaagatgttgacgacgtgattggcctgattgagtgcgtcttccttgagaagggtgtcgagaagggtgatcgctgcaaccgcgttctgctggggggtgcgaaaaaccgccgtcccctcgacgtcttgttggccgatgagttctcgtgctcgtcgcccggcctccaaggcgcgctgtcgccggtcctcggcctcctttgcagcccgttcgcgctcctgttgctcacgctacagtcgttctcgctcttgtgtttgacgctcctcctccagtcggcgacgttcagcttcttgtcgcacgcgctattcttctgcttctcaggcttggcgttgttcttccgtctcgttgtcggccatgaaaatgccgaagtagagaggcatgtagttatctttgtagccttcgtcgaagtcgtcgaggttgcggtagtcgtagcggtagccgaagtcgtcgtactctacgatctttgtcggtcgggagtcgacaccgggggagctgaggtagccgtccaattgttccgtcgaaaccgtgccgagaggctggagtatgacgccgacttccctggagctagactggatcggggccgaggccagatcccgcctaggcctcggggagaggacgcccttgtggtgaagacggcagccaagtcatcggggagtttcattaggattaagggataagctctattgtcttgatcgggtcgtgttggagtagattggatctcgtccgagtggtttggagctaactcggttgagatgatcgcggagtagatctcggccgagttcgggataccgaacggggcggaaacctggcctcttcccgactggttcgaatccgagtcgaggagagaaatcttgccgaagttgttggtgatgaagtcgaggctgccgaaccggaacgcctgcccgggagggaagacaaagttgtcgatgccggagacgaaacccatcgcactaatcaatgaagaacttgacgctacccctacttggcgcgccaactgttgaaacaagatttcggcaatactaaaagggggtggctatcaagctagaaaagtggatgggttgagagacaaggaattttatacaggttcaggccttgttaacaagaagtaataccctactcctgtccggggattgatccgccgagtatgttattgatcgtatgatctgggagaaaatcgtgccccaagaggcacccggaccc

SEQ ID NO: 41164 - DNA, 1501 bp, Oryza sativa
catgcgcaatatgcaaagagctaattggctctaaattacaaattaattaattagctccagatctagctactatcagatcactctcggatatactccctccgtattttaatgtataacgccgttgacttttcaaccaacgtttgactattcgttttattcaaaatttttatgtaaataccaaaatatttatgtcatgcttaaaaaatatttgatgacgaatcaagccacaataaaataaatgataattacataaattttttgaataagacgaatggtcaaacgttgaaaaaaagtcaacggcgtcatatatttaaatatagaggtagtaattaatttgatcgaccgtaccgtaggtacgtactttgaattcgtcatgcaaatggagctgatcaacagaccaagggatcattgcattccccaagctagctgccggctgatcgatctggccgaacactgacctaaaaagagaagagagggcaggcccgtagatggacagggccctcatatatattttagttttcaattccaacggaatgtgtgttttggtatgtttgatgacattcttatcattttgtttacttccgctactactactccttcactaaatctcgctaaacaaacatgtttttcttcatctatgctttctatataagtgagaccacaaacagacaccacgtttagccacgtcatcaaaaatagtttcaaccgttagattgataattctttcgagtattagccgttagataaaagtcccctctacttcctcaccaattaaacaacgccattaatcaccaccccatctaaatgctatctaattaatcaggtagtcaattggacaataatacaatcaagatatcatatcatatttactattccaaccatcattcaatcaattggatccatgccactacaaatatgccaaattaaaaaaatatcactattattcacgtgccactgcaattttaggaaattggatccatgccactccgtcgcattttccatttgacgccgtctctctgcgtcctccgcccatggtgtgccactgatgtggctgaggtgctctggcgtggccaccgatggcggcagcagcggtgcagccgaccgtgcgaagctccacaggtcgtcgtcgccgccgatggcaccgccgagcagcctcgtggcagtggcggagtagtaagcgaggccgtcggctgctgaggcatcggtggcggcggcggcggcgtcgaagcagacctggtcgtcaagagcgtcggggtagccgttgaggtgtgcgacgcgacgaggcggtccatcatggcccagtccgtgtggtggtggtagtggagcagcaggtggtcggcggcggtggtcgacgaggccgcatcgcagccgtgcttggagtagacgagagcgttgtggccgccgacgggctctcgagtggcggcagtttcatcaagccgtggccgtcgagcacgatgtcgattggccggagataccttgacgccggcctgctgctgccgcc

SEQ ID NO: 41165 - DNA, 496 bp, Oryza sativa
agggttcatctccctagcttgattctcatttggacattggattttgggttgtgctgaactggagttggcaagagaatgtttcggcgagaagcactgtgatttttctctagtataaaaatcgtaccattatgtacccatccaactttttttttaagaaagattcgttcaacttttgtgatgtttaagcacttttttttttgctctttctcgtcaactgaatattgaggaatttccaggtctctttcatgctatcccaataatgaatcattaattcctccatggggcatacgttcctcggccactttgtgccattaatgtgcatgccccctccatgtcattatcattgcttgaatcatagtaacattattactgttctagtttactctcgctgacacaactgcttcgctctagaatcgcgatgatgctaggtatgctaggttgatttgatctgtcgtctctgcactttactgtcgctcacttgcttgcttttaattgg

SEQ ID NO: 41166 - DNA, 1501 bp, Oryza sativa
gtctgagggtgttacaagagtagttgaccaaattaccaaatgtcgtacgatggccatgaaaaagaactgccgcggacgatttttttttctaaaaaaaaagcagacgattttttccctgttcttgaacctactgcggcatttcttctcaaacgatacaacagctagcaaaataatttggttagttagaaatagaccaataatccaatactaaacgcatatacaaagagtttaattacacgtcctaatcatgaaccaggaacaagtgaggaggcactaagaaataggatcttgcttccgcaatacgaagcatcttaaattgttaatagtgagctactacatctgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcaaatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagacgggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagaggaggactttttttccctttgggaaggcggaggggaaagggagttaatcctttgtaacttgtccatacacaaatccacaaaaacacaggagtagggtattacgcttcacagcggcccgaacctgtatacgtcgccgtgtctcgtgtgtcttgcgggcgggtgatccttccacatacagagagagagagagagcttgggattgcaccctaagcccctggtcgaaccggcaaaggggggcttgcgcagtctcccggtgaggggccacgagctccgtcatctggcgcgccaggtagggggctcagcgtgtgttttctgagctctcagactcttccgtgtgcgccaagtttttcttgttcagcctaa

SEQ ID NO: 41167 - DNA, 994 bp, Oryza sativa
taagtgacttttaaatgccgtttactgcaaaacttaacccctatattattatctccttgtacccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgatgcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagcgaaggaagcagtgaagccagctgtgaagcaggagtgaaggtcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcttgtctctagttctgatctattctctccttgtatgcttcccctctcaacctctaccttgtgacagatggataatcctggtaaccaaggctatgggaa

SEQ ID NO: 41168 - DNA, 1501 bp, Oryza sativa
tgagcacacgctcctccgtcgacagtggcaatggtggcccctggttcttggaaacctaggtcatcatcaccatcatcgatgtcaacggcgggggccttctgtctggcctcacttcgccgtttaccggagggaactgccgcagacttgccctcacggcgttcctgcctcctgtcctcctcccacttcctcgttcgctcagccaagtttttgactgcgcgacagtccgcgagatcgtggagggaggtgttgtggacggagcaccacctgctggctgggcgctccctgctggaagtaccagcctctctctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaagcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacccgggcgtggataggtgccttgaaagttcatggtgaactgctggcacagatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcgccgtagacgaggaggcgacgctccccatctcgccgtt

SEQ ID NO: 41169 - DNA, 1501 bp, Oryza sativa
ttaggcctttaaggcggtaatctagactttatctgagaaagtcttttcttttaatataacctttttgggatttacttcgcaaataggatttccaggaaatactttattaataattgttatttgaaaaataactgccaaatgacgtaatccttttaaaggaaaggattcttaggaaataatcaatattacattttattggtaaaataattccttagggagttaaccttcaagaagggttttctccaaatagaaactatttggcaaaacaaggacaacccatgggttttaatccatagaaaaggatttgtgagaaggctgttagtatttgcaaatattttcttaattaacatatttcataatcatggttctttcaacaaataatattttgaaatctaaaatacaagcatattctcagacacccatcctttgttccaagcacaggaggaaaacaacaaattccagcataaatgaattttggaaaagattatttttattattctgaatttcgtttttgtattttagagtcaaaattttcggggtgttacaacgcgacggccaggcggcggtgcggggcgttggaccaattcttgctatatcgtggaagcaccccgaatcgagatggcggtggggcttgcggtggcagcgatggtcctgctccaccaatcggcatggtcggcattgccacaccatgtgtcgccccctggagcaaagccaacaccgacggctgtgagaaagaggacggtggcggcggtcgaggtgggcgagaaaagctgcgcgggaacatttcgccggacgtgcgcgagagagcggcgagggaagggtttgggaatgaaaccgagtggctagaagtggggaacgaataatccgaataagggaactcgatctattgggagcgctagtagggaatcgattggatacggtttttgaccaaaaatcccaaaattacagcatatggaatgaaatacagaagctcttactgctagagcattgtttcctcctttcgcgcttacatatctcggcatcggcgatgccgccgtggtggtcgtgctgcagtgctggagcagggcgaggagtggatggggttacttgtggtcaaagcgaggtatggctcaagcaaaaccttatcctactgagtcctccgccactgaacgcaacattacgaattacttttctaaacaacaaaactggatattctacagcccgaacatttcaatcctgacaaataaccacctaagcactgttttgagcggttttgatccgagccagcacatgtggcaatccaatcgaaaaaaaactaactaggcccacatgtcatccaccatgccactttctttgttttctcccattctttggtccatggcggcagcgaaggacctagcctatccgagcgacacaggcaagagtggcaacgccggctaccccatcattgtggcatcacacgcagtggatctggaggagttggtctcagagaagctagttggggctggtgacccagccggtg

SEQ ID NO: 41170 - DNA, 1501 bp, Oryza sativa
agatgaaaggtttagaaaagtaaaaaatcttgctaatctttccattatgattgttgaaacaaaattgcacaatagacatgagattgtttacaagcttctcaaattggttctggtacttccagtagcaacagctagtgttgaaagaatattttctgccatgaattatgtgaagaataaattgagaaacaggatgggggatcaatacttgaatgattgcttggtcacatttattgagcgtgagatgtttttgaaagtcaaggagtgtgatattataaaccgctttcaagccatgaaggaacgcagaattaaagctactcttccaagccacgaaggaaccgaaatagaaaattagaggtaccatgtaataatttgtaattttatttcttagattatcggtattgacatactgtgaaccattgattttttttactatgaatttttttgtagacgggaatacccaactttcaaatcctggctccgccactgaggaataaataaaaaatatatagagaaagtgggaaacatcacttctccatgcatgggccctcttattattttttttttgagggcactcttagtcttatcttcatcatatagtagtgtgactagtgtcattgaattcaacacaagtaagaccagagtagacgtaagcaggcttagcaacaacacataaggcatggtccacaggccccatcgcgttgtattttgcaaagaaaaacaaaaagacaaaaaaacacacagaggaatattttttatatacgtaaatgacatattctctacttctcaaattgatcatcatagaacaaaatccaaaatttcttaaattgatcattatataactgcatgatataactgtatggacacaaattttatcggaatacgattaatataacatgagagaatgtgtgcatgctagggcgtaattggcatattgttttaattgatgtatacattgtggaagaatgtgtgcatgttgtcttgattgatgcgatttaaattattattggtcttggtgtataaatatatatgatgatcaatttagaatggcggaagtatttactttgaaacttataaggtatttttttcgcagtacacacgctatttaaaagtagtatataaaaatcaacttaaaagaggagacatatgagattcagagaggtagcaattacattgaaaaaagtggctgaaatcaaatagtatatgatgtcgtatttttttagcaaaaccgttttcttattttacatgtaaccttttgttttgtttccccctaaatttcccttattttatccacgatcccttaaaactagatcgtcactccagttccttgtgatatttgtacctttttttttacaaatattctttcaaaaaatggagaactatcagatgagaaatgataaagttgatcttttccgttgcttacattttgtgtttgagaagtaagcttactgatgacggtgacactaaacagccatgtcttctgtttgcaaacttatgccagaac

SEQ ID NO: 41171 - DNA, 733 bp, Oryza sativa
aatttttcttgtacgtattttagtgttgcccaatttctttccgaatttaaattaattcattattcctttagcgaatgatttttaattcgggatgaatttatcaggacgtgacaaatccaccccccttacaagaatctcgtccccgagattcgaggaggctagcaagaagataggttgggcggtcttctcttcttgtctgacttcttccgctctgtcttctataacaaacttgtctaactaaacttctccactctggactgcttggctcgatctcctgttgcagatggaatcttctcttcacccgacttgtccctggttgcacctttaactgactcagactaggctgcggtggttgaggatggggcttcagttctagaacttcttatcattcatatctttggcgtcaacctcatacaagttaccaccttcgtgacatgcgtcgacatcagctttgtcattactaggataccatgtttgtcatcataagaatatcatgcttgtcatttacttctaacttgccaccaactgcctcatattagctttcctggtctccgggtgatagctacttctgctatttgatgcaagggtcgataactttgcctttgaattatgcttcaccagagaaccaacttatcccacttgacatactttgacgtcttcccaaatggctttactgctggatttgttattgtctaatcattatcctgccaaatctgaggcttcgttgttagat

SEQ ID NO: 41172 - DNA, 1174 bp, Oryza sativa
ttattaatcaaggccggtggacccacacggaacctgcctttagcccaaggcttacgataattcaagaccgacttggcaaaccggacgtgggtccaagctcgtcccaagccaaaccagggcaaaccttttcacattttagttgttaggcaaattttaagaattaaccccttaacttgggtacattgctaggattgcccatatcagagggcacggctattcgaatagatttactctgatcagaggtgtacatctttacccacaagacacatctttactccgcattccatggccttggaacccgtcataaacatgtgacataacccttcacccatcctagccgtgaacaaaagtaccgacccaaccctgcctacagccggtatcccgggacaggcaggccaggattgagccattagcaataggatatagaccgggtgcgccacacgcataggggtgagaccacccgcatactagtcaagtgccatggcatctcgactaacgggcatcgacccgtgtagtcttcatttgcctagacatctcgattaccgagtcatagctcgtgtagccttcatttgcctcagagatatccatcgtcgcaacgacttcatccatctctatccgtgtccttttgtttaggactagactgagcaccgagttaagccttacccattagacatgtggttagtacggtagtgctttgtaacagaggcccgaagaccggtccttatagtggccgaggtgttactggcaaaaccctgcacctcgagcccagcctaaaactattttgggagttttgaatagagggggaaggtgtgtgttcaattccaacataagccagccattccacagtgtccaaatgatatgagcattcccaaagtctaaagttataaaaccacctaatgttgcctaattaatcagcgaagcatctacctaaattcatactagtggaaccgttaatagagtacccactagttggggttttgtttatcctagggtgaacaaggtaataataaacaatagcaatgataaagctataacaaggattaataggaagtgctaaataaaatagtgataacgcaggaatttaaataaagcggtaatgcaataatttaaatcaaaataatttttaaactgggattcaatatgcttaagggtgatgtgacttgccttgctcaga

SEQ ID NO: 41173 - DNA, 1501 bp, Oryza sativa
tttccccctatttttccctctctctctccctcggattcgttcggatttcctcccgcaaacttcgccggcgccatcaatggcggccggatcttccgcgccggtttctttctcctccggccgccctctctcactcccaccgctatttaaacgctccccgtgcctccctcctccgtttccgaccctcgccgcactctctctccgtcggattcgagcccgcgccgtcgtcctctctctccgccgtcgccgccgagctccggttcaccgccgtcgtcgccccggaccacctcccgcttcggcatcgcttgcttcggcatcgctgtgtccttgccgatctcgtccactcctctgtttcgcccgccgaccgccggagcaccgtcgtcctcgtcgacccgagccgcgccgccgcctctctccacttcggtcgccgtttccgtcgtcgccgtcgacccggggtgagccgaggaccgttgtttcacttcccccttccctcccctctctcggccgccgctccgtcgcgccggaggtcgccgccggtgaccatcggggcgcgggcgcgccgcctcccgtcggccgtgccggcgaggccgccttcgggcgcgccccgcggctgctaggtggggcccggccgtcagccgcccgcgccctcggtgcggctgacacgtgggacccacggcgccggtcggcgtcagccgcgtgcgcccggtccaccgtggaccgtgaggctgccgcgtgggccccggtccgcgtgtcccctcccctcggctgacgcaataaatccaattttaaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcacccttggataaataaaaccccaactagtgggtactctattcatggttccactagtatgaatttaggtagatgcttcgctgattaattaggcaacattaggtggttttataactttagactttgggaatattcatatcacttggatactttggaatggttggcttttgttggaattggacacacacctccccctctattcaaaaaccccaaaatggttttaggctgggctcgaggtgcgtggttgggttttgctagtcgtacctcgg

SEQ ID NO: 41174 - DNA, 1501 bp, Oryza sativa
ctatgtccaaatataactaaatccatgacttataaattacttacataaagtttagcctcatattttgtaactaaaatataaacacacatagatgaatctttaacctgtttaggagagtaatcacagagctagttgtatttggactacttaaaaattagttgatacaatgtcatgtgaagtagaatatatatatatagtcggttgatatctattagttaaccaaacagagccatcttaaaatcaacatgtattgtatagcttacagtaaaaagcaaatactcaaatatatgatctaataataaaatattgttgcttacacatatactatacatcccattatagttgtacggtatagtattaatttgcgtgttgcatatattaatttagagggagtgtatgacaaacatgtatattagataaatactagttataaatcttcacctcatataattataattatagttcaactgtaaattaggattattcattgtaaaattttgtgatgggataatctgtaaccataatatgattaacctaaacaaatctaacatacaaagcatggataattattaaccttttataatttattgtgacaagtaaaatatgttcataattaaagtaaagcttccatcaataaaataataatacaaatgattcactgtaattatttgattgatcctaaatccatctaacaacagaacctctagtatataaccgtcctatttagatagatgcatacatagccataatccttccatagccatttgatagactaaaccaccgattagccaaaaatatatgtatcccataaatgctatgttggttaactcctaaataggccacgttgacaatagaaagattaagaaaccttagcccctagcgtgattggaatccattaagcagacacgaatagtatattttgttgtgcatatttggttgttgtttgaatattggtttttcttgcgtattatagaatttatgtatcggttagtcgtgaggcaatgtcagcaacttccaggaggtgaaggttgatcaagattatatcgagaataaggattatcatgagcaggcaagtcatcactattccttgaacatgttgatcctaattgcgaaattattttgtttataaataaaattgcatgcaatgatgaacatcctacttgtgattatgccatgccttgattattgtttatcccttattccttcgtaaccatgtttacgtatgagtccccagtcaattatgacaattgcttagaaatgctattctaggatcatgcagactcatatttatcaaatgctaaatgcttgggcaattacctttgggaaggtaattgagatgcggcatgtgaagacatgagcgccacattgccatgaaattgatgacatgatttgtgaaaggaaaataaagtgggaacaactgttttcgactggggcggacggaggatttgggtggtatctggaaaaggctagtaccgtccccggtcaattaaggactgagcca

SEQ ID NO: 41175 - DNA, 1501 bp, Oryza sativa
atgtaaatattatcgatataataaagatgtgtcttttatatcatgtttgtgtggtgtaccccggcttttcctgggacggggattaatacactagcgttcgggaaaaggcaattttctcggtcgcgacactccgcgactgcccaacacatgagcctcgtcccgacacatgagacgcgtcacggcaaagcttttcgataacctcgcattggcagtacccgctccatgaacataaatcctcatgaactctaggcgtccatgtttctagcagtgagaggagttctggcgctcccgggaaagagaaatctcacatacatattatattagggttcaagttaagttctctctcacacacactcatggcagtcctaccaatggcgacaccgatgtagggctcgcctctcggccctacctcaacggctgttccaccgtagcgcacctgcctcactctggggtgaaccatctatgcagggatactgcctccgctcggctatctagtccgctaggtctatacccatacgagaagtgtggttgtacgggggtcgtttcatgcttaacttcatggctcagtccttaattgaccggggacggtactagccttttccagataccacccaaatcctccgtccgccccagtcgaaaacagttgttcccactttattttcctttcacaaatcatgtcatcaatttcatggcaatgtggcgctcatgtcttcacatgccgcatctcaattaccttcccaaaggtaattgcccaagcatttagcatttgataaatatgagtctgcatgatcctagaatagcatttctaagcaattgtcataattgactggggactcatacgtaaacatggttacgaaggaataagggataaacaataatcaaggcatggcataatcacaagtaggatgttcatcattgcatgcaattttatttataaacaaaataatttcgcaattaggatcaacatgttcaaggaatagtgatgacttgcctgctcatgataatccttattctcgatataatcttgatcaaccttcacctcctggaagttgctgacattgcctcacgactaaccgatacataaattctataatacgcaagaaaaaccaatattcaaacaacaaccaaatatgcacaacaaaatatactattcgtgtctgcttaatggattccaatcacgctaggggctaaggtttcttaatctttctattgtcaacgtggcctatttaggagttaaccaacatagcatttatgggatacatatatttttggctaatcggtggtttagtctatcaaatggctatggaaggattatggctatgtatgcatctatctaaataggacggttatatactagaggttctgttgttagatggatttaggatcaatcaaataattacagtgaatcatttgtattattattttattgatggaagctttactttaattatgaacatattttacttgtcacaataaattataaaaggttaataattatcca

SEQ ID NO: 41176 - DNA, 1501 bp, Oryza sativa
tgtaaacgcgatcctagaactatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcggctattcgaatagattatactctgatcagaggtgtacatctttacccacaagatacatcttcctcacgtgtagccacgtgccacataccaccacggtatacggacggaagatgtgacatagtttccaacccatcctagccatagacaagagtaccgacccaaccccacctacggccagaacccccgggacaggtaggcaggactgagcccttagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacagtagtgctttgcaacagaggcccaaagaccggtccttatatggccgaggtgctactgtcaaaaccatgcaccccgagcccagcctaaaaccattttgagggttttgaatagagggggaggtgtgaatccaattccacaataatccaaccattccatagtgtccaggtgataagagtattcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgatagtgcaataatttaaatcaaaataattttataaactgggattcaatatgttcaaggattatgtgacttgccttgctcgctttcccaaacatcggcttcaacttccacgaagagcggatcgtccgaagctgcagcgtctacacgaccaatggaaaagaaaaggcttttactctaataaactccatataacaagctgaaacaaagcacaaaaataggttcttgacttcttaaggaaaaattagagacatgaacgatccaattccgagttcaaattgccaagttatggccatttgaagtttatatgctctttaaatgaatatttgcgaatttcttcatttaaatttttaattttaaaaagggtttattgcgtcagccgaggggaggggcgcgcggaccgggtccacgggagtggggcccatgcggcagccccacggtccacggtggaccgggtgcacccggctcaca

SEQ ID NO: 41177 - DNA, 1501 bp, Oryza sativa
aatttagaaatagttgaaattcggagaaaatataatgatgctagcgacgcaatctgcgcgggccaccatgctagttacaaatattaggagagtccatagggtttcaatgtgaggatcaagttatcaatagagtaaatttgacaccgcggtattatagttatagttgcaaaaatctaaaagggttttgataaagttgttagtatcgagattctagttagtattgtttttttttcctaaagtagtattgaattgtataattgaattattttattttctttttaactttttaaaattttgaactgtaacaatcgcaatgtaagccgtgtcaatgttgttttgcgacgccaggcagattggcgtggttaaaaggttcatattttagaaataagttcaaaaataaaaaaaatctcgtaggatcctacaaaatatagtaatattgtttcgatggaaactatcagtatactgatttttgtgcgcttctaattattctatgcttcgtatcccgacactagagcgataccacccgaaaacgatactacaaccgacacgtgtcgttttacccggataatatcgtacgataatgacgtatcccaataccgttaaccttgggttttgataagtactaaataacaaaaacgaaattagtcaatgatatgatatctaaactagttgattagaataaatatatttagagaatcttatcaaatgatattttagcaaataaaaaacatttttagttgttctcataaatcatagatgttatctaatcattattacaaaggcacaaattaattattatacacaggggaatgtataataatgaaatactgtagaagtcaaactagttgattagaatgaatagtaacgaaatagaaatagaactagttaagatagaaacagaaatatgtaatttttctgtactgcaggtaaatatgacacagtggcccacaatgtcagaaatccccccgccatatgtttctctactgcagcttgttctatcagccgaacacgctttccccaattttgttttcgcgcgaactccctcacagccaaccctagaatcgattccgccgccgcccacctctttcctctcccgcgcgcggcgcctgcctgcaacgcgaccggctgctttctccagcttcaacgccgtcggctgccttctccgtccgtccggattgcagccacctttcttctcggagaccctccgtcagccccgttttcttggcctgcgcggtcgtcagcctccttcgtcggagtcgcaggcccctctcctgctgggagcctccgcgcggagcgcagccgcaggacgccctcatcggccgcaacgacgctgctggccaccatcgccatctggagcactggagcctgtggcctctcctgaaagaacactgtgtaagtgagcagtagccatttttatttttctctctttctcattcccaaaaattcaatatatgaatcaacccttagtttttgtttcgttgtatttctttgcagcaaaaaa

SEQ ID NO: 41178 - DNA, 1501 bp, Oryza sativa
agagttttagggagttatgttttaaaaaagtttgagttaaaagctttaaaatttaaatctattcgaaaccactcaaaggaaacatagaattgctaagaaataaccatattcagagtcattcacctgctgtccttgtatatttggaagtgttcgctagaagttgaagtgactctagcaggtacaatagcatactataagctagctataaacatatttttacgagataagagaagagaaagaagagcagtgggctacagatttgccagctgcagcacggacgccaagacgcaatgtgcgtatgacaggtgggaccatatattaatagtgtagtatacactggtggagaagtggtttttacttccgattggtagccccctcgccggccgccggcacgccgccgcgccggccgccacctgcaacgcagccacgccgcaagtaggccgtcgcccggccctccaccagccctctgctagccggccacgccgccgcctcgtgcagatcgagaagtggagaggaggggggagggggaggaggagaggaagagatagggtgagtaaggagaggaggagaggacttaaaaggagaggaggagatagaactggaaggaagatcctcgatccgatctgctcccatgcctcgatctccgcgcatgccgatcttttattccggttggtgttatcaactggcactacaaattgatctttagtaccggttggtaacaccaaccgggactaaagaaaatataggggtctgacaccgcctgtcctcttttaaaccgcgactaaaaatgaaaagtacccttgagcttttcaatacaaccggtactattgtgaaatttggttgactgaccaaagatggtttttccagtagtgatatgtttctaaataatggctattaaattaactatagatgatttggagctagtagttgcctatactactaaacttgctccaaatcatctataaccaatgtaatggctaattcatacaatagttgcttactatactattaatacctggtcccaccagtcatacacacattacgtcttattgtccatgctgcagctggctatatatttgtagccccgctgcttttctctcttttacttttatctctttaaaatatatttatagcttgcttatagcctatacctactctaatctggcccgacgcgtatcggaatcggatacgattctgcctctgattcacctccgtgtcggatacttttatgattctctacccgtgccattagagcaaggataatagtgggctataagcaagctatatgcttatgtggaagagagagataaacaaaagtggggagtgttggctctcatgcaagagctaactgcacacaaactccaagaaatatgcattaaattcatggtgagagaaagagagaggatgaagaaaataaagataaacttatagccaacctactatacatgttagctttaacattgactaatagtaagtagtgagctctactattaaacttgct

SEQ ID NO: 41179 - DNA, 1501 bp, Oryza sativa
accggttgtattgaaaagctcaagggtacttttcatttttagtcgcggtttaaaagaggacaggcggtgtcagacccctatattttctttagtcccggttggtgttaccaaccggtactaaagatcaatttgtagtgccagttgataacaccaaccggaataaaagatcggcatgcgcggagatcgaggcatgggagcagatcggatcgaggatcttccttccagttctatctcctcctctccttttaagtcctctcctcctctccttactcaccctatctcttcctctcctcctccccctcccccctcctctccacttctcgatctgcacgaggcggcggcgtggccggctagcagagggctggtggagggccgggcgacggcctacttgcggcgtggctgcgttgcaggtggcggccggcgcggcggcgtgccggcggccggcgagggggctaccaatcggaagtaaaaaccacttctccaccagtgtatactacactattaatatatggtcccacctgtcatacgcacattgcgtcttggcgtccgtgctgcagctggcaaatctgtagcccactgctcttctttctcttctcttatctcgtaaaaatatgtttatagctagcttatagtatgctattgtacctgctagagtcacttcaacttctagcgaacacttccaaatatacaaggacagcaggtgaatgactctgaatatggttatttcttagcaattctatgtttcctttgagtggtttcgaatagatttaaattttaaagcttttaactcaaacttttttaaaacataactccctaaaactctacccaaattggaaacatgcatcgatttcaatattctttgaaactttctaactcgattctaatttgtgtagctttcaacttaaaattttaaactttcaactcatatttaaaaacttttaaatcatctctttttattattttatttaaaatataaaactttcaacttaaattatgaaactgttctactcagttttttgaatctttcaacttatattttacaacttttaactcaattatgtatttattattatactagcaattataaccgtgcattgcagtggggagaaaaatcgagaaagttagagagtattgttggcagaaagctgagtaaaataggttgatacagtataagttatcaaaggctagtcctttaaaaaagaagatgcatgtctttagcatgataccgacaatgctaacaatgtagggataatgcaaactagtatttttacttacatttcaatggcttaaaaataccatgtagtggtaagtgattgaaattaccccgagtcttttcacaaactaacggacttgaacgttgggcctcgccatatgagagctcttttacatgctaaggcattaacagaatgattgaaatgtttatttattgggaaaaaaatattgaaatgttactacaggtgaaaagatcacttcactaattaatatggaattaacacaggag

SEQ ID NO: 41180 - DNA, 1501 bp, Oryza sativa
ctttccccccttttttccctccctctctccctcggattcctttggaaacctctcccctaacctcgccggcgccattaatggcggccgggtctcccgcgcccatttccccctcctctggccgccctctctcactcccaaccctatataaaccctcctcgagctccccactaccgtttccgccactcaccgccctctctccccgccggaattgagctcgcgccgtcgctctctctctcctccgtcgccgccgagctccggtccgccgccgtcgtcacaccggaccacctcccacctcggcgccgcctccttcggcttcgccgcatcttggccgacctcgtccaccactccgtttcggtcgccgacctccggagcaccgtcgaccccgtccacccggtcgccgtttccgtcgtcgccgtcgacccggagtgagccgtggaccgccgcttcgtttccccctttccctcccctctctcggccgccgctccgccgtgcctatggccgccgccggtgaccataggggcgcgggcgtgccgcctcccgccggccgcaccgacgtggccgcctccgggcgcgcctagcggctgccgcgtggggcccggccgtcagccgcccgcgccttcgggtgcggctgacgcgtggggcccacggcgccggccggtgtgagccgggtgcacccggtccaccgtggaccgtggggctgccgcatgggccccactcccgtggacccggtccgcgcgcccctcccctcggctgacgcaataaaccctttttaaaattaaaaatttaaatgaagaaattcgcaaatattcatttaaagagcatataaacttcaaatggccataacttggcaatttgaactcggaattggatcgttcatgtctctaatttttccttaagaagtcaagaacctatttttgtgctttgtttcagcttgttatatggagtttattagagtaaaagccttttcttttccattggtcgtgtagacgctgcagcttcggacgatccgctcttcgtggaagttgaagccgatgtttgggaaagcgagcaaggcaagtcacataatccttgaacatattgaatcccagtttataaaattattttgatttaaattattgcactatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctggacactatggaatggttggattattgtggaattggattcacacctccccctctattcaaaaccctcaaaatggttttaggctgggctcggggtgcatggttttgacagtagcacctcggccatataaggaccggt

SEQ ID NO: 41181 - DNA, 1501 bp, Oryza sativa
cacaacggaacacgaatagatcacgtcgcttacgtcgcatacgccgtggtcgtatgacagtcagacatcgtagtcgtgtgtgtagcattttccaaaaaaatattcactggctataacaatgaaggcgcgccaattttctagtgtgttccgaatcggacgtggtgtttgtgtaaagggaaggagacaaattcgagtctgcccatgcgaacgtgtgggcggcagcaataaaaaggaaactcactgtggagattatgggtacctccacccatacccacatggcatggttatccgactagttatagaggatagtttatatctatgaaatatgtaacatatcatgacttgtatattatggaatggcctaaagtattggttaaggtttctatcttgtaatcttgccccccatcctatataaggtgggcaggaggccctctagggggcatatgagcacacatgatcgtcagatctatactacacccggtggattcaaatcctcaaaaaggagtagggtattacctctcattgagagggactgaacctgtctaaatccttgtctccgcatccatccacttttaggtctcgtgcgctacccccttttattattaccgaattcatgtttcgacagttggcgcgccaggtaggggatgcgctgagttttctgtcgacgagtgtgatggaaccaatcttcaaatcgctgggttggtcgttccaatctattgctgttagattaattttttgcatcagattgatccgttttattgtcttttggcgtgcatatactggtgcctgatgcttttgtcgatccaatgaatgacactatcatctacaatcttcacgcacgattctgcgcctgtgtgatctcgcgtcggcctcgtgcatgtgtagatgcatcttgtgttcatgcatgcctgggattgatcagcagagaagcgggcatgcgtgcattgctatatgcatctaatcttcatgctacgtgctaattagattgattttggattatagattattaatcctaattttgctggttatttttgcctgcatgtctacgctggttgacgaggactgatgatcatgatcactgtcgcatcaccttgccgatcgcaggaaccgctgcgagccgctgtacgtcaagaagccgtccacgcagaggacgcgcgagaccaccggccgacagccgccgcacacgacctcgcgcgatttcgcgtggtctggcatgatcaggccgtccgtcttggttgcatgcaatgcaaggcattcagctaacgattggtctacatgcatgacatgaccagtgataatctgggagcaagcaaacactccaagcattctttgactttgcatctacgtatatacatatgtatttaattcattgatgctgctgaaattgtttccccttttttgtttgcacatatactcggggaacggcgccgcatgcccgggggttcatcctttgcgtggctgacgcggcccgactacacccgtggcgcatgagtccggggca

SEQ ID NO: 41182 - DNA, 240 bp, Oryza sativa
tacccacatggcatcgttatccaacctagttataggggatagcttatatctatgaaatatgtaccagattatgacttgagtattacgttcccttgtatattatggaacggcctaaagtcctggtttgataatattgtaaagtagatttaggaaatcgataccgtattggttaaggtttctatcttgtaatcttgccccgcatcctatataaggtaggcaggaggccctctagggggcata

SEQ ID NO: 41183 - DNA, 988 bp, Oryza sativa
agggtttaaataggtttggaaggggaagaaacgactgggaagaaagaaaccggcgcgggaggtcggcccccatcaatggcgccggcgagatttgcgggggcaaatccgcccgtttgaacgcaagagagagagggaaaaaatggggggaaagggagaggggatcacgttgagtgattcctcccactttattgcacgtggggacgacggaaggcggcgggattcgcgccgacgccggcgctagggcgcgggcggaacggcgggagcggcgggaggtcggggatgacgggtgggccctacccgtcagcgagggtggtgggcgggccggcccgtcagcggcgcgcgcgcggggagaggccgagtgggccgcggggagaggagagagagagggggggaaggagagatgggccgggccggcccaagggagggaagggggactttaagggtttttctttttataaaactttttcaactttgtttatttcttaacaattattatttgtgctatgaaaattccactaaaatttatttacacattttaggcttttaggaaatatacaaaaatcttctaagccttatttgacttttaactttgcacattttaattgttagaggctttcacacggattttaattattctaggcataatttaaaggatatattttagagtcgttttgggacgtgacattttcctagcaaccaaacatcttttccgatctcttccatcaatcaccttttgacctttctcaaccaggtactcttcactccgggtgttgtgggtgcttctggggcaatgcagtccttgggcctgctgcctttcagagaaaccttgaagtagttcgtcaaaagctatactgactgtcgttgcctttgatccgaaaaaggacacatcggaaactcttagtccaaacaaatgtctctttggttgatcacttgattttcttcgccatcaatcgctaggttatttgattcataacagattatgagctta

SEQ ID NO: 41184 - DNA, 1501 bp, Oryza sativa
acccggctgcacagatctatctccaaaccaggaatgtaccattccaaaccaggagctaaattaattaccatcaattaccacattattattaatgagtagtgtgggactaatcaagaaagacattgttcgacccgcccataaccacgggcacggctattcgaatagttttactctggccagaggtgtaccactgtacccacaagacacaactccacaatatgtcaccatatcatcatgtgcccatgctgaacatgtcaccattagtgtagttgtgacaagacccctcgcataactcaaccaaaagcagtgcaccgttcctggatcgtagtcaccccctcaaaaaccagaggcatggactccccagcgacccttgtgggcttatctccgccacttctcagtctggtgctccgtaatgagccttgttatacaaagtgtccagccgttgcccattctggcttgtggttggcacgggtaatgtttcacaaccgaaactcgtgaaccggtccttaattgtcataagtacgaccatcaaaaccatgtgctcacaacccaccattatcaagttttagttggcacattaattaaccaatcacgattgaccaacgattgaccatcgtgagctatcattaaatatccatcattaagtaatagtgaaacattagttatcccaattgtgtgctaatgtttaacatctagctgaaccaatatataaagctcaactagtcaaattataataacccaaggtatgaaggaatagagtaattaatgcaaattggccatacaaaggaataattcacaccacacggtgacattcgaaaataaatgcacagttgaaataaatagagaatttaattataggatcaacatgctcaaaggaattgtgtttgggatctgtgtgacttgtcttgcaataacatgtcttcaattaatcttcttgaacacttctggcgcactcgcgaaccttcgaaacgacggaaacgacaagctaacacgcaaaacaaagaaaaagactaataaaaaccaaataaacaatacatataaagtaagcaaacatgtaggtcataattttagatgaattatgagacttgaacggcctcattctgacttcatatgaattaattatgaattttacaagatttaatctaattaaagcctatttaaaaaggattaaataaaattaattcaatttatggataatttaatatgtagatgtttattttatacaacttttgcaacttgaaccacattaaaccaagttacaatgattatgaatttataaagattaaactggattaaagcatttatatggattttaattgaattatgacgcaataaagaattatttttgaaaggaaaaagggatttattgcgtcatcaaaggcggtccacggtaaaccgggttcaaagagacggtctacgaaaccaacggccgagatctaatctaagccgaacggacggccgagatcgatccggtccaccacgggctatggatgacgtcagc

SEQ ID NO: 41185 - DNA, 664 bp, Oryza sativa
ataacttggccatttcaactcggaattggaccgttcaagtctctaatttttccttaagaagtcaagaacccatttttgtgctttgttcctgcttgttatatggagtttattagagtaaaagccttttcttttccgttggtcgtggagacgctgcagcttcggaagatccgctcttcgtggaggttaaagccgacgtttgggaaagcgagcaaggcaagtcacatcatccttgaacatattggatcccattttacaaaattcttttgatttaaattattgcattatcgctttacttaaattcccgcgttatcactgttttatttagccatgcctatttacctttgttatgaccttattattattgtcattgatattattaccttgttcaccctagattaaacaaaaccccaactagtggacactctactcatggtaccactagtatgaatttaggtagatgcttcactgattaattaggcaacattagggggttttataactctagactttgggatattcatatcacctggacactatggaatggttggattattgtggaattggattcacacctccccctctattcaaaatcctcaaaatggttttcggacgggctcggggtgcattgttttgatagtagcacctcggccatataaggaccggt

SEQ ID NO: 41186 - DNA, 1501 bp, Oryza sativa
accgattgtaaagaaagtgaatccgagatgtctgttcgtgggagctattcccagttatgaaccaagtgatatgttcaaggataatctacagaggtcagattaaaatcacatccaataaagaagcttcagatttggcaggataacgatcagacaataacaagtctagcagtaaagttatttgggaagacgtcaaagcatgtcaagtgggataagttggttctcgtgggaagcataattcaaagttagagtgatcgaccctcgcattgaatagcgttagtatctagcacccggagactaggaaagctaatatgaggcagttagtggcaagttgtcaatcatggtatccttggtaagcgggatatcatagtctaaagcatttggtggtaagttggaaggaaacgccaagcatggtattctcatgatgacaagctggtaatgacaagcatggtatcccagtaatgacaagttggtatcgacgcataacgtgaagttggtaacttgtatgagattgacaccaagggtatgaattatgagaagtcccggaactgaagccccgtcttcaagtgccgcatcccagtcgaagtcagctcaaggtgcaaccagggacaagccaggtgaaacgaagattccatctgcaacaggagatcaagccaagcagttcagagtggggaagttttgctgggcaagtttgttaaagaaaacgcaatggaagaagtcggaccagaagagaagaccgcccaacctatcttcttgctagccttctcgaatctcgggggcgagattcctgtaagggggtggatttgtcacgtcctgataaattcatcccgaaataaaaatcattttctaaaaggaataatataattaattaaaattcgaatagaaattggcaaacattaaaatgcgtacaagaaaaattcgaatgtggcccggagaatttttgttaaattccccttggtctaaaatgatccctcaaattttacttgaatttccagagcaccggatataattattacgcaacaacaacaattaagaaagtttattaaaaaggaaactaaaaataatcctccttttcctttgggccaagtccagcccaaagttcctttcctctctccctcggcccgcggccgaagtatcacttccctccctctctttttcctcccctctctctccctggcctcccctcctcctcccgggccacctcttccctcctcttccgcttgggccgcccctgccctatcccggcctagccgaccagccgcctccctcctttccctcgcgcccctctgcacgcgcggcgcatgtgcgcgcctcacgcctgaccggtgggtccacccaccctgtcgtcttcaacctccagccggccgctcctctctatcactctcccgaaccctagcgccaccatccttcgatcccgctccactgcgcaagttccggccaaataaattgcaaaaacggaatccccatcccttcctcattatttcccccaactttccccctttaa

SEQ ID NO: 41187 - DNA, 1501 bp, Oryza sativa
cggacgttggttcacaagggtcaatttgccggaggaagacgaggaaggcacggcaccggctacgtaggggaaaagaaaacggcgccggcctcgtctcctgattgggtatccatggtggcgcgcacacgcggcgacaccgggagtgttggcgggtaaagaaggacggacacggcacaacgttgacgtcggcgccagctgtgggcagtcaacgatcagtggcggccagcgtagactctacagcattgtacaaatggatcacgccttgaaggtacaaggttgttgcacccgagatgtgtgcataaccaaacaactcgcctgagttggcatggtgtaacatcatgaaaattaactattttctaatcatgcatcatgtcgtttcttatgttcttaataacttgctaaacctaggaaaatataattagcgggacctcctaaaactaacttgcataacatccctctctagtatttaacttttttgtgtttttcatttaaagatatatttggttaagcaaaaacgtgcaatctggtgatcaacggccacgaaacaggtttggccgaactggtggttcgactgaacctaaaaaccctcttcctgacctctcctttggctggtaggtagcttattgggcccccaacatcatgtactttgatttgtctccattctaagtggttttggttgacatatgggccctccaatccgtgtaaacgcgtcctgaatgtgcaaaggtgcattttgtcgcatgacggatgtgttttctcctcaaaatacctgcatacacatatttcaccaacactagtgaaaatgattagtaataaaccctaccactaagttggatgccatattttatttcattatatgcaagtattgatggtcaaaaactatgatttaaagaccgtaaacattaatttccagtgattgctgtgtatcccacaaatagttagaggtatgtgtagaggtggtgacagccctcaagaacacttaagtcctcattgtcggggtacggaatagagcatgttctggtagtagcgagcaagcatgtgcatgaagtaccgctataggattaaattaagctttccgtagatactatttctcactaggaaatcctctctactcgttgtctatgtttgcttcgtgtccttggatgaacatggagaagagctgagcacactctttccctatggaaaatcgataccttggaatactcccaggtgaagtgctacatctttctctgttcttcttcttcctctctttctctgttcatcttcttcatgttctctctttctcatgcgtgtgctgcaacagctagatagcacgtacagtggctagctggaaggacggccggacgggcgagtcgaactgaggggcgtggtgcggagagcgatcgtcgggcaagaccaagagaagcgtgggaggcgtgcgggcccatggcggcaagtcgcgcatgctggaatggtctccaacgtgcaccgacgacagcggcgggtgtgctactactacgac

SEQ ID NO: 41188 - DNA, 1501 bp, Oryza sativa
acaaacaaaaataaacagcagcggacaagcgggcctgcggctccatcttcacaggtgctcaactggggtataagccaggactccacctaggacttcttctccaaagcttctattactgaagggggggaaagatatagcaagaatgagtacaaccacagtactcagcaagccacatcgggagatgcatgattaatgtaagggggtacaaggggataataataggggttaggttttgcagtaaacagcatttaaaagtcacttagttgtccaaagctattttgtaaacacgatcctatagctacacaatattattaatcaaggccgtgaatccacacgaacctgccttaacccaaggcctacgatgattcagaccgaactggcaaccagacccaggtcccaactcgtcccaagccaacccatgccaaccattccacattttagttgttaagcaagttttaaaaattaaaccaccaacttgggtacattgctaggcttacccatatccgagggcgcggctattcaatagattatactctgatcagaggtgtacatctttacctacaagacacatctttactccgtattccacggccgtggaacccgtcataaaggatgtgacttaacccctttacctatcctagccatgacaaaagcaccgacccaaccccgactacggccggaacccccgagacaggtaggcaggattgagcccctagcagcagaacactggccctgtgccatgacatctcgactaccacgccgtagcccgtgtagccttcatttgccctagagatgtccattgagccccgactttgtccatctccatccgtgtactcttgccaggactagactgagcaccgagttaagccttacccattagacatgtggttagatggtagtgctttgcaatagaggcccgaagaccggtccttatagtggccaaggtgctgctagcagaaccatgcacctcgagcccaacctaaaaccattttgggagttttgaatagtgggggaggtgtgtgttcaattccatcacaagccaaccattccataatgtctaaatgacatgagaactcccaaagtctaaagttataaaaccacctaatgttgcctaattaatcagcgaagcatctacctaaattcatactagtggaaccatgaatagagtacccaccagttggggttttgttttcctagggtgaacgaggtgataataacaattgcaatgataaggctgtaacaaggattagtaggaagtgctaaataaaacagtgataacgcggtaatttaaataaaacggtaatgcaataatttaaattaaaataattttaaaaactgggattcaatatgctcaaggatgatgtgacttgccttgctcagagagaacggccttccgaaccttcggcgacgaccacgaactacgcttccgaaacctccggaacgacagaagctacgcgaaacacacaagcaaagctacaaccctataaagaagcaataataa

SEQ ID NO: 41189 - DNA, 1501 bp, Oryza sativa
acggaccgtaagtgacagcgtctgcaaaaattgatctttattttcacatacgactctttaagacacctgtatgggaaaattaatatttccataggggcctcttaagaggtccgcatgcaaaaatgagctcatttttgcatgcggcttacttaagagcccacatgaaaaaatcaatttttccatacgagcattttaaggagccgtctgcaaaaataaactagtttatctcaatcatatgaactccaaattggatgattctttgtcacgcccggaatttttatccaaaattccaaacgcttacacgtgcgttaaatcctcgtccaggaatcagccgaggcacacaataacaaattgataatagagtactatcaaatatctaattaatactcgcgaaataaataattattacagaggtagatagttcctctcaaaagaataaaattctacgcagcggaaataaaaacaatagacggaacaggtatggcgactccactccacaagcaacttgacccgaacaaaacctaatcctccatatcatcaccttcactgaagtactcctcctctgatgaatgaatattgcaagattgagcatatgacatactcaacaagccacacagcaaatatgcaagtgcacaggataacaaaggatggcataatacagctcaattgcataaacaagatttaataaacatttgagagaatagtaaaacagttaagtaattaagcaatattaaataaacactatacaacacccccgtgttgcataggcccaaccccatctgaacaaccaaccctggttgtacaaattaaacctccataccaggaatatatcattccaaaccaggagtcaatttaattatcacagtattatcattaataatgagtagtgtgagactaatcatgaaaaacattgttagacccacccataaccgcggacacggctattcggatagttttactctgatcagagatgtaccactgttcccacaagacacagctccacaagatgtcaccatgcgcctcgataccaccacggtaccttggaaaggagctgtgacaatacctctcacacaacacaactcaccacagtgcaccgttcctggatcgtactctccccttcaaaaccagaggtaatggactccccagcgacccccacggacttctcgccgcttctcagtctggcaccccataatgaatcacgctatacaaaaggtaaagtcgttgcccacgctggcttgtggttggcacggtaaatgtttcacaacagtagctcgtgaaccggtccttaattgtcatgagcacgaccatcaaaaccatatgctcgcaacccacctttatgcaggttttaattatcaattaattatcataacacgattaaccatcatgagctagcactaaatataaccataattaataatgtagtatgattcatcccattaatgagctaatgtttctaagcatggctaagcaattatacctatatagcacttagctaaaccaa

SEQ ID NO: 41190 - DNA, 1501 bp, Oryza sativa
aaaggctgccgagaacatctacatcaaggtatatccaccctactcgcttccctaatcttccttccccctcgtgattgttgctgttcttgctgcgatagatgggctacagatgcaactagagatgtattgcttgagctcttcataattcatcaacacttcatgactgttgaaactgaattgcatctatacgttataagtactactcctaacctgtagaattatcaatctatggcaatcaacctcaatgaattatcatctgacctgcaagcagaatgagaaaccaatataatatcatatagctgtaagacatgatcttttgaacaagagacttgcattatgtagtgttttatttatccatcacttgagcagttttcacaattcctatatatcgaatggtaaactctacttcaacgtactttcagaaaatatgaaatatataaatgttaacagtaagatgaaatcaaaagtactaatctccaatagtccatatatatctggatcatatccacctgaaataaaagattaccacttttttatgtactgcaatttgcaattagcaattaaacatgtgcatgctgcaaaaatattctacaaaaacaggactagccatctttccttttccttttaacaaacagtaatagcaaactatcagtaaacagagaacatctacatcaaggtatatccaccctactcgcttccctaatcttccttccccctcgtgattgttgctgttcttgctgcggtagatgggctacagatgcaactagagatgtattggtgtgctgtgtagaggttttggatgtgctccaaattgaaatgaggctgtttttcctgtgcgaattgctgagtttgcttcaactttcatccttcccatggtcacttttggtgagttcctatgagtcctatggtcacctttttttagaaagtaataagtgaaatcctattatgaatgtcaaatctgatgactccttttatcttattcatgtaaaaaggattggttgccaccatatgtggtgctcaggaatgtcaaaactgtagtggcatgtttcttcctaacatgtgaagtggtttttttggctatctagcaaacttttggctgtgctttctcatgttatactatgctaagcagttgcattgcagtttaagatgcctcagtttatacccaatttttggaaatttgtgagcatgatgtcagtcttttccttttaaattaagggataataggaagaaaccagggctggcagttctttttgtttaccaatttttccactgtacaagtgcaaaagcatttcaatatcttttcagagttcacgaaagaactgggctatttatttggtagcaggatcggaagtagggttgtttttttcacctataactgttactttagtaaggaaatttgagggtgcctctccctcatgcgtgaaaaccattatttccacagtgaaaaggggtaaatatatatatattgttttgcctgatctctgagcatgcttagtttctt

SEQ ID NO: 41191 - DNA, 1307 bp, Oryza sativa
agcttcaaacaacatttacaagtactagatgattttaactgaaaaagtcatcacaacaatgttgtataactcatcaggatctataacttttatttgggtcatttcttcattcgtcgaagtgatttgtaacattgttcacaaaatgtacatatctcttatacgtttataaaaaataagagagatatgtagattttgtgaacaatgttacaaattacttcgtcggatgaagaaatgatcaaaataaaagttatatatattgatgagttatacaactttgttattgatgactttttgagttgaaatcatttagtatttgtaaattttgtttgaagttgtcataatttgaaattcaaattcaaaccgttgaaacaaagtcatatagaaaaatgaccaaaataaaagttatagatattgatgagttatacaattttgttgttgatgaacttttcatttgagatcatttagtttttgaaaatattgtttgaagttgtcataatttgaaattcaaattttatataggccaatgaaactcagatggagaaataaccaaaataaaattggtagatctcagtaagttatacaactttgtttcaaacaactttttcacataagttcatttattatgataaaattcgatttgaagtttcaaaattttgaaatttccacgttaaatgaccattttgtccaagtaacttgtataataggtttccagataccagggttattctggtaaaatcgcatcaacatagcttcttatacatatatccaaaccctagccatccattcttcaccttctctttccccaccctcacaccgccgcctaccacgccgtggtcatcgtcctcctcccttcgcccaccatccacagccccctcggatctcgccgccccttccgcctccccctccgctcctctcgccgctcctccgtcccccccctcttcggcaatctcgccggcgtcccaactctagcgggagcggcggtggcagcaaggaggcgcggcggcaacgacctgcggcggtggatttggcggcgccgtcctagggaaggccggatccgccgccctaggaaggagctcggctctcggcggcgggcggcgggcacagtgacagcctgctccggcggatctggtggcgccgtcgcagaggcggaggacagcggcgcgccagagacggagggcccgtcgggcaggccggcagcgaggcggtggcggagccgcggaggcgggccggcgtggatggggtcggtggaggtggcggtgacctggtacggcggcggaagggagtcaatgcgagggggttcaggcaag

SEQ ID NO: 41192 - DNA, 1501 bp, Oryza sativa
ctccatctcctcatcctcgcgctcgcggcggcacgctctccttctctgttgctctctctcgatcttgtttcattcagatgagatgtgatttttctcctgttttttgttttttggggttggtttcatctggcgttggataggaatttggatgtttacctgttcatgggagcactgtcccaaaggccggccaccgtcgtctagggtggatctcggtctcgtttcgatttgaaagctcccgagatgaaatcaggtggcgcttagagccctcatccgtgggttttccagttggatattgggttacgctcgcctccaaattctcttctatctttaaattcttggggtttgctgcattttgtctgtttggatcttgtgcgattgatttgggagatggtttggttgtggtgcagtgattataaaatcattcctcgtcctgatgggagatctgcgtgatcgactcctatacacccatagaatctgagcaccaaaaaccattcctttttttttcaatcaatcatctgctttctattttggaatccagttttctgtgttatgtgaatatccgatccttgcgcggtttaaactccattggtgtattctatctctaatctacaaacctttcttttttatggaaataggaatcttcgaaccttgcgcgatttaaactccgttggtgtattcgaattcaaatctacggacttccctcttgacggaaatctgaatctgcacaaactcgcccattagaggaaatctgaatctgcacaaactcgcccattagtaaaaacatttgtattgacggcttgcaatgttaaatctcctaccaactatgtaaaattacaattttgtaagttaaatcaagtttcgaagagaattgaatgaaattcggtggaaattgcagttgttttttgtacgtcgctctcaagcacactaaatttctggcccatcgagaagaacacgcgatgttacgatatctaaccattcctcgttgtacacttttgatagttattttgaatgagctgattgttagcccgcccagattaacagttctgtgtagtgatttcgtcgtaacgcaccaacagactcattggtttgatttactaaaaattaaaattaatttggaaatatttttttatatttgtgttcttaagaaattattagaatcaaatgttgaaaactaggttatattaaataaaattacaagttcataacaacgtttgaaaatttaaatttttcccgtgaggccgtgataaactgggcgattttaccaaaaataaatattgctactgtcccttctacctaaagtgaaccatctttccaaataatcatcatatcagctttgaattgatctacccttgttcttaacgtatactggcctctaacttttcgcatatgtttatgtttattagtaaaagtttaaattttcaatcttaaatatatttagacttgattttgagatttttactatcgaagattattttttagcctttaattttatatcgctaag

SEQ ID NO: 41193 - DNA, 1501 bp, Oryza sativa
tactcacccatcatgtgaggcagagaggatcccgagccctggcatttgtgctaaacatcgaacagtatctgccgtaacaatgttacacaaaatgaggtcaaataaacatgggtgagctagcaacaaaacacaaaaacaaacttatgcttatatattgagaagggcactgacaatcaattcataaatgatatttttctctttgcataaaacaaatgcataacattttgctccagtgcaaccagaatcaattctaaagtgagaaaaaaaaattgaccagagtaaaattgacaactctcagctatctggtgaaccacactattacagtagaagcacccttgcacacatatacatttgtgtcaatgtccaagaaagtataaacaataaacagagtattatgcattaggaacaggcaaataacctgcatgtcctgtgaatgtatgtagacatgtccttcctttccaaaacttaattgtggaatcacttgagcctgtatgaaggaggaaaagcatcaatagatcatttgacgaatttttggtcacatttgttcagaacaagtcccaggaaacactataataaattgaggttcagtatgcattttgtaccccctgcactgtattgtggaaattgagacgtttacctatactagtaaacccattttccttcgcctctaaggtagcggttgctagacacatagctacttagtacatccaataagaattactattataagtactttcaaaaagccaaaacaattccagatgaaccattgctttcgggatatttccagtaaaccatcagattccaaaagtttgataggaagctcaaaccaatcacattggatcagttatgaacaaggtgccagtgcacaaatacagaaaataaacaagtaccaagtaaaaacgaaataaatgtgaaggcataacagatgctctaccagtaaatagttctccagatggcagcatcagaacagtttgcacggcaaccttgtgagcttcccaaacctctactacactgccatttctccaccgtcttacagtgctgtatggacaattggcaatacatatatcagataggacaacaataaaccactctaataaggacccttaattgtttattagtattaggccatcctgtcattagaacaaacaatttaagaaagagtaaatagcagatgcgtgtgcctaaaataccaaatacttagaggcagcttttgacacaaattattagtagtaacatttgcaacagagcctcaaaggaaaaggaaacagaagtagaaacatgaattggcacaaaatgaaagaaaatgagtgatccataaataagaaggtgccaaagctatacaaattatcatagcatgttacattatgccattgacaacatacatttttttaatgaaattagcataggatagtaattagcaagcagaaacagaaccaagccatataagaaagcagcatagaattatattgatttctcagagaaaacctaccaatccatggat

SEQ ID NO: 41194 - DNA, 935 bp, Oryza sativa
aaaacaaaaaataaaaaacataaaaggtccatcatgggctcatggcaaaacaattaaggaacctctctcagacatctgctgcttgtcaacatctttcatgagcctgaggggtatgtatatcgtatttagctccactggtttgcctgaaaggaatgaattgagcatgtaaagagtatgctgcaaaatgcttcggccttgagtttatgtaggaaatgatttttgtagtcatggagaaggcatgatgcatacccgtaggtggcacattcaacactttctcatacttcttcatatggtgcatcatggcacagtgtagagggggaggggggaagtgtggtgtgtgcagacgctggatttaggaggggatatgtggcctcatcactaccattatttacggctctactctcatgcaccttgcgtgtacttttttttttgttattgagtacccttaattagcatatttaaccgtttttggtacatttgtcatgttaaattgttattgggtatggacattgggcattgtcatgttacagcaatgctagtgcatgactatggccgtgctcaacttagttggatacaatcgcaacatagtttcccctactcatcactaccattgtcgatgcactacaacctattgaaaatttggtcataattcgttatattttaatccaaaataacaagataataaacatgatatttataatgggatttgatccattgatagtggtgaatgtaatcaacatgagtatgcttaatgtagaataagcatcaacaatcacataataacacaatattgacattgcgatgaacattaatagtaaaacttctaattgaaataatgtaagaaggttataccccaagaatagtcctccgctggagtttgaggcagtattgcctccgttggtgttgacgggagcctccttctccttgtatccagt

SEQ ID NO: 41195 - DNA, 1501 bp, Oryza sativa
ggcttgttttttttgaagattttctttctgtttttcttttcatcgtgcaagctttatatgaagctagctatgagcccatgcaagatggtatatattgctatgtgcattgcgttacttaatcctctacgcattgaatgtacatatcactgggactactttcctaggttttgcaagaaatttacaggattatatcgtacaaattagttcaactcctgtaaaaatttcttcaagatcaccttccattttattttaaaggaggcttcttagtactacctccatattttaatgtatgacgtcgttgattttttgtccaacgtttgacccattcatcttagaaaaaaaattatataattatcatttattttattatgacttaattcgtcatcaaatgttctttaagcatgacataaatatttttatatttgcacaaaaattagggagtacatttttttggtgaccaaagagtataggaatgccgtattgataaaactaaggatcaaccacatttcctagtcaggattcagttggagaaaaatgtagacacacgaaccaaacgtagatcggacttgagcgggtgtgtgcgtatgacggggctatgtccaattatgctagtggagattacaataacttaaagtgttctaaaatcccgatggatagtggataaaactaagcttgtaacaatcatgcgaggacacaaataaataaattgataatattaaaaagaaggttgaaagaccaatgcaatgtaagatatagtttcataagaaatgtttatttagtgaataaagattatatatgtaaaaaatgtactatttaggatcttaagatgtttttaattaatccgatgttgcattctaagtccgataagttgcctctctttgggggggaaagagagataagaaagcgaagaagcgagtcaagttggctgctggttgaatacaggcgggcatgggcgacaacgatgcaaaacgaatatcttcaaaaccagtgaatgcaagggagcgattccctccgttaatttattccgataatatctaacatctcgatccaagttactgtcattttttgttttttgagctatctaacgatcgctaattcgctatatatgcatgtaggggcgctttgttctaatatgacccatcaatctatttctttcatctcttttatgtgttgcttaccagctataaatggctaagaggttcagtgttttgggttataagcttttttccctttctcaaaaagaaaaaaaaaacatgacaacgttagattctttctttctgtgatattaactgctactatgaactttatagtatatatgatatagcaataggttttatctctgtcggctgtggtattatatatgtactaagtgattccccgagttttgcttaaagaattcctaaatattttttttaacaaatgagctaaaaaatatattagttattaacaacaaataaaactgatttgtcaaactatgttcagagagaaatatatttagtac

SEQ ID NO: 41196 - DNA, 1501 bp, Oryza sativa
aatgcctctgaataagcgagcgaaattagacagccagtcaggcaggtccagattccagcaacgccgcatttacacgggaccagcaatttgagctctttgttttatcgtctctgacagcgtcttccaaaccaagaaaaaaatgcatgttaaggtcaggtcaggccaggagagatgagcagtttatcattttgcatcagactcaacagctcaccagttatcaacatccacaataacgctactagtagtggagttacctgctaagtgtccatcagaaccagatagctactaagagtcctgctccctcaattctaaaaatataagagacaactaccattgatccaaagataaagaaataattattatcatcttattgttataagtataaaacctgtttaaattgtagccaaaataaaccttaccaaatttttgcaataccaaaattttagtaagataccaaaattttggcaggatttcttatgtatttagcaaatttagtaacaactaaacgtagacatttttttataactttaccaagaaaatggtatggttgaaaatgacatcaacgtaaaccgaaccataatgtatggatccaataaaatttagatttaaagataaatgataaaaataataatttagtgaagataagatgctagttaattgattatacgcatacatgtttttattgtagttatgccttatatattttgggatggagggtgtctgttcaggttaagattgaacccacttagagcaggtacaatagcaggctataagccagctgcaaacatattttaaggagataaataaagagagagaagagcagcgggctacagatttgtagccagctgtagcacggactccaagacgcagtgtgtgcatgacaggtgggaccaggtattaatagtgtagtatataactattgtatggatgagctattagattggctatagatgaattggagttagtagttggctatactattatacttactcctactataagcttatgtgaaagagagatgtaacaaaaagttaaggggtgttggctctcatgcaagagctagcttaacacaagctccaagacaaatacaattaatgtataagtgagagatagagagaggagaagaaaattgtagccaaccttataactaatttattatatgtgttggctttaagattaattaatagtaagaagtgagtcctattattatccctgctctcagtgactgacaggcagctcaaccacatcgattcgccacgcagcaacaccacttgcaccaccgcccctcgtctcagctcatctcctcgtcaaacttcgctttccccaaagtcttcctcttccctcctctctctctctctcccccatctccatgccgccataagtatcagcagcatcgcacccggaatcggaatccccaaacccaaccccatcaccccccaacaacaagagatcatcgaagccccaacaagtcgcatgacatccatggcgacgccgccgccca

SEQ ID NO: 41197 - DNA, 225 bp, Oryza sativa
gctgttgacatttgagttgtttatggttcagctaatgcatatgtacctgggcaatcagcgtcttcaactggtatgtgtccactgatatgaaaatagagatctaactgatctattttattacttttgttgtattcagtgataatggctttgctccctttccccactctcctttttttgcttcttcacaagtcctaacataatgttcaaacttgttttcagttagtg

SEQ ID NO: 41198 - DNA, 398 bp, Oryza sativa
ggcaatgctagaaagtcttataatataaaacggatgaagtaccttgagagttaggaccttgtttagactagtattgcaatatgaggaatacgttgtattcggttttatggctgaaggatacgtttgaaactcagccttaaaggaaaatgagacgtaaagtaaggccctatttagttccctaaaaacttttcgcaaaaacatcacatcgaatctttggacatatgtatggaacattaaatatagataaaaagaaaaactaattgcacagtttgcatgtaagtcgcgagacaaatcttttgagcctaattagtccatgattagccataagtgctacaataacccacatgcgctaatgatggcttaattaggctcaaaagattcgtctcgcggtttccagg

SEQ ID NO: 41199 - DNA, 1501 bp, Oryza sativa
ttgaaattgatgaaagtataataatttcttttgttggttaaaagaaaagtttgaaaacgttcgagtttccaagtaaacagttttttttactagtaatgagaagtcgttgtatagtgaagagaaaagaaggtgaggaaatagcaaagttaagggacggtgtgtaatgcttaatgggctagcttgtcggccccatgtatgatgattggatacaatctggcagtatgcatgtttatgggccgatccaactgatacgtgcataggataggagtaggactggcattgcaaaacagcagatgccatgacatgcataaatactactccctccatcccgaaatataaaggattttatgtggaggatgtgacacatccagtgcatactactactacttggcaattggcatgtacgcatatgtgtatgtgaatatatagggagaaaatggcagaggcattgacatgtgcaaatggaggaggtaggtttttaagctagggaggattggatggggatgggaatgggaatggaatgaagttgacttgagagtcaaaaaggagagatgaggaaggagggcccagctggggaagggaataaatccatccatccatccatccatttgctgcctttgattttagtttaggcggccgtcgaaggcgacccgctaggtccctgttccgacttgcgagctgcgaccatatgcatccgcgtactgtatactccttccgtctcaaaataaatacagttttgtactattcatgttcaacgtttgaccgttcgttttatttgaaaaatttttatgattagtatttttattgttattagaagataaaacgtaaatagtattttatgtgtgactaaatattttcaaatttttcataatttttttaaataagacggacggtcaaacgttcacggctgcacttattttgggtgggacatgaggtagtacttggcgttgaccagcgcgtggacttgtaatatggacggacgcggacgtgctctctcatctcctagctactgtactagcactagaaaagaaaagaaagaagaaagcagcagcaggaggagagatggacttgctcactcggcacgtgaagtactccctccagcaactagtaagaagaaaggcaggctgcaggcgtggacgctgactgtcggtcttcccttgtgaattgtgatccaatattgccaaattaataatatcccttcatagatttctctctgaccccgcgaaacagcatcagcatgcattgcaattcaactcgcatattagtagtaagaagagctactcctactcagtggtgtggcgatgggttcagctctttcgggcagcggcagcgggagcttgttggtcctctccgtctccgtcgtcggcatccttttcacctccatcctcctccttgcctactacctcttcctcgcctgctcatggcgccgccgttcccaccaaactgcacgacccacgccgcctcttccttctttcttcttagccgccgatcaaccccgccg

SEQ ID NO: 41200 - DNA, 361 bp, Oryza sativa
cggaagtaatcaagaagcctgcttagcttgcgacatcaataggtcatcaggcacgggcgcacatttttctttcccctgtgccggacgagttgaccgtatatggtatgaccctccccaaatagaacggtttaactgttacagaatcagtatgaaaatgccatgtgcaacttgacaagctttgagatctagactttcggcaggagaacttaaaagacctcttgttgattttactattgcaaatttccgtacattcactaatcacagaggggaaaatatcaaacaagaaccacagaattttgtctgctttgatttttgcttgaacgggacagtaatactagaaaaaacaaatcaactgtcacga

SEQ ID NO: 41201 - DNA, 1501 bp, Oryza sativa
ttagcttgaagcatgtgaacagataaattttgcatgagagttaaccctttttatttttcaaattctctcactacttatcctactattaaacttaaactggctcttaaaatgaacaacttctggacgtatctcggcaaaaaatttatccatagaagttaatttcttttgggacggagggtacagtgctaaaaatttttaattaggatgtgcaatgtaatactcttttcatgttcgtaatacttatcgatcgttttgaacaagtctaatgtgaaattttaaaatctttaattataaattatttctaaaatatccatatgtatagtttaatttttaaaattactctaataaaatagtatatttattaatatttttatatgtattataatagaaaatagtggtcaaacattactttttattatgttcttgttaaaacgacaagtaccatcaaaatgaagacacaactatcctggaaaaatcacggtggaccatacaaataggtttaggtcgttgcaattgcaggggcatcacactccaaattcctcaagtcgaacctctgaagtgatgacagtataatcgatagtagcttggatttttcctaaagcagctattggcacgttctaattaaggaagggagttgggaaccggcggaactcctcacgatacattgggcagtggaaaaaataaaaaatagtttaggggtaaaacttttatatttatgtttattagaggtttataaaacaatgctgaaaaatgaagtatgataaaagaaactcaatcaacttaaaaattaagttttaaaatctaatttataattatggaagctaaacgatgagaagataagaaaaggatcatgtttaaatactaaatggcaagagctgattaactatatactagtatagactatgtgtttctgatgttacaaacagttttcttttagggggtgggaggggggggggatgttacctcaaattctgtgtcacaactcacaaggttgcaagagtgcacgaccaaatgtcactgcattcatcagcgaaaaacctctctcgcaagttgtactatcaactagtactatcaagtggatgacaggaatggacaaattaaatttgctgagctgagaattttttcagttttacgttatagtagttgcataaacactaataaataaatacacaacgaggatatggatgatatattactgttaaacgcatgttaaacgtacaccttaaaatgtatgtgctcgttggtatgtaaatataaggtaatgttcgtttctacttaagataaaaataaagaagttagaacaccaaaaataagaaaaccattaacgtataattagttgagttttaattgttataaacttaacgaatagttttattcaatattttacagtaacttctacatatataaaaaaattttccgcgaaatatattatttagctgtttaaaaagcgtgagttgatcaaaccgaggtagcatgaagaagatgcctatatggtcgcagg

SEQ ID NO: 41202 - DNA, 1501 bp, Oryza sativa
gaattgacccttgattaatttaatgcttagcagccttcttatgtacttaccaaacatctctagaaactaaagctgccacttaaggtcaagatttgtttggtattgcaatgtggagctaaggcaacataactaaccacaactagtaaggtagtcaaaagcattgttcctgttaaacacatgttctaatattgtaattgtgctcactcgatttggtctattattcaagtggtgtgagatctccctccaccttgaagtgtttctcacgggtttggagatggctttggggaatccaaaataatatgaaacctcatgtcttgttaaaggcggatgtcatttgctggtcgctttgattgtacgtgaatgatatggttatttttattagaaaaacattatctcttcagcttttcatgttttattattcactaatccattggctcccataggttatactttaggagtatgcaagatttggtgattgcgttatgtctgcatctagagaaagtggtcaaggtgtttattaccctatgatgtggatggccatctagacgttgattggccataaaacttcatgtattttttattttataaacttgagggtgtgtgtgtgtaactatgtgtccttgctatgtaaaagctgagggtgttctcacttctcatatagatgtgtcttctcgatgtaattggtttttctataggctatgtaattggttaagttgaataaaagctattgttatttttaaaaatccaaaaaggaggggatgaaaccttcttggaccgagtcagtggaagttaactggttaagagactgcaaattcaattgtaaacaaattttccaaccggagaaatgttaggataaacggcattacaattatctataatcattctctatacaatggaaatggcaaccatgtatctcaaacaaaatggcaactttcacttggtcatctcctatctcttcagttggagtatccattcatcacatttactggtaggagaataactcaacgattggtgctggcaaatcctatatacaaacaattaaaatcgatgcataagcataactaggtacatctgctggtacaaaccaaacaaagtgagcaacaccagacgcatcatctacctctactatttagagcttactgcaaactcagcaggacatgaacatccatccagtagttctttctcgcaaccaaaaagggaaaaagaaaacactgttcctgattgatcctgagctcaactatgcctacccatatattctaccgcttccatctctgctactcacacccgggctaaattacaggcagaccaaacaaaaacaaccagtcaccacttcgacgacaaaattcacagggaggacacaccgattaagactgaacttcccgcgcgttttcgactttttttttccttttctttttttttgtttgcctcaaagaagaagaaaatgcggcctaatggtgaccacgacgacgccggcgaggcgtggcgaggtccggtgaggtga

SEQ ID NO: 41203 - DNA, 1501 bp, Oryza sativa
aatactccgatgtatacaagggatcaagcaaatctcgtgggcgtagaaaggaccgcgtgaagtttcaagggtacttaaggaattgacccttgattaatttaatgcttagcagccttcttatgtacttaccaaacatctctagaaactaaagctgccacttaaggtcaagatttgtttggtattgcaatgtggagctaaggcaacataactaaccacaactagtaaggtagtcaaaagcattgttcctgttaaacacatgttctaatattgtaattgtgctcactcgatttggtctattattcaagtggtgtgagatctccctccaccttgaagtgtttctcacgggtttggagatggctttggggaatccaaaataatatgaaacctcatgtcttgttaaaggcggatgtcatttgctggtcgctttgattgtacgtgaatgatatggttatttttattagaaaaacattatctcttcagcttttcatgttttattattcactaatccattggctcccataggttatactttaggagtatgcaagatttggtgattgcgttatgtctgcatctagagaaagtggtcaaggtgtttattaccctatgatgtggatggccatctagacgttgattggccataaaacttcatgtattttttattttataaacttgagggtgtgtgtgtgtaactatgtgtccttgctatgtaaaagctgagggtgttctcacttctcatatagatgtgtcttctcgatgtaattggtttttctataggctatgtaattggttaagttgaataaaagctattgttatttttaaaaatccaaaaaggaggggatgaaaccttcttggaccgagtcagtggaagttaactggttaagagactgcaaattcaattgtaaacaaattttccaaccggagaaatgttaggataaacggcattacaattatctataatcattctctatacaatggaaatggcaaccatgtatctcaaacaaaatggcaactttcacttggtcatctcctatctcttcagttggagtatccattcatcacatttactggtaggagaataactcaacgattggtgctggcaaatcctatatacaaacaattaaaatcgatgcataagcataactaggtacatctgctggtacaaaccaaacaaagtgagcaacaccagacgcatcatctacctctactatttagagcttactgcaaactcagcaggacatgaacatccatccagtagttctttctcgcaaccaaaaagggaaaaagaaaacactgttcctgattgatcctgagctcaactatgcctacccatatattctaccgcttccatctctgctactcacacccgggctaaattacaggcagaccaaacaaaaacaaccagtcaccacttcgacgacaaaattcacagggaggacacaccgattaagactgaacttcccgcgcgttttcgactttttttttccttttctttttttttgtt

SEQ ID NO: 41204 - DNA, 403 bp, Oryza sativa
tatagggccaattcgagctcggtaccccatcagaccgacctcaggaggccaatgtccgatgtggtgccgggggctactgtcggagatatgggcccgggagtatgcgaagtgaggggaatctaccttcccatcctgccacgtgtccctacagcctggtcctgtccccgtattccgcgaaccgcaggagcggctggggggtcggagcctcggggtgccacgtcatgcccctcgggcccttgcactactttgccccgaggccctcgcccaaccgccgtttggggggggggagcaagcgaggagggagcccaggctgaacttcctttaatgcgcgcaacgccccaactgccccatgtcgcatttaatgcagtggggcagacgtgcggcgtgctaaactgacgcgcga

SEQ ID NO: 41205 - DNA, 574 bp, Oryza sativa
tgttcgactcgaactctgccgatcctagtcacagccgattcggacttcagccgatcctcactctgtttccggacgatctctatctcgaactccgtctcgattccttcttcacatccgatccttggattaccaaatttggtcgttaacagcgtgttgcatgtagagttgcatgtgtcatgcatatttggtttgttatttgcatgatcgcctataatctttatccaacaacaacgatttgactcacatatcctaaattctatatgaaaattcatatcaatggtgaattgcatttggagattaaggtgacagatattaactcacgtatcctaaattcttgtatgaaaattcatatcgatggcgaattacatttggagattaaggtgacagatattacactatatctttaagagctacaagatgggacttatattcacatgtaactgcgcacatacatactacaaatcttgatcatacactacaccctagggaaatgaacattaatagataatcgttccacaactctggcttaatgtatttctagggctgtgggggagggggaagggggttgttacca

SEQ ID NO: 41206 - DNA, 1501 bp, Oryza sativa
actttcttccaagctgaaaagaaggacacaggttaccagatcataaaaaaaaatgtgaactaagttatcttgtgcacatgaaaaatctgtagaatgaaaacaaactcaaattccatttcactggtaaattaaattcttgggtgttgggcaagccaggatttttaatgcaattgtgcatgaaatgtttataaactatgctggttcattatatccgctccccttggatgatttaattggtgcatcaatgccattatttcgtgaaataaattttaagcctcttcaatcatgaaaaagacaacttaaattgaaccacatcaagaggtgctaaaaaggaagggtaaactatacaaagtctaaccacgtttactattgttgcacgccgttgcctcccaccatgtaccataacagagttccatgatgcactagctaaagccgctcgacacgaaatcacaccttgaactgcagaagtagaacaaaaaacaaatcacctcacatgtacaacattatgataacagcaatgcagtatatcatatcgtagtaaacaacggcaactttttaattcaggactgatcacaaaaatagcaaatacatgtgagacatgaccctagctgcaacaaagctgtgacctttcacagtctctgttaataatttctggtatatggaggaggcaggtaatcaaccagtcaccaccaccgcaaactattccaatgaaggacagttcccttatctcgctttacatatcagcaagtacatggcttaagcacaactgaagcctattagtgctagcttctcatctcaagatctagtgcagtttcacatggaaggtcctgaattcctcttgctccaataaacatggcacaaacgagtcagtagccactactcaccaccctaacaaagctcaccactcaagagaaagagtgtggtaactaagttgtcactatcgtctactggcagcaagggttatctaccataaatggcaggagcccatggtagtgcgagaaagagctgttcttggattgggagatggttacctttgggaggagctgccaggaagagtggggaagataatgagagagtggacatcatggctccctcagcttatgttcctgaccttcttcgagctttttgttttttttttccactctctgaaccttctatcgaatagagaagcactcaagcttgttatttgatctgcctcactttttttcttgggctttttgacggacctcgtaaccaagaactccacgttcggccacaagagttgtgcagttgctgagggtgtccactgccaatttgctgtttaatactgtttttcacgaatatggtttacctacatacaaattcggggcacggatcggtcagattccaaattgtcacagataggctaatggatagcatatggcatatgcataaagtaaaaaaaaaaaagaagaaaaaagatgcaacttagatgcttggatcacccttcacacaatgtgctcgacaaccatttatcactgtt

SEQ ID NO: 41207 - DNA, 1501 bp, Oryza sativa
ggctctagctcacttctctttgcttacaatttcagaaatcaattccatcgtacccctccaaaatctccttaattacggtagcttaccacgctgctgcgccatccaacctccacagaaaatacctttaagacaaggtctaaagtgcaaaaatacaaaaatagtttggcactacattgatttattttgtatttggcactgcaaagatggtcttgacgttccgagttagcccatttgatggtggaacacaatgtgatctcctgtatacatccgcaaaaccacaactccacagctcaggctgtgtttatagttcacgctaaaattggaagttcggtttaaattggaacgatgtgacggaaaagttgaaagtttatgtgtgtaggaaagttttgatgtgatggaaaagttggaagtttgaagaaatattttggaactaaacacggcgtcactactcatactcaatctttggcattggcgtatcaagctgatgacttgtagtggttacaatacttttgatttttcaagtatggaagtgtaagacattttttcatgtcacactttagttatgcccgtagttttgctgccccatcgagctcgccaaatctagcctcgggttcgtcggatctggcgagcggcaccgctttggggacgatgcagctgattggggcggtggcctcgccggcgaccgctgccgcttcacacggatgtgggggtgtcgcattaggccacggtctctcccaatgcgccgctcaacccgtacctcatcctgcacctgcaagttttgacgaagaacatgtgacttagtttggctccgcggacttcggttaggaacgccacacacgcatcttgggagagggggtggaatatctgatgtggatggttggggaaagaatgccacctcactgcattgtgaacgccctggcagttctatcattcctacttctatttactctgagattcacctcaaccttttaatccaaactctcaaaggatgccccgatttggccaggcatttcggcgaacgcatgtagttggctaggctctactccatcattcccaaaataaataaactttatatgaaatatgatacattataatattacaaatttaaataaatctctttatggtgctatattttatagctgtatcatggagcctgagaacgcatgacacgacaaggcaaccgaatccgtacgggaaaatgcaacgaataggcaggcattgacgaaagcaaaattaaaaaaaattatcacctggtcccgatcgttgcctcgttgcgcatggctgcatgggcacttccgcacgcaagtggtgacactcgggtaaagctgcgcggcaaccgcatcgtgagggtgaggcctagggccagtcggccagacaccgccggtgcgtgttatatattggatgtattggtgcaatgcgatgcgaaacactcgctctcttactctgtcgcctactagtccacctctcactgttgttcaccgtctcctggctcctgccccac

SEQ ID NO: 41208 - DNA, 393 bp, Oryza sativa
tgtccttcctgtcgctgcctctcctaaccttgtgagacgatgacgatcccccatgcaacaatgcgttgtgtttgtttgttaggcaggcagcatgagcacgaggaggcatgctatgctatcacattcacaccacgtctctctgctgcttctcatatcatctcatctccctcctttttagttatagatagatagtacattagagattactgtactcgaagggagagagatactcctagatagagacagggaaagacatgttatgttattattactagggccaggcggcaatcaatgggttgctttcgaacgctgttccgagttggtgcaagtaacatggacggattattggatcatgccaagattcctcctcctcttcctccccctttcaaaagc

SEQ ID NO: 41209 - DNA, 208 bp, Oryza sativa
atctcaactaaaaattatcattaccacatatatgtacttaaaaaaatcataacactaataagcgcactgtacacatgtaacactacaatcatcaaaccctcaatttcaacggtcaagatcactatattagacaaaaaaaaataggttatagggttatccttcgatctacaaattccactaattaaaacgaaaaaacaagagaggggaa

SEQ ID NO: 41210 - DNA, 617 bp, Oryza sativa
cctacaaaaatcagacagacattcagagtatgaagtgcagtcatgtgcaaagtaatttcggctatagtgaaccatgtatgtacaatataagtgcttgaaaatgttgggcagcagcaatgatgtaatttaagttttatcctccttacaagccccgcagtactagtacaagatctttttatcaaaactgtatgttacttttaggtcataaccagtaaaattcttgataagttctcacaatcagctaaccagacaacctgcagtatgattgccttcagcctaaactttggcaagtttaaatagtgtgataagactaaaagctcataattcttaacccagtttggttcaatacattcagaccataataaattttcctcttacacattcatattcaacttaacagacgtgcaacaccactttcacaagaaaggaatgaaggattagacatggacttatactattagtattatcatggacgtcctgtatagcaaaagcccatttaactgtcaggctagccagtacattcatggccatgtatgcaccagcagttagattttgtaataggacccccagctattaggaatagcatatgggtcataagcctatgcttatatatagcc

SEQ ID NO: 41211 - DNA, 1501 bp, Oryza sativa
tttttggtaaaccgcccggttctaccggtttgattgcacaccgatcttttagctggaccggaccagccggcgccctggttccttttttttccagtcggatcatcggtctggtccggttctaataactatggtctgccgtgtaataaaaaaaaagagagctagagtagctactacttgtaatgagtggtcacatcattcgaattcatatagtaaacattgtaaccaaatgtctataaaatattatgtttcctataacacagatattctattatctttatggatccaccatcttcttctatctcttctctttcttcatcccacccttcattctaatcttcttccttcttttctttaccttctcgatgactctctctcgcaaatgatgccagctcgagtgcccggtgaggacaatgggctgcagatgggagagggcatggtagactccccacgcgcagccatggtgaacgagaacaatggtccgacaggcgcaggcgacaacgacagtcacaacgaggacgacgacccgacggatgcaggagacaacagcggctagcacagttgtctgagccaccatcaccatgggtagactccacaatcttgggccgcccagtgcagccaggcaactaattagtcactcgcatattttctcttcccctctctccttcatattatcacaaaatcctatatggatttttgatccccgatttttttcatgctcttaagtgtttcaaatttcttgaagcgtggcaatcgtgctactaaccattaataattttatagttcacaaatcatactcaaaccgtttgtttggatcatttcaatccaaacattaccaaaagattggcaatagtaaaaaaaaaagtaaatatagtttttggcttgttgccaaatttcggttggtgtttgaggtcaaatttgttcttccaaaaattttggcaattccacatttttggcgcaaaccacttgttattgaatgttgatcataagccttctcagctaaaacactgaaccgcttctaccaacggatcatctaagaggacagcatcacagcagccgtacattgtcgaacacaaaggaaaagaacagatgcagcaggccagcaatgatcgatgcatgtaaactaagttatctgcacggatggatatgcacttgtgatcaaagacaagaacagattctattcttgaccaccatatatggatggaccgtggatgagagatggagaattggatattcctcccttgtggagagcaaaagcagagcaatctctccaggtggcagaaaggatcaaaggaatacttggctggcttacttgcaaagcaaccaaggagaaatatttgctgcgatcttttcagttagaaaaactgcactttttagcgtatatattggctcccgaccgatcgaagcgtcaacacagcagcagcagcagcagagtgtgttttctcgcgacgccgttgtgatcttctcctgcctcggagagcagagcaagagggaagatcagcaa

SEQ ID NO: 41212 - DNA, 1501 bp, Oryza sativa
accctactcctgtgtatgggatttagactgagagttacaagggttcctaaactcgggagaacactcttacttccctcctccacaagctcaggttttctgagagtcgtcccccctctcggagggcaaagtcctccttttatacctcaaggggataccacatacaccgcctctacctactcttctttcgggagaggacccaccctatcttgactggaactcgacctgtgccttcgcctggaaactaaaccacagcttatccttgagcggggcccagcgccgtccctcgcctgacacgggggatggccctgtcattccctcattaataggtgaagacttgtggtggccgccgtccgaatgaacccccgatgggacaggtcatacctacctccactccgctggaagtagatgcgacgtgggagcacggttgtccgtccagtcagacatgaccggtgtcaggccggtcacagaccggtcattcttgaccatcgcgcgtcagtttagcacgccgcacgtctgccccactgcattaaatgcgacatggggcagttggggcgttgcgcgcattaaaggaagttcagcctgggccccctcctcgcttgctccccccccccaaacggcggttgggcgagggcctcggggcaaagtagtgcaagggcccgaggggcatgacgtggcaccccgagggttggccgaccccccagccgttcctgcggttcacggaatacggggacaggaccaggctgtagggacacgtggcaggatgggaaggtagattcccctcacttcgcatactcccgggcccatatctccgacagtagcccccggcaccacatcggacattggcctcctgaggtcggtctgatgtggtgcctcacgacttcccaaactggtgttgtgggcccggcagggaatctaagtggatgccgccgagtggccaggttggcgtatcaacaacaacagcggtttgaccgccactgaccgcgctgatgatgaggatgcttaaggcgcgaaaatcagggggttggatggactgcacctagactccctcacccgccacgcatgcggcggtactggtgacggttcgcccagattgcgcccgtgaccgtcgcacgccctacgccgagtgtgccgctgacaggcgcactaaatgcgggacgcggattcagtgggcgacgtgatgagtggtcgcaggaaacgatgaggcaactgcaggcgcgagaatcgtgggggcaaccgagagggcgtgaaacaaggaggcgagcgcgggcgaggcagggataaaaggatacggaggcggggactttgccttcttcctttcgccaactgctcacccgcacactcgctccctaagccctaacattctcgccactccacgctactccgcacaccaagcccctcgtcgtttctccgccagtcatcatggctcaagatgccagcgacgcagtgcttccagcatcgcgcattatggcggataggcaccttagtctcccccgcaagatca

SEQ ID NO: 41213 - DNA, 1501 bp, Oryza sativa
gacatccaaacaatattcgtctctacaaaggttccaaacttcgaatcaagtatttgatttacgatcaggcaatatactcctaaaaaagttgtgaagtatgtccttaattgcagcactgctgggcggctgcatcgatcatgggaaaatatagtgcaaactccatatgaaatgcaaacctagaaactatcataagatacatagacaggcatctaaacaaatggacgtccaagtatctcaagaagggtgagatcatgggcctagaccacttgtgcgggatctgaacaaatgagcgtccgagtatctcaagaagggccatgggcctagaccactagtgcgatcgcctagagcctaggccggtcaggggtccatcactaaccaatatagctagcaggacgtcattaattgtccgctctaatgtccaactcccaagtggttacacttcatcacatcgtgactaggttttacggtaaggtaccgtgatcttctcaattttatatctatttagtctaaaaaaattggttaggattttgttttattctggttgtttaatttatttcacaagtttaagtgtatatcatgttagtattgttcacttgtgccactttagactatacatggtttataaagtactctctccgtagtgcaatatatactctctccgtaggtgcaatataaagtcataattgttgtcctatcgcggatgctgatcattcggaaaaaaataaaaatcgttgtcctaggtttgtccccgttcctggaccttcctgaatcccggtaagtacgtacgttccctgcgccgtggacgcgcgtacatctgacaattttgcacacagcacacatgtatactaatgggaattctgcacgttgctacgagaaaactgtataacaaaatagtattgatgagttgtaaaatttaattttcttactatataattttctttcatatgttctctatagtctatatatgttaccctgatcaattatccaacgattataaatgattgtgatgtacagtgttgctttttgagaagatagacaatttgaattcttgatgaatcattaaaagctaaaaatagccgaaatgatgcgacttcataatagaaaaaaaagttaaatatatatgtatgggcatgtttagattgtaactaaaataaacattaacaagttttgtcaatgctaaaattttggcaatggcaagatttcttatgtattgactaaatttggtaataaactaaacgtagatattgttttttaactttgcgaaacaaatatattatggttgaaaatgacatcaaacaggctctatggttctggagttccgtgcacacagcaccgctcgctagctccctccgtcccgctacctatatatatctccatctcgagtgcctggatcacatcagcaaattaatcaacgggctcaagcgttaacacacacacacaccgatcaccgaacacgtctgaattcgccacgggcgacgcgccgccgccggattcacgagga

SEQ ID NO: 41214 - DNA, 1103 bp, Oryza sativa
ttcacatattgagttatgtgcaatacaaacctagaaaggtttttactacctcattaacacaaaaccctgtgctactgcaaagggctaaatggttcagtctgattggatcgcattgtgtgcgataatggttgagccgttacaataaggttagggttagattttttttgagaagtgcaaaaagataatgaaacactggtgcctattctcgctatacaaattggcacgacctagagcaaccacggtttagatggccagctccggtaacaccggctttgcaggttggggttagatcgttttgcactatataataccaaggatggagtttttatcgagctggtagaaataaaacggcttaatttggaattatttactgatggcccatgacttgttttcgtgctaactgcagaaggtgactacttatagctttgtacagtaacacggcaagagttgggcactttcttgtgtatttgctagtataaatttccagattgtctgacatatttttctagggagaaatgaccccaattttttccatcgaagaaaaatataaggacggtctgaacatctgaatgtgagatcaacacattcgagaatccaaaatagcattatagaaacagctagaaaagaggaataaagacatatcattcaaggataaattattccactgttccagcctccaggaggtcccgacgcatcgttaatagtccttagctcactgcaaatattttgttgtgaggaacatggcgcaaagttcactgcaaaatttaccatatgttattttccttagtctatgattcactccttatgtaattaagtcgccccttccctcctctttctctctcgacggactatgatccattgttaataactttttatctttatttttctcctcctaatataaccggcagtcctcctgccatataccatttcaaaaaattagtatgatggttattgcatgtggatgatctgaatatcaaaagtaaacagcgctgcatcttttagcttttgtatgttattgttctcaagattttgcatgctagatcacaatgtaatcttcatatgtgcttatagccattctaaacttactgtacctttgatgtggt

SEQ ID NO: 41215 - DNA, 1501 bp, Oryza sativa
taggtatgtggtatccataaccctgacagtagcccccgacttcgatgcaaatgaacgagttcatattctcaaccacacactttggaggaactgttatcgagctcacgtaaccgttctcggtgagtttagagataacattagacttcctttatcagcctcgtgcgggcaccgaaagggtttgtctaagtcaatctctgatgtcgaccgagaaagtacagagcgtacgactaagtctcccgtcttgctgtaatcgagaatttggattgaagtcaagaaattttatctcggcgggtacaccatttcttcattccgtattccttgtcaagatccagcaactgttctcgagcgatcgagaaggcgtagagtctgcgacggagccttgtcgacatttgtcgtactcgccttagtcgatcttggtgtacaaccatagagacatggagccttcgtcattgtcgaatagaattttcttgaaatcaatactaagaaaagaatattagatagaaatagcccccgagcgaacgctcaaagggtaacatgttataatataacatactagtgaattgaatgtacagaccagtgttttgtatatgagcgtcttctctcttaccgactccgatcagtcagtttgtggagtcatacactctccctagcccccagccttgtcgtcggagaattgttctcggatgataaggctcttggacctttgacctgccttggttgaacaagcactgatcctagccccaagccgtgaagttggaaattccatttccgattacacagcttggttaatacgcacggcgagaactattacacgaccagatcttacatggtctttcgtctctaaaggatccgacaaggccttatcggctctgggcgtccctagccgaagttcccttaggttcctcggaggccttgtcaagacggcgtaaagggacattaggataggtttcaacgctaggtgtcatctgggtaagggatctctgggtaaaacacttggtgatcttgtgctcctgatatcaactttgttgaagcaggggtaatgggagaatcgctacacctctggtcgaggaccaagcagtagtcgtaactcgaccacttgggagaaacactacaccgctggttgaggaccaggaagtagtcgtaactcgaccacttgaagtggaaacaatgggagaaacgctgcatcgctggtcgaggaccaggaagtagtcgtaactcgaccacttgaagtggaaacaatgggagaaacgctgcatcgctggtcgaggaccaggcagtagtcgtaactcgatcacttgaagtggaaacagtgggagaaacgctacatcgctggtcgaggaccaggcagtagtcgtaactcgaccacttaaagtggaagtagtaggagaaacgctacatcgctggtcgaggaccagacagtagtcgtaactcaaccacttaaagtggaagtagtgggagaaacactacatcgctggtcgaggaccaggcagtagtcgtaact

SEQ ID NO: 41216 - DNA, 358 bp, Oryza sativa
cccctcttagcccctgcctcttgcatatatgcattttgtccatttcgttcatcatgcttatccccttatccaatcttaccgtaccgtatgatgcctctttagtctttactgattttccacaattaaaataccccctttttcatttaacatgtcatgattcataaaaaaaattataatataatctcatggaaacttacgaaaatacaacacatatgaaaataataataattaaactgtttgtttctactctgctacttttcaatcactggaagtaatttttctcagctaacggaagtgacgcatactagacagtactaaagttgtccagaacacggtagtaatgccttttatattcatt

SEQ ID NO: 41217 - DNA, 1501 bp, Oryza sativa
caatcattttattagttaattagtttcgttaataagaacagttcatgtcagtttgagtaatcgtgggatcagattttagttgatgctgttttctggccaatatgcatttgcttcatgttgctgttcctatctgcttgctcaaggatgctaaagttgatatatcggagaaatgtttagtagcaggcttaagccatgccaaattcaatcgttattcgttagtactacacaagtaaataacgacgtcaaagagggaggtacatgaaattctttatctacctacaaagtaaaaaaccacatgagagagacaagtgtgtgaattcatatctatcatacaaagagatctaggttgcatttcttcatatagatcctgtctcatcctgggtagttgtaacgcaaactttccaacgaatcaaaccagagcacggctcgatctggctgatgcatgtgtgacatcgaatccccggaaacaaagacgatcgtttttactactgttctatctcttcatctagtttaattaatgccctgtatattcgatcgtgcatccatgtatcagtgggctcagttaaacaaagcagacgcaggcatgcaggagatgaaaacgagcaacgcaccctcgtgctgcccgaaagacagtgtactctccacactggcatgactcatttctacgggtgaaaacagagcggattcagacgaataatggtcataccatatcctaaaccaggattcagagtgggtgcggataggatacggatgcgcatgcggagcggattatttcggatgtcggaaatagtgcggaatcagttcgaaaaagattaaatttatcggatattacatgtgtatacaatcaatacaatattaagttagcaatgcaagaaacaataatacaataatcaataaacgatccatcatactaattatgtgcttaagtgttaaacaatatgaatacatgatgtccataatataaaaatacagctacgcaagtatgccatgagaaggtgaaagcctcagactaagaaatctatgctaattgataaattagtgcattcgatagaccaacttatgttatatgcaatagatagagtgattacatgtgttgataaattcgaattatccggcaaacggccaatcggataatccgatagaaatgtcggataatctgcatccaccggattttagagataccatatcctcatccgcatccgcattatactatcctcatccgcattcatatccgccggatttccaaaagcccataccatatcctcgtttcgaacggattcagagtggatcggatctatccgatcggttttcactcctactcatttcacacaagatgaggccatcaccttgcataaccgattttacacaagctagatgaggccatgatctcctctatataagaggccatgcagtctgtggcttcatcactcaccagctacgtacactcaaccaacacaccactgaaaagcaagattttgttgaagaaataagcatcttgcca

SEQ ID NO: 41218 - DNA, 1189 bp, Oryza sativa
caaaattctccatgcattttggtttctgtcattctttgatgattaaggaactttgcagattatctaaacttggggatttatataccctttttgtctatgaataggtgaattgcatgaattgttgtttatatacatgatttatatacccttgctgctgctgccacataaataattgtgggctgttttattatctacacttgattgaattgaatggatgaattgctgtttacatgaagttagtagtactgtctgtttttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttctttatgcataagaacagattttctgcacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattttgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaacca

SEQ ID NO: 41219 - DNA, 580 bp, Oryza sativa
attgattggaactggatgatcggtgaagtcgaacagtctaggcggggtggctattgacgcaaaatccgttccaacacgcaaaggctaagagatttgtttgactatagtgcacgtccttaatattgggttcagggcgtgctagttggaagttgcttcccctgaagtatttttttccccttgattttccaactgcgtgtgcaattttgaccatgatgcaagcaaagtgcaaacaaagtgtattagaaacacataattttctggtagttcgttttggaaacaggatttgcttcttgtcttccaaattgccaacagaacagacaaacaaatgcagatgtaaatgcagataatcgctgcatgagtttgggtttggcatgcatgatgcatccatatgaacctgaacattcaggacaaaagaagggcaaattgtgccattaatctcagaatctaaaacaggattcagattgcaatcagcttaccggttcccgtacgtttgcataattgcatgtaccgacaagttcaccaattttgcgtacgcagggcgtgagcctgaatttcatatcactagccgaggggatcacca

SEQ ID NO: 41220 - DNA, 1450 bp, Oryza sativa
agctcggtaccctgcgctggcattttgttcttgggtaaaggcaaacattttcactcttttgctggatttgcgaatcgtcctcttgtctttttatcctaccttaattatatatgcatgcatggatgtcgtttccagaagaaaccacatacgatgaccctgactaaatcagaaggacatgcatgagcttcaggacgactatagagtcagcagtattgttgttctggtccacctagctagacgacatgctgggctgtatgagctctattgatcatacatattctggcccaaatgatgtagtgttccatgggccatcagcttaatatgggcgttcaatcattgttggtctggcccagatggttgattgacatattatttggggattaagttcacttgactcccttaattagtggtcgaatcacctaattattaaaactggtgtaatttgacttcctcggtggtttttggagggtagtttcactgacatggcgcctatggtgcggtagtaacctggtcttcgttctacgtggtgttgacgtggcgctaatgtggtattagaattaaggggttgtacagattgatgccatttccaaccataccatttttgataaagttgctaaagatgtgcatacatttatttttttaccaaaccttggtaagtatataagaaatcctatcaaaaattgtcaataggtgtcaacttatcaaaaattgataaagtttattttggctacaatctaaacagcctctaaagaatatgtgtgggactcatttgtcattcaataaaaaaaatactgtgggactcgctgacatggtgaaatcaccaggtaaaacgccaaggtgaagagaaatgggagagaaagagagagaagggtgagagggagggaggaggaagaagcaggatgacatgtgggcccacatgtcagtgggtccctcaaatttttttaaatgttaaatgggtcccacacatattttttcaattctaatgccacataatcgtcatgtcaataccacgtggaacgaagactaggttaacaccgctatgtcagcgaaattgtcctccaaaactacggagggagtcaaattgcaccaattttaatagttgtggagagtcgagatatccggtattgtggttcagtgatacgaattagatttggccactagctacgggagttaaattgaacttagtccttattatttgagcgtcatgtttagctagtgtttgtcatattgtagtgttgattatttgaagcccagcaattcaattctattattaattgccgtcatgtttagctagtgtttgggccggccattaggcaattaaacctaataatctatctggtcgtcttcttcattattccatccatcatatctcctgcgtgattgttaacctctgggggttccttcctttgttcgggcatagaattgaattagaggcaggatcaaatcaaca

SEQ ID NO: 41221 - DNA, 1501 bp, Oryza sativa
cgtggcattttaggttcctcaagtgagtagcttgcattgctactggcctaaccgagcacgccatgtgtcagcgtgtgactactgcatgcaaagtctttttcactcttgtgtatgtttagttctctcttggttaattacatgatgagggtcaggtaaatcttagggataagtctacgggtcgggcgtctgatcggtttggagaaaaatcgggcgctgacgtcagcgcccgatttacgtgcaaatctacgttaaactgatttttctcttaaattacttatccaaatcataatttgactgcaacattaatttcgttgcaattaaatcttcaaaacaagaccacacatggatatattccgacgaaatttttttagcttattattgaattatttttaaatgttgcacgatgttccactagatatatcggaattgtttcactaagttgatcgaaaatgtttcactcgtttaaatcggatgttgtttcaccttatataaaaagaatgtttcagcaaatagcgaaagaatgcaaaagaaaatttcacttcactgctacattagatctatacatagtgaaacattgtgagtacattaggtgaaacatttttggtggaaaaagaagtaaaccaaattcccttaatagagagttttcaaaatatgtgggtgatttgttgcaaaagaatattttaattcactgtaacattagatctatacatagtgaaacattgtgagtacactaggtgaaacattttctgtgaaaaaaaataaaaccaattcccttaataaagggtttagaaaatatataggtaatttgttgcaacgttatgtgtggtggggataagtgacagtgtggcaggaaagatgtgatgggggcgtccgatttttcctacccccgagcgcccaggaaggagcattatcaaaatcttggtcaaagaaaaaaaggttaggtaaatctaagctagtttatcaaggggtgtttaaaagagagggactaaaccaaaaaattactccgacttatatttttggagagctctcttccaaacaccccttgagtacgcacgttgttgaacgcaacgactccggggggtcagtcgtcgaccgcgtgtttaccgcatttattcacacgacttttcaacatctctgcagtatccccagttccccactaataaagaaattagggtaaggaaccaagatgtacgacgattatcccagctctgttttccggtatgaccattgatttgtatccatttgataggctgatagctgcgacctgcacgcggagattctcttaagcccgagtgacggaggtagtcatcaagtcatggtttctgcctataataccgagcgtacatccgagccgtagcgagtagctcgcaaatcgcaagctaacacagaacagtaatttgatattcacttgctcggagtcggagctctagcttggttcatcggttgcatacttgcatataccaccgtgccatgccttacctcgtccagctcctcctcctaa

SEQ ID NO: 41222 - DNA, 749 bp, Oryza sativa
cctataagtgaaatgaagaagtaattttgacattagtgctaataacaatcaattgtacagatttttttgtaaagtatataaggagaaatttgaatacccttagaaaggatgattttgggctcaagaatgcttgtttttacacaaataatatcacaaaacacataatatagctatgaaatcataagttccaaaaaattggggtacaactatagctcatgtttcattggcacacccatggtttctaaggaacacccgtaatcagtgtcccgagatataaattttagcacaatctcattagtaaatatcatatctcgatgtggttaattatcttggtgaatacttatgacgtattttcgtgtttagttaccgatgttctataatagctcgcatgaggttggaagtaatcaggcaacaaaattagtgttcttcaagcaagaatggttgtcagtttatctcactatgtgaagatcgatctgtgaaactaaaatgagacttaacattaactccaaatagttgcccttcatgattgatgatgagtctagctacgtactgtactgcccaggctgacagctgagcggtcacaatcaaactagcaatcaccaccaattccgtgcagacgtggacgaagatgaaaaaactcgagctcgctagcgaagtccattccgactcgccagccgtctataaaaggcaggcgttacgcgctatcgtcccatctcgaaatcaagcacgaggactcccaagtccagcca

SEQ ID NO: 41223 - DNA, 248 bp, Oryza sativa
acgataaggtttggtctttcgaagttttaagacgacgagatagctatttaataaattttaagtaaaatcatactgaaaaatatatgattttgtttgggggctagccgcgcaattgcgcgggccacccagctaatttttttctaaaaatagctaatacttaattaatcatatgctaatggactgctccgttttacgaaagatgagttgctaacacccaccaacgaacactactcttatatatggatcga

SEQ ID NO: 41224 - DNA, 553 bp, Oryza sativa
aaaacccttctctattagaaccccttcagcataattattttgtaataaagctacacataaatacatgttaccgttttggataaaaccctctatgggtagtatattgaaataaatacccttttaataaagaaacatagctatggctattttatacgaacctttgaaaaggaatttgccttcggaaaattaattacaaaataatatatattagtaaagtatttattaaaaaccctatttgcaaaatataattcataataggctattttcaaaagatatgaccttctcacacaacgtctaattttccctcaggtatagcctagtttgcatgttaggatttattgtttatttgtgtgtgtttagaatttgtgccatagattttgattaaaccctatctctagaaaggacaccctttcctatacctttctttttccatccttaccttctcttaccttcgcggtctaatttgttatgtgcttcgatgctaaataaatcaatgacccaaaacttttttgtcctatcgcgatattgttgctctctcaaactctcgcccagc

SEQ ID NO: 41225 - DNA, 1360 bp, Oryza sativa
tataaataataagtggtaagtcgcaaaatgcctttttcatgatatcaagaagataaagttacatatgcaagtaggacaacatggtaccgatagcgtgtgatataatatttttgtgcttagtagtagtcacttgcatgcattttcttaatcttaattagtgctacgatgtgtgaggcctgcagcaaagtcatccccatcgatcaattcataattatgtgcttatgtcgggacgactgtttgttatatatgcttgtctgttaagaatgattcaatctttgactgattcaagttcaagctatataatagataatatgaatgatttaactctatatatagtttatgctaagatagagagatatattaagaacataatgtctatttatggacaaattaattaagatagtacagctagtgtttggatgaatcgggaaaataatactccaaatgtctatatatttatggacaaactaagaacaaagaacaaatttagaacctaaaacctaaaatttctttatatatatatatatatatatatatatatatatatataggacattcatatggggcaccatggtgcccggacaccatggtttcaaatgcacaaaatcactcaaatttttcaaaattttcaaattgtgagtatatacctagttataagaattcgattcatacctatacctatcaacaaaacaacttaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatatatatatatatatatatatatatatatatatatatatatatatatatatggaccgagggagttccatatatctcacattaattgtatttttgttttcaggtgattagattcaatatcattagcaacactaacacaaccaaattaaggtagcacgcatcattagctccgctcttttttaaaatgttggcagaattcctagctccgctcttttttaaaaaatgttggcaaaatccctagctctgatttttttaaaatgttattgttaaatgaataaaatttcttatattttgagacgaaggtagtataagatttgcgctgttagcaataacactagtattacttaaggaaaaaaaataaagaccagtgagagttagagagt

SEQ ID NO: 41226 - DNA, 1128 bp, Oryza sativa
cttaatggtcaggcataatcccaaaatagtgatgttaaagatattgctgttaaattatagaattctcttatgcaaatgcctattttctaatctgatcttatgccaagaatctttgatgttggtgttgtggtcaagtaaggggaaaaagtgtagcttgaacctcccgatctcagctatttctgacctctaaatttaggtaaaggccaactgaatgaagcaacaagtcgactacaaaattttccaggtcatttcagaaattatacattattcttagaacctttgttttatgtgaactggaactgttgaattgtacaaaatatattttgttttatggtgcctctagctaaatatggagcttaatttcctacacggagggatcactcacctccaccatatcggtacgataacattttgtagtaagatggttcatgtaatcttgtatttagatgtgcttgattttataattgtggaaagaactaatttgtagcttcaaatgcaattgcttcaggtacaacaaagcactgccattttataatctctttcgttgttcacatttcaggagttacatataagtattttcatttgagtataaaaatataataatgtgttgagatgatgattgtgtggtgactagctctgataattgataattttgtttatgctttatacaatgtgcgtttttttagcactgatcaacatgagattgttctactgaccagttaacttttttgcacgcttagtatttatgttgcattgtttatgccttggatgtaaatgcaacaatttgaaaaaaaacctatattgaaatacgtacgtaggaaatggctaccgcatttattaatgtcaaagcagatagttggagataaagaatcattttttatgacatggtttaagttatatatagctttcctcaaggatataattttaaatcatacctattgttggcaactttttgtgacaagtcgacaagcacgattgtaacacctaaatgccttgcggtgatatggagtcgccaaccacctcaatctagccaaagggccaaatcaagatgggttttgcaaaaagaaaagctaaaccggctagcggagccgatttatagatcaaaatcagcctctacgccgatttaga

SEQ ID NO: 41227 - DNA, 553 bp, Oryza sativa
tataaataataagtggtaagtcgcaaaatgcctttttcatgatatcaagaagataaagttacatatgcaagtaggacaacatggtaccgatagcgtgtgatataatatttttgtgcttagtagtagtcacttgcatgcattttcttaatcttaattagtgctacgatgtgtgaggcctgcagcaaagtcatccccatcgatcaattcataattatgtgcttatgtcgggacgactgtttgttatatatgcttgtctgttaagaatgattcaatctttgactgattcaagttcaagctatataatagataatatgaatgatttaactctatatatagtttatgctaagatagagagatatattaagaacataatgtctatttatggacaaattaattaagatagtacagctagtgtttggatgaatcgggaaaataatactccaaatgtctatatatttatggacaaactaagaacaaagaacaaatttagaacctaaaacctaaaatttctttatatatatatatatatatatatatatatatatatatagga

SEQ ID NO: 41228 - DNA, 1501 bp, Oryza sativa
ctaggactatgttatgtttggagagctcatgggtagctataactattcatataatcttcaattttctcaaacagtttagtttttttttttacatacttcaaatctcagtaggtacaaaatccaaaaagaaatttagtagttataagctgaaaaacccaggttctttaaatctttattagatatttcctgcaatcttcagcttcccaaaccaagccataaaaatatttgtttgtgtaattttaaccacaataattgttcaggactatgttttaggcttatagaaatagtataggccaggtgtatcataatttgtaaaagtattataatattatatttgtttaaacttttcttttttatttgaaaggacttatccaatcaaagtcaccctttgttgaaactttgaaacatccaagaccaagggaagcacaagtgttgtgttggtggagtagctccattttcacaggaatttaaatcctgatatccacaaatattacctagcacggtatcaatatgaatttagtgatgtcatatatagatttgtaatcgactttcgttgctgagtgtgtgaatgtggtgtgtgtatgcattttctatgtaataaaaaaaagcaattggaaaccatatccttttatatcagaaggggtacatgttgtcgaagaagaagaaaaagaagaaagatacatgcttttttccaaggataattaaggtgacttttgctactttccgttgtttttaagacacgttgaatttagatcatgctttgatagtggacgtgatgagtaaacgctgagggaaggcagtacggctgcaatgaagcatagtatttagtacaaccccactgctccaacaaaaacagtttaaatataattaaataacatggcacataggataaacgatgcttcgtctgtgtcaagttagttaaatgagaaattatgaggaaactctaggtcttacatgcatgagacttggtcatttatacaatattcaagactacttgaatatgtaatgtgaaatgaatggtattaaattagcatatatattgaattaaagtttgtgtatttcagagtttagtatacttgtactaattaatttctagacaggtggcgtgaagggatatgaaaactgccgcgccggtagcatatcttgcactacagcacctttaagagcatcttgaacggtctctccaaatcccactctccaaatatctacttagctaactctttatttaatttggcaagttaaattcgttgtttattccaacagcttttctattcatcatctctattctgagtctatgatagtgggacccacctgtcagcctctataccactttcttcctcgttatcctgctccccctcttccccaagccctttttttcttgcggcagtggtggccgtgcgccgcgacggtggggtggcggtctttgtgcgcgggccagcggtcttcatgcccgacgacgacggggcggtagtggccgggcgcggcaacgacggggcggcga

SEQ ID NO: 41229 - DNA, 563 bp, Oryza sativa
tatttattattatttactttgttagttaggtccaactccaatccctccccaactattttcagattcttattagctttgacattcttgtctagttcacctagtctacatatccaattgaactcaatttacatttcatcagacacagttattacagtatagaggtttgcttggaagatgcaccccttctgttcaaatggatcttccctttgagggtcagggaactatgatggcaaggcaaactgtttgttggagaaaccgcctacctctctcgtttattttacttcgttatgttagatcatgtatgtgccactctcgctccgcgagtcctttgtagctgttgtccacttttggtcatagccactatatttgagcgcgtaacttgggctatgcctactcatttgtccaacatcttgaatggtagactgacacattatgccttaggtgacatttctctttttttttttgcacaaaacatctcaaaagcactctctctctctctctctctctctctcgttctgcatgggatatattcgtcatttacttgcttgttgcaatctgcgtac

SEQ ID NO: 41230 - DNA, 327 bp, Oryza sativa
catttcatgttactgcttatttaaagttgactctttgagtcttgacatctgaagaacttgataggtttagcattgacctattttatttatttctcttcactattgctctgtggaatctagctatgttttccggatagcctgttttgctgctgtgctaaaagagaagaaatcattaataccttttattcccctcaaattagcttccttaaacaaattttgatcatatagaaggcatataccctccctttagattgaaattgaggatttaccttcctgtccctttttttttcttgcatgattcatgtcccttgtgttctgtatggcagt

SEQ ID NO: 41231 - DNA, 1501 bp, Oryza sativa
gattcattcgatgtgaagtaagatacttactggggaggggaggggaggggaggggagaggagaggagaggagaggaggtcaggcgaggtcttggtcgtcgaagtcgtcggggaaggaattgaagaagtcggcatcgatgggaagggaggaggagggcgggtggcggtcgtcggcgtcgacctccatcatgcccatgcccacggcggaggcggcctccgactccatctcccccggtgagtcctcccactcgttcacgccgcccggcgagctcatctcgatgactcgattaatccaaccacttttggaatcttggattggatgattggatttccgatccccaatctcctcctcctcgctttgcctcctccacttcaacaacgacttgtagttgtaggtagggagggagggtacaccacagcagaggccaccagccggcgtcggcatccaactccaaatgcttttcttcctttctggcctttgtgtgtccaatattaattgctagtggactcgactagacgtgaggcccatttgttggcaagtttcttcccttgtctctctcttgtgagacgaatcttttaaacctaattgctacatgatctgataatatggtgctatatttaatatttactaatgacagattaattagacttaataaatttatctcatggtttactgatggattctataattagtttttttattagtgtccgaacaccccatacgacacgctatataatattcgctgcgacacgccaaaactttatgactctggatttgaacaccacctaagttgcctcttactcctagtattaatatccaaaatactgtatcaaacacaccaaataagcaagtggatggtggtggtggtggggcatcggagacatacagtacacgtgcatttccccaaggagaaaaggagggcagagatggagtgagtggctttgacttacgacgatatagcactagcagtactcgtactcctaaatttgtgttggtttgttggactatctatgtgtgtagtgcatgtgcgcgtgcaagccgcatttttgaaaggaattaatgtgtttttctataaaaagaaaaggagaaaagaaagaatgaagttgctttaattgatgaagttgtcttgtggggtagcagcactttgaagtggtcgctgttcccattggtgtatgtcggtcggagcggaagacaatgcttgatggccatgtgacagtagagtatataagatgccagtcgtaagatgttactactcgtacgtagacacacggagtatggcaagcaatgcaaaaatgtccattggttagcaagactagtgctagtgtagtatagtctgtggaggagtattgacacccctttattatttgcattgcactactcacactcagcaagcattgtctttcacttgagtagtactaggagtggtgctcacttgcacactatttcactccactgctccagtccacagtccagtgtgttcacctgctctaccccaagccca

SEQ ID NO: 41232 - DNA, 375 bp, Oryza sativa
aaatcctacgccaccgccacgccccgcgcccaacgttgtacacagcctccctcatgtcgaactggttgatcaagaactggaacatgatctcctcctcgccgccgccgccgttgacaccatcgggtagcacctccaccgcggtggtggccgccgagaacttgttgcggaacgtgcgcgcgacgttccggctgccggcgccgtggcgcgagtagtcgatcctccgctccagccgccagctgctcgggtcggagtagtcctcgagcatccacatccccaacgcgctggcgctcggctcgtggacgaacgcgcacagcttgccggagcgccgagcgatctgtacactcatcatgtgcggcaggttcccatggcgagccc

SEQ ID NO: 41233 - DNA, 409 bp, Oryza sativa
agtactccccaattccattttaatcatcccctatgtttggttgctgagatgggatgggatgggatgggatgaacgtacttttaggagtatttggtttaggggtgagtgggatgggttggcccctatagaggaatattcctatcagatccgggaccaactaatccggccaaaactggcggacaaactcgtcccacctggaatgagcgaacggcgtgacgacgccagctcgtgcgcttgccctgctcacccttaggagatggcggcggaagacagcttgggcgacagtggcgggcttgtctaaggcggcgcgacaggctcggcaacggcagtggcgacaggctcgggcgacggaggtaggcggcaggctcggcagcggcggcgtcgactggctcggcgactccggatccta

SEQ ID NO: 41234 - DNA, 317 bp, Oryza sativa
gccccccctcgagggttttttttttttttttttttttttttttttttttttttttttttaccagggattcattgggtatttaacaacataggcatgcaatctggcaaatttgaaaaacttttaacatacaccccaaatccctgcccaaatttaagaactaggggggacacagggcgtttttccatgtcgcattttctgtgatggggctaccatacgtgggagcaaaaaatggggagggtggagcgcatgccaaatgaggatctattagcaatgggacggggcctccactttagcatttccaccctgctcctttaaga

SEQ ID NO: 41235 - DNA, 209 bp, Oryza sativa
aggtctcttccctggccaaactggctaaaaggtgctgagaagtctctccaccgataatttcagctcgtcagtcattcggagcttggtgaagcactaggaaggcactttgcaacattgtatctctagctaagcttcaagccttcaactgcagaatgtgtaagggtgcaaccgtgtacagtaggcttgcacaggtgagatctgtctatagc

SEQ ID NO: 41236 - DNA, 435 bp, Oryza sativa
catattgaatcccagtttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctactcatggtatccctagtataattttaggtagatgcttcgcaatctaattaggtaaccttaggtggttttacaactatagactttgggaaatattcatatcacttggacactctggaattgttggattattgtggaattggcttcacaccgccccctctattcaaaaccccctaaaatggttttaggctgggctcggggtgcatggttttgatggtagcacctcggccgtttaaggaccggt

SEQ ID NO: 41237 - DNA, 246 bp, Oryza sativa
tttttcctataccttcctccccagtccggctctcggaggtccgagcaacggaatcgagcaaagtatccccactcccgaccctttccgcatcatcacgctcagcagcccctctgttattccctccctccccctcttctggtccttctgtccccggcccggcccgtgcctcccccagtcctcctctcccccgtctcccgccgcctagcgattcccggagcgcctcctccgccacccatcctgctccaa

SEQ ID NO: 41238 - DNA, 331 bp, Oryza sativa
agaattaaaacgctaacttgggtacattactcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagc

SEQ ID NO: 41239 - DNA, 1501 bp, Oryza sativa
cggggttgacgctcccgtcatatttttcggcgatggtgggccggaaccttgggggccaacggacattccgaagactcgccacaaaggctctacagccgacaccaccaaccgggggtacggagggctgattcccgcgtccgtgttgaggtgacactctggacgaggaagcgccctccgttgcgtgggtagcacgtcggccattacgccgccgctcgatgctagtgcgggcgtccggccccccacgcagatcttcccgggtcgaaggagtcgacgaaggagtggtggggcgaggcgtgcgtcagaccgcctgtcgccacctaacccgcgatctgaccggtctgtgactggtcacagaccggataaatgagtgcactgcactgcgttacatgcggcgtgacgcgctcgtccaaaccgcaataaatgtggctaggtgagcgcagcggcgctcacctaacccatacacgcggcgcaaaacccacaaggggtcggggcgcctcggtcctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacaacatcgattgcgatgatataagtctatatacaaacatgcatgactaaatttaatctacaataagagaaacaaaaataataaaatcagatagtgaatacctgtacagcgtagataaaatttattatttttgtttttcatatgtcgatcgaatttataccttttttttttcaagtgtcttatattattatagtctattttatcaaattttttgaaatttttatataactgtttaaattaacagcaatccggagataacaattactactactaagcagcagttaatgcctgaagcgaagcgaaagccagcaaatcgagcttgtcgaatcgaaggaaggagttggaggaagcaagcaaggcatcgaccggaccggaacgaacctgcgtgcggttgtcggagctagcgagcgcggatgccatgcgcgtggccatccgccgcgtccgcgcgctgatgcggtggaacggccccacgatctcctcctcctccccctccatcccggcaacggcgagcgaagagcggcggcggcggcggatggcgagagagatcctcgagcggagaggccgtggggagctttgcgtgcggacttgggctggtctgctgcttcggcccattaactaacctgcccaccgaggcccggctctccgcctgctcatgtgaagcaattgggctggtctgctggctcggttcggcccatcaaccagaccaagacgacgacgaagcaactgtttcgatctccataaatctcgcaactattacctgcatgcgcacaagatcgtgagcgtctccacatatggacaacgcggcgccgccgccgtcatctggagcggcggggaaggaga

SEQ ID NO: 41240 - DNA, 1400 bp, Oryza sativa
tgtcagtttcacatagaaattataaaaaaggtagggcccacgtgggccccacatgtcattctatccccttttcttccaccgcccttcgccgcccgcgcccgccgacggttaccgacgacgtgactccatccgccgccacagcccagcgaccagcggcgtcgcctgcctccctgacccgccatggccacgagttagtgcaagcgcacccgccgtcccgccgctcccgccagataaggaggttcccctgttgccatgctgtatcgaagataaccagcaatgcttcctccctgctccccgtgccggccatggcaacggtctcctcttcttccctctcgctgcctcctctctcctggtccttattcttcatgatctccgtgtccttcatggcattcgtgatctctccagctggcgtctccacccgctgtacatcctccacgcggaccacgccgcattcttggccacctgatacgtcggcgcgtttcgccggagtcgctgcctctcctttgccgtcaacgggagccttgtcgccatgcacgttgttgccaccgccaccgccaccgccgccgtcgttcccgcccgtgacgacctccaagttctcgagttccttccgagcccataggagtagctcatacgcatatacgccgggtatagatggccatatggcccgaggcccacggcccggcacgaagcccgcaattttggcccggcccaagcacggcccggcccgactagggtcgtgcccgtgccggcccggcccgacagccgggccgtgcctgggctgcaccctgggcacggggggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatttccagccatttaaacacaacccacagagttgagggatcaaaaatagacttatttccagccatttaaacacagcccacagagttgagggatcaaaaatagactctttctgtgaggcagcacaatagcccatcgtgccttcgggccggcccggcacggcccgactagtattggaccgtgcctgggccgtgtatgccgcccgtgggctggcacggcacggcccggtgcatcggtcgggccgtgccggcccgacaagcctcggcccaggcacggccgggcttgggccgtgccgtgccgggcggcccagatggccatctataacgccgggtacagacggccgcatgcatatgcgtcttcgtgcgagcatatatatgcatgcatggagacgaccagctatagcctctagctagcttcttgttggtttgccgccaacaacatgca

SEQ ID NO: 41241 - DNA, 401 bp, Oryza sativa
tcagttgggaaccatgataatctcaggtctaaggattcaacaccaacactaaatgagataactgatgacacaacacatatggctcttgcagtgtctcatgttgggtctatccaacaacatgttcactaacatgtgtccacattattaatttggtatctctataccatgatccatgagacatgatcatcaattaatacatgtgttgatcatctaaacatatttgttccacatatgatatttgatcagggatcctttagaaatagcaacacataacataaaaagtcttatgaaagaatcacatattcattaaccaataatgagtttatctatttcaaggaacaaaatcggaaaaatatgtaaacatagtatgtgatacaatcatctctatgattgcctctagg

SEQ ID NO: 41242 - DNA, 1396 bp, Oryza sativa
  unsure (1)..(1396): unsure at all n locations
cccgcccccggcccaccgaagggggcttgcttttgaccgtttgttaccccgtgggggatgaatttaccccgatagctcaccctaatagaggaattccccaccgatgaacggggaacggggccattgccatccctacatatgagcatgaaaaaaagcagacgcaacacgcaagcggacgccgacactcaagatcagacacgacgtgccatattcagcacggcaccactgccaccacacgaccttacccaacccaacaccaccatttcaccattgcactgcacgggggcacggccgatcgaaaggacaaacgagttttcctttcccaaactattactagtactacagtataaaggtgcctctttaaatcgcataaatgataataagataataagtgtgaaataaaatattacaaaatatacgaaaaatataggaaaaaatataggaatggttgtttgattgaccagcgaaaagaacataaaaatcgaataagagagataaagtcaaaagaaaatttttaaaaggttggagtttttttaaagtttcctcaaaatctctttttattgtccattcaatagaaattttaaattgtatgataggatttaatccattgttttaaaggtcttcacacaaaaattttttataggattaaaaatcctttaaaatttctatgttttcctacaaatcaaagggtccataaaggttggatctacttatgggtccataaaggttggatctacttatggcctatttgttttggaggaatttaaacatataagaatagaaaatgtgaaagaacaggaattcgtaggaattttcccagaggtttgggtggatgaaatttttcatatgctttctctctacatctaataggaatgaaaatttttcttctatttttctatacctatatgcctacaagccgaatgatactaatatgaattaattcttagaaatccaactttttttcgtccaaaccaattttttttgtttcccttatcggtcagcacttacttttcctttttttttgaatttttcttcaaggaaaatgggcttttctctctttgatcctccagaggagagaaaacgtgcattttaacttcctccagtgcaatttacatttaggtcttatctttcaaccataaaatctggtttatcgtttctttcaactatcaaaatattattttgcctctgcaaacgtttttgaaggtgattttgtccaatgtggcacattcgtaacatcttgatatagtcttcatccnaatatggcgtataagtggcaatacagccaaagaaaaataaaaaaaataatgcgacccacatgtcagtggcataaccgttcctctctttatatcgcctttcatcagacaaaaccgttaactatattgacttataagcgcca

SEQ ID NO: 41243 - DNA, 167 bp, Oryza sativa
ccggttacaataggtccttcggtggttttgacaccagttttgtcctacgtgacggctgatttagcatgggacccacgtgggtcctacatgtcaggctgagtccgctgagtcatctatcttccccttcttctcttccttggttcctcctctctctctgcgcctgtagg

SEQ ID NO: 41244 - DNA, 1501 bp, Oryza sativa
gtaataaagtactacacgtagtaggagtaataagttataagtgccagaatgaagccccatgagctgactcccccgtctcccttcccctggtgattggcgatgagttggattggatttggatctccagaatccatccagatgctgaaaagaaaattaagagcaaggggccaaaacctgtcacgcgctcgctcaaccccaccacaacaccatccatgctcatcatcttgttgtgcagttgctgctcttgttctccaatcgacacaaacacaacacatgccagccgcccgcccgggccggctgtggattgtggaagagagaaaaaggactaatgattccatggctgtcctttcggatcgaggcgccctggatgattagcagcagcaggggcaggagcatggcaatctatctttgatgccaagcaaagcaatggctggctgatatactaccactcactgatccagttgcagtttgtttagggtgtgccacttgtttcagatctctcttttgccttgtttctggcagcatccacaagctcgccttgcgccaattgacatggccaaccccacaaagactagggtggtgacttgagctccttcgcccacacttgtgctcattgctcgtcagaccagatacacaaacacgcgccctgctctactactggagtactactactccagtactggtagtacagtagtacagacacacacactgacactggccctgctgatggtagtggtagtggcagtgttaggtaccccatcgcagaaagagaagaggagactcgccatggactcacctctacagaggagaggtgtaggagtagagcagtgtcagtgtagtatggggcacatgagttttcgacagcactaaatatggtggcttagatttgacagtgccatttggatttggttcatccatgaaatagaaatagaagaggcccccatactgctttgtccgtccggaggggagggggagggaccatgcagcgagcgagcgagcgagcagtcggtgttggggcacacgacggagacgatcatgtcatgtgcaagcaacaacaagacgtcaacattatgcctgcatgtgcatgtgatagtccttccaagtcaaactttggagggtccagaatttctgcaattctgcctccctccctccctatcccttgcctgcaaaacactgttactttggactttggagtgtgaacgaatgatactcctactcctacgactactctgaatgttgtactagtagtagtgacaaggaagccctaaatcccgggtcatacctgctgatcgaattgacttggtaatggagtaatattatactactccagcagcagcagcagcagcagtggtggtgtatcaatcatcctcaactaatcgaactgagcatgctgcttttgtgctggtccttgatttccggacaaactaatcgaagaatcgagctaaaatgatccatcgatggacacagtactagtagtatcatgagctagctagctagcagt

SEQ ID NO: 41245 - DNA, 1501 bp, Oryza sativa
tcgtattaatgtttagggccaagatcattttagttgcaacaggaaaaaaaaggcaaccttaatctttaacaaagatggctttttatggtcgcgcaaacgcgcgactcttagtggctagtatatttgagatccgtacggttaagaatagtcacggtgatccaaagtgtaacaaaggtaaaattatctggttgaaaacaaaaatattggctaaagaatggttaaagagaaatatctaataaaagattgcgtaaagagaaatgtactctagctgtgttcggaggttggtgttgggaacccatctcccatgcacggaaacggagcggtctattagcgcgtgattaattaagtattagctaatttttttaaaaaaatggatcaatatgattttttaagcaactttcgtatagaaactttttgcaaaaaaacacaccgtttagtagtttgaaaaacgtgcgcgcggaaaacgagagaggagagttgggaagagtaccgaacacagctaggtaaaaattaaacaggccatcctcagccatatattactatcctaatttgatggatatggatgctctgcagtactgtatttgcagtagcagtgccggtttcacatgtcagcggctgctactacagctgtaacactgtagacaatccccactgtaatttgattagttccacgaagaattaaaatccatagagatgtttgaatgatttttttaacgaattttacgaaaactcatatgctgcagtgatccttaaacttatataaaagtaaaactggtcggtgcgccaacaaacatgctgattttctagttaatacttaatcacagaatttacagtcgcatttgttgcgcagcttgcgctcctaattataacagggaaaacttgcagccccatgcttctgatgatggtcagggctgctaagtaccaggttgggctctactgggctggatctcttccgcgggttcctcctacggtatggaataagttcaccttagatcccttaatttgtcgtcagtttaccccttaatttgttgcgctcctaattcactacggtagtttttcactttctgcggctcttgtcgctacggaatgcttttcttagacttttgctcaaaatattggtgcttgagaaagccaaccgttaaatgtattagtaaaaactaattaaaaaacgaagatagtagtaagtaatcattgtttactatttgtgtcttctggatatgggatatctctcatacttgtacttgtatattttggtatatttgtactcaaagtatgagtacgaggtatcctatattcagaccgataatttgtcatccaatttatagggttttaagaaattttcacccaattcacatgtctttatttcatattactctatctatccggccaaatagatattgcatctatttgcatctaccatacaagtttatgcatagtggttgttatcagggttataggtaaggtataccctctacccttcgatatacgtcacatatcgata

SEQ ID NO: 41246 - DNA, 1501 bp, Oryza sativa
atcgtaagatgaatttttgagcctaattacgccatgatttgacaatttgatgctacagtaaatattgactaatgacggattaattaggcttaatcgattcgtctcacagtttataggtgaaatctataattgattttattattaatctacgtttaataatttaaatgtgtgtccgtatacttaaaaagaattttggcacacgaactatgcacagccatgcttaggagtaccgatcgagtacgtaatagggagtaacctctccgtttcgaaatgtctgacgccgttgactttttagtacatgtttgaccgttcgtcttattcaaaaaatttaagtaattattaattctttttatatcatttgattcattgttaaatatatttttatgtaggcatataattttacatatttcacaaaagtttttgaataagacaaacggtcaaatatttactaaaaagtcaacggtgtcaaatatttcaaaacagagggagtatatactagcagctagtccagcatgcgcatacatgcatactagtactccagtacgagttgtacaaatgcgtacagtgaaaatggagtgcgacaacatgtgcatactactacttcttacgtagcatagtgatttgtgacagtggtcgtcggtcgtcgttggaaataaaagcttgattatattgtcaagtgaagcatgtggtaggttttggtttggatgattggtagttagctcgtgtgaactctgaagcaacaatatgtgaaaggaccaactgcaacatcctgcctgcctgcggatattatattaccgtggaaagagagagagagattaccggagctccgagcttggggctccgggcgggtcggccggtgaggttgaaggaggccacacacacccggtaagagtattaccgtggataactactactctacatgaagggaaaaagggctggctggtgtagaactagaagccgacttggtgtggcctagtggaccaggcttgttgtgcaaggccacgtgccttttcttttctattagtccagtagtctctctatttataaacatgtcgtcccctcttaccaccagccataagccattaggcaaggcaatcctcctcctcctccttgctcacagtcacagatgggaagagaggaattgagcaactcgtcaactcaagaattggagggttgagctagaattattaggaagtagagctagaattagagaagagcagagcagcaagagattattagtacaggaacaggagagcagagcagagtgcgatcgagcaagggcagggcggcggtaggctaggcatggaggaggagataaagggccgcgtcgtcgtcctcggcgccgatgccgccgccgacccggagctcgaggccttccatctcccctccgccgaccagcccccgcactcgcacctcctccaccaccaccattctccacaatcccatcctcaacctgatgcaccagcagcagcagcgccaccgccacctgctccccttactc

SEQ ID NO: 41247 - DNA, 1501 bp, Oryza sativa
tcgtcttcgctgaggtgctcgaaggtaagtgacagtaaacaagagactgaaacagaagtgaggcgtgtctgaattttctgaaaccaccatttcacttctgaccctgtgaacaaaacgatgcaggagtgaacctgtccctcctttcccgggtgatgtcgtcgaggctctcgcgcggaacctacaacggcgggctcctctcgacggaagccggcactttggctcgcgtcgcggcggacatgacgatcacggcggcgggttaccttggccagaacagcctcctgaatgtaaccctgcttccgtccttcgtgatctgcgtagcttccatcgtcgcgacattttgcacctataactccctgtactgagaatctgttctctccgtctgtatgtacaagaagcagttgacacagttcctggccacttgggtggcctgtaaaatgttaggccgatgcagctaatgctggtctctaattgtcatctgtggaagattaggttatgtttgtagtagcagttactaagttaacagatgatgtaagagcatgttcaataaactctactgatcaaatgctccaaaagcctcttggacaatcctgcttgcaccggaccagcgagttccagggcaacggcaagagcataaaaaaaatgtaggctcagcggccaagcaaaggttaattggtgcggatcagagtgaagtgaggtgatcaccggtggtttttgccgttttggtttcttaattctgagtcctttctttcgtcacactcatggcatgctcaacataggacgactcagtcaagtgtgcatagactatagtagagaaatacttctgcggagcgaattattagagcatgcatctggtgctgaaaattgtctacatggtcgccagtgatcagaattcagacattatactgttctatgataatactccaacaaacacctgtgttcatatatatctgactaaaacggtatatgttgcacgtagtgtgcgcttgtggtttgtggtgtatgtgtgtgtaatcgagaaagaacagtttttaatctgacatgtgcctgtagtttgttgttttatgatgctacgacatatcatcttcagaaatgcattctgacaacagatacgctctggataattacgccataaaccgaggatggcgtatttcaatcttacgtttcccacatctcctctcattcgcctacaaaataagcagacaagcacggagcagaggtgattaacatatccgaatctgtcgaacacttgagctgacacaaaggctgcggagcatgaaggccggaggccggttccacttgcaccaaaccgtaccaaaccagactaacggcccatgcaacaacggtttctttagcaaaccattcatctctcgccagtatataagcacacctgatcctgtacgccaaacacatcaaacacgacgcacattcctgatctcgtcagcacagacgcagacgatggcattcctcgttgccacgaccctgtttctgtttgggcagctac

SEQ ID NO: 41248 - DNA, 798 bp, Oryza sativa
aactaattttcacttaatttgaaccgaataatttgacatttgtgataccttgaaccactatcaagtcttttatccatatgattttaatttgtcatatgtcaaagaaattatctacatacggctatgggatttcattgacaagtaggagctagtctaaagtaatgaaggaactaatctttctcaaaagcacattaggccacgtaagctaaaaaacaaaggccatcagatgcatgattggataaatgttgaccgtccgatcaaatacgtactgcattatccctccggagccttctagtgcctctcctcacgtacttgccagcatgaaagagagcaagcaacacagatagacacttatgaaacttaatgggcttcaatttcataagttgggtttttttgaaatttgacacatggaccaagtaaaacaatactccctttgtcttttaatatatggcatcattgacttttagatacatatttaactatttgtcttccaaattcttttttaaataaataagatatatatcatgcttgaagtactttcagtttgtaacacaactcacaataaaataaattagaaatatgtaaattttttaataagacaaatggtcaaccgtgtgaatataagttaatggcgtcatttattaaaaacataggtagtataaattgtttctgtgaaaaaaaaagaaatactacggtggtcatgtatgtaacatatgggcaacttcgtattaatgtttagggccaagatcattttagttgcaacaggaaaaaaaaggcaaccttaatctttaacaaaga

SEQ ID NO: 41249 - DNA, 559 bp, Oryza sativa
tcttttaatttttctaactttggatattattttattttttatttaaaattttaattaatctcgtattgagtttcttatatggattcttctttcaatatcgcttatttttaattctgaattttagttaattttaaattgtattcttacttgaactcttcttttctttttgctaatttcggattttttttatttttattttgaatattaattaatctcgtgttgggttcctatatggattcttctatcaatataccttatttttaattccgaattttaattatttttaaattgtatttctacttggactcttcttttcttttataatttcggattttattttgtttttattctgaatttcgattaatctcgtatcgggttcttatatggactcatctttcaatttcagctatttttaaattgtatttctacttagactcttcttttcttttcctctccgattaatgtggaaatttctaacccccacagcgaacgtggtgcctcctttcaaaactgttaatccgtatactacacataatacaaattctaaaaatcctgcaca

SEQ ID NO: 41250 - DNA, 1501 bp, Oryza sativa
agccctttcctgtctctccatactggcgatggtgaattaacgggaagaagtgacaaacatgagtcacttgcaatgcgcatcccaataatggtgatatgccatcgtcactgacttcaggtggtgcacctaaaggctaacgctagcatgcagccgtgttctgtttttcttgtctttcttcttgcgaggacatgggagtcatgtcttgagtggttgatgagtatacttacattgggtatttacaaaagaaacactcgctcgtgatttgatcaatagacctacttcagaatttcagctgatggttcactctccgagcgtaatggctagtttactactttatccttttcataatgtaagtctttctagcattactcatatttttatatatgtctagattcgttaacatttatataaatatgagcaataatagaaagtcttacattatgaaacggagggagtactccctccgtcccatttaaacgcaaccataagtttttatatctaattttaatcattcgtcttatttattttttttatgattagtacttttattgttattagatgataaaatatgaataatactttatgataaaatatgaataatactttatgcgtgacttatgttttttattttttttaaaaaaaaataaataagacggacgataaaagttggatacggaaactcacgactgcacttaaaataaaacggagggagtagtatcttcagagtccaaaacaataggaggaaaagcatgcacctttagtttcctagtactgtcgagaagggctaattggattcgtgccattaaaatggtttcctagtactgtcttctttcaaaaaaagtttcaaagtacagtgctagctgcagcctgcagctgcacttgagtatttctttgctagggaagcgtgggaacaagggacgtaacaaaccatagtgtcgaaagatgcttacttggctcttggaacaccattgagccatctaatctatgttgttctgcatcctggagttgggcatcgctaaaaggaggccagagatttatctgaaagtgtgactagatgattctgtgtcaccttgctaagtgtcctgtcgttctggatctgtcgcgaatattttaagcttttgcagacatgttaacattatctttgtggttcttgtgttaaagttctgtccttttccatgtactctctgtcactgacatgttggaccatgagattttatgcctttattcatgttgaggcttgatctgtactttggcactaaccatatgtatagtacattaagcttctaggtcatttgctgaaagatttagatcatcactatgtcgctttcttcatgttttgcttcaacagaaaagttgtatttcctgaactctgaacaaacagtactggttgtcgttctgaattgaactgtaaatgctataccactagacttgatcgattcgtttctagcggcatgctaattgttccattgcagtttcaggttccctcagtaaaacgccaaga

SEQ ID NO: 41251 - DNA, 615 bp, Oryza sativa
atgaataatgcatgaaactgagtttataaaattatttaatggcataaataaataaattaaatattataaagttgaatagttgatttaaaaagttattagaaatgatgatgaataaagttttttagataaacatatcatttagaagcttaggaggcttgtccttcaatttgtaggtagaaaaagaacgtgaccttaatttctcatatacttgcaaatttatatgataattaatttgaatgtcccaaacgacgtaagcagacagtactcttttgaagtataggaatacttgtttaatttttgtgtgtcgtggtgcatcgatctgcatctgcatgtgagcctcactccctaactatccttttggttaatgtacattataatcgagttcactttacaagttagtggtgtgttgccctttaatttgtctttctcgtgcatcaagctaattaatttaggattgcactacgggtttcacgatcaaatgaaatctcttctttcttccaagctactcctagcttaatttatagtagtaacttttcttttcatgttacttgctaactcagtctgtgtttagttcgtgtaccaatttttttataccgacacatatttaaagtatta

SEQ ID NO: 41252 - DNA, 471 bp, Oryza sativa
ttcaaggataaattattccactgttccagcctccaggaggtcccgacgcatcgttaatagtccttagctcactgcaaatattttgttgtgaggaacatggcgcaaagttcactgcaaaatttaccatatgtattttccttagtctatgattcactccttatgtaattaagtcgccccttccctcctatttctctctcgacggactatgatccattgttaataactttttatctttatttttctcctcctaatataaccggcagtcctcctgccatataccatttcaaaaaattagtatgatggttattgcatgtggatgatctgaatatcaaaagtaaacagcgctgcatcttttagcttttgtatgttattggtctcaagattttgcatgctagatcacaatgtaatcttcatatgtgcttatagccattctaaacttactgtacctttgatgtggtttgtctcttcagt

SEQ ID NO: 41253 - DNA, 247 bp, Oryza sativa
aaatggaagaggtcgcggtctcgatgtgatcgtttggattctccattaccgaaagccgacgagacttttgagtaggtatcttgaatattctctggtttattccgtaagaactgaccgagtgacagtgtgacacctaaacattactcccttcgtcccataatattttaacctaggatcggacaaaacatttcataggacaaatttgtccagatttattgtcctataaaatgtctcgtacggtcctaga

SEQ ID NO: 41254 - DNA, 879 bp, Oryza sativa
atatatgtatatatatatatatatatatgtatatatatatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagccctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtctcgtgacttagcagatgtttcttgtatcaacaga

SEQ ID NO: 41255 - DNA, 706 bp, Oryza sativa
atatatagtggagtaattttctaatcttagaggggctcttttccaattgtcctccttatctctactgtttcgattgagtggtttcgtgtttttccacctcgatgacatgcggggaccacctgtcggcgccacggaccctctctttttctttctcatcatcaatcaaaagataatatactaactgtatgggcccacctgccggtgggagacataaaaatatcttcctctttaattctcgctccacttttattcttcgacagaactaattaaagaaaaagaaaagcaatcgatttttgtggtgctgttagttgctgaaacttgcacacaagatatgctagttctaacgtcgcccaaggcaattaatagtcagaaaaataccgcagtttcaatcttaattaatgagttgtattgacattcttttttgggtcaccttaacgattcacccaaagcctagtgttgtatgcagaacggaaacaaatccacaaaagagttactgcaaatacggatgacacaacgcaaactgataaagacaggtgaactagatcaaaatgataagttcggttatctcagcaatcccaacttactatatgtatttggacagagaaatctatcgagacaactgacaaaataagtcgtgctttcttttggaaaggtgaaaaatccattaaaggaggattagggatcaaggacttaaggacacataaca

SEQ ID NO: 41256 - DNA, 289 bp, Oryza sativa
cagctattttagatggtaactattgttttgtcttcgccaagttgaaattccaaattgacctgcccaaaattaagtcccagcataaagtcaggaaggtagtaaagacaacaaacagaaaggagcccattatgttcattaaatgccaagatgcccatacaggctagcatatatatctagttaaatttcagattgcaaacagctaagtatccatagatatggtgttagaaagcctgcaagccggagttcagatattgaaaattttggatggttgcaaaaaaagagaggtatg

SEQ ID NO: 41257 - DNA, 352 bp, Oryza sativa
ccatccatccaacaacgcaagttgcagattctacttggtcggagtttcagcctccggcgaactgctccgatcgatcgatcgctcgctcgcggggacgcgacgaggtaacgacgcccatccctccctgctctttcttctcttcgatccttcttcgcggtcgtgtagggatccatccatcaaatctgaatatctaatcgaatcaatctatatggcgttgcgtttgcgtttgatttgaaccaccatgatgatgatgatgattttgctgctctgagagatgatgctgctgctgatgctagggtctgcttgcttcatctgtcgtagggtgggtgaatcgcttaggatttgggaatgg

SEQ ID NO: 41258 - DNA, 376 bp, Oryza sativa
ctatcccagcgtagcatcccattataatatcggtattgaagatgacaaatgtgaggatcatactgacaacaacatagaggaggcatcaagtatcgcatctacaaattgtggttctgctgataagcatcagactatacaggtgttgcctgtttgtttagcaaatggagataacattgatgatgttgcttcattggggagttcaatttgtgaagacgttgaagataaagacaacaaaagtaatgctaattgtatttcagaggtgagtacaaaaggaagtttcgcttaatttctgaaaattgtggctgttagcttgttatatatttctgaattttactgctattgtatgtttcaaatgaatttgaaagggagctccaca

SEQ ID NO: 41259 - DNA, 1501 bp, Oryza sativa
ccagcatagtcaacgtgctaccccatatctctgtcaagggtcagtgaacctgcactgtccatattggtgcaatgtatataattaacaacagccttaactacttcaaatttaggtgctgttcaatcgtttggatttcagattttagcaaaacttaatttgaggttgttctgtttgtcacttaatgccttatttatttttcctgaattttctattatcgaagaagaagatattttgaccgaaaggtttggatgaaattaaggctctgtttctttcagcttgggattattataatctaaattattgagccagattactataagttatattgttataatctgtagtagaataaggccctctttgtttaggtttataagccaacttataagtcgaaaagtctaagtctaaacaaacaagcagcttttccgtttggcttttttgaagccataagccactctaacactattaagccaaaagctaggttagagaagcttttttggcttatgtgaggtagatgtatgactcaactactaaacttaggacattaaatccaccggcttataaatcatataagccaataagctgacttaaaagtctaggccaataagcctaagcctaaacaaagagggtctaagcggttagttgtttctttcctagattattagagcctagattattgggtttgcaagtctaaaaagggagtggggtggcatggtgggtaatttttcacccaataatctgaaaaaagctcacctaaatgagcttatcagattataataagctggactccagattataataagctacttcaataagttgtctgtttctttcagcttactctcaataatctagattataataatcccaagctgaaagaaacagggcctaaataggctggacatgtgtggcgtgtgaagaagagtactgattcacctaaaagagataacaccaacatgtgacaacattttgtgtctaacaaaaaatcccaatcgttcagcttcacattggaaaacaatagaacaccaaactaaaaggtaaacgataaaaataaaaaaaatgaaaatagctactgttcaaacatgtagctattaacacgctaaaactatcgcagctaacagggaatcgttgtacactatgcataatttatgtacaaccatgtaaattactctggttaaacttttaattggcaaggcaggcccaaggggaatggtttcattaaccccaattttaaccttaaggttatcagccttgttcttgaagcacttttttttcttccggttataagcaaaaccagtttaattagcttaagcacaaaaggtacagtaagcttaagctagctacacactaagcaagcttattagccatggcttcatcaccaagtctgccattggtgacgtgtgccctgctgctgctgctggccgtggcatgccaggctcacccttactggccactggagttggcgtactaccgcgacaagtgccccaggccgaggccgtcgtcaagg

SEQ ID NO: 41260 - DNA, 1501 bp, Oryza sativa
aggagaaggagagcaaaccacacgggatcggatggggtggtgtggggcccaaaaaatgtatttttaatcgctagtactagttgcatgcgcatatggagccgtgctatcgtcggcgctagattagtcgtccgttcccttcctttttctggtttatctttcctccacgtagaaatacgatgatatgtaactttttgaagcctgttgagttattttattgtaccggctctaagcgcaaggatctcgtcctcgcgggtggtcacatcctcacggtcactgacaccaattgacacccaataattccatggcaaagtgccaaagtagaaacatgagcgagtacaagcatgtgggtgatgagaggtacatctgatgtaaagattagacgaatgaaaaaccgagagcaggtttgttccggggaaaccagctactggtgtgaatgcccgtacctgaatgctagtaataactaggaataaacagacagaatttggtttctttctttagataaagaaattgcttgcttgatcaagagaacagaccagggattggaagctcgctgcacgggtccaacagcaaatcagtatccatgcttatcaggttcggaaatttgtctggagctcattcctgacgatctttgaagtagtattagtactagtttcagactctcaggaaacatttgtcaagtaaaggaagatttgctacatcaaatttgatggtttgagtatgagctcaagacagcttcacgcgcgagtgtacgcctgtacgtacatgtacaatggctaatgcacacactcaagtcaaaagtttaaggggctgtccgtttggcgtctacggaccaacggatttaaaaagctggttaaccaatacacttttaaccggtagttcatcacggcaccaagaatcaacgtgtattattgacttgcaagaacagaaaaatatcgacatgtactaatctgcaagtccgaccttccaggacgatgtgcagtgttcctcacgaaaattcgacgagcaccatcatccgattgattgaaaaactggtttgcatctaatcataagccgtgcaattattgtcaccccgatggtacgagcattacggaatgtattcacacctgccattggctgtaacaactgcaccatttcatgaaaaaaaagagttcattttcttctccatcttactacagtggcttctgttgtttattccattactctgttttttttttcaaatgtatcttcgattggtcacctaaggcagacgagagggcccaaaaatgatcgatcgcatgattaggacgccggcagatggggattaaacggtgggcttgtttttttagagccgaagacagcgaagtttaaagaggcagtcaagcaaaccagcgaggcagcgaagcgggcttaagcttaagccacctctcgtcacgcctccaaacccacttctctcccaccaccgagaccgccgcctattctttccttcctccctctctccggtctttgcttctcgcgaggaagt

SEQ ID NO: 41261 - DNA, 183 bp, Oryza sativa
tactgtgctaccatattagtatagatattaaaaagttacaatatttagttctctctctgagctcaatgaaattaacatgcctatcactttgcgattttggccattatcattatgaccttaccctctaggttagtcccagatttatattgttatattcatgcaatatattctgttggtcacagg

SEQ ID NO: 41262 - DNA, 1016 bp, Oryza sativa
gacatggtggtgctctccggcgcccacaccgtcggccgctcccactgctcctccttcgtctcggaccgcgtcgccgcgccctccgacatcaacggcggcttcgccaacttcctcaagcagaggtgcccggccaacccgacctccagcaacgacccgacggtgaaccaggacgccgtcacgcccaacgcgttcgacaaccagtactacaagaacgtggtggcgcacaaggtgctcttcgcgtcggacgcggcgctgctgacgtcgccggcgacggcgaagatggtgtcggacaacgccaacatcccggggtggtgggaggacaagttcgccaaggcgttcgtcaagatggcatccgtcggtgtcaagaccggctaccccggcgagatcaggaggcactgcagggtcgtcaactaatcatcatcgggtcaatccgactaatgcaaacccatcgatctatacgttcattcgtttgttttccaggactttgttcttctgatcgattcgacatgacgtactacatttcttggttcttttggccgttggtacggcttgcattatccctctaaaaccaccatgacaatgaactgtacttgaataaattcatctctcataataattaatacaagcctcatctcttttttattggtaaacctagtgttagatttgtgtgtgtttgcaatgccttgagtaattggaatactagtcggagtcggacatttgaatttggcgcgcagagtggcgttctttttttgggtgaagaatgaaacgaaggaagactccgagtcggatcatgtaaccatcaccataagtagcagcgtgcgtgcgctccgaattctgtcatttccacccatcgatcgatcagcaaccagcaacggagaagaagatcgacgtcatcatcgtcgcgatggcgttgcaaggcatggagcaagaagcagcagggcaacctcccgcctcggccgctttcccgtcttccgcggaggcggcggcggcggcggcgagcccgacgagcggcggga

SEQ ID NO: 41263 - DNA, 303 bp, Oryza sativa
tcccgtataggcccataaccgggtttagttgctctttttagaaaatttggtcccgtgaggcgcaggtgtttggtgggagatcaatctctttctggcgctcgctcgtacgccgctgtcgttagtttttcgccaatgcccaatggagagaaacaatcgccagggtttcggtgctgccgggcatgccggtggctttgctcggggttttcatccgggttccggaggtggttttccataccaagccagagatggtagaggagtaagggcccggggtcgtggaaagtttggcggtcacaacaatcgcca

SEQ ID NO: 41264 - DNA, 1501 bp, Oryza sativa
gcaccgggggaggaacctggcctcgtcgccctcctcgagctccgcgaggcacaccgcgcactcgatgctgtcgtccttcttcttcaccgccgccgccgccgccgccatgctgtggctgtacaccgtgaccagcagcgaccgcagcacctccgggtagacccctcctccccttccaccttccccgctgctcccagagcgtcgccgctgcggccgcccccgccgcccatgcccgctggagaaaagtgaagagagagaaagaggagaaagggagaggaagggaaagagagagagggagtgacgacgtggcatgctgacaggtgagtccatggtgactcagctgccacatagaccaaaaccagagttaaaaccaccgaaggatctcgggtgatcggttttctatagttgagggacctcatgtatctggttttgcggtttgaggacgttttcggatctcggtgacaagttcagggacctccggtgcactttttccagtgaactgcgaatctgtgatgactgacgagcgatgctggatgattatggtccattgcatccatgctccaaaatctatttttgaagcaagcataccaaaattcgataatgacatttgcatgcactaacgaaccaggtttagatatatactagtactcatcatgtctacaggtttcagaataaagtcttttgactaaagcaatgtgtccgttatccaatcaagaggacctcaggccacaagacatgaaaaagaacatcaagtgtgtcccacggaaaggacagaaaaatgtctggatcttatatatactccgtagattctagtagtagtgtgctttaagagcaaggtcaatagtatagtctgctgctggctccattatctccatatcattttatagctaatattacagttaactaatacaatagactagctattgtgcttactacatctcatgaaagaaatatttaattatacatgcacatactttatgagtacttacagtgtatgatcaaaagtgaacttcatgtttgtggccattcatgttctgaaacatgagttcttatgtctacatgaatagaattgaatggaagctatcgaaaatcagatggagcgaggtaaaaaagaatacactcagcggcgaaaaaatacacggaaacaaaatccgctttttgtaaacaagatacgcatacatctgagatcaggcagaaatagagaaaaaaccaagaaaagaaaaccaaatccactggtacggaggacatcagaactactgaaccactccctagccgattgtttgttttaatcaacgaaatcacccacaagacagcaagatttaggctctgtttctttcagcttaggattattataatctagattattgagtcagattactataagctagattgttataatctgtagtaaaataagcggttagttgtttatttcctagattattgggtttgcaagtctaaagaggaagtggggtggcatgatgggtaattttttacccaataattt

SEQ ID NO: 41265 - DNA, 1501 bp, Oryza sativa
ctgcacatcgtcctggaaggtcggacttgcagattagtacatgtcgatatttttctgttcttgcaagtcaataatacacgttgattcttggtgccgtgatgaactaccggttaaaagtgtattggttaaccagctttttaaatccgttggtccgtagacgccaaacggacagccccttaaacttttgacttgagtgtgtgcattagccattgtacatgtacgtacaggcgtacactcgcgcgtgaagctgtcttgagctcatactcaaaccatcaaatttgatgtagcaaatcttcctttacttgacaaatgtttcctgagagtctgaaactagtactaatactacttcaaagatcgtcaggaatgagctccagacaaatttccgaacctgataagcatggatactgatttgctgttggacccgtgcagcgagcttccaatccctggtctgttctcttgatcaagcaagcaatttctttatctaaagaaagaaaccaaattctgtctgtttattcctagttattactagcattcaggtacgggcattcacaccagtagctggtttccccggaacaaacctgctctcggtttttcattcgtctaatctttacatcagatgtacctctcatcacccacatgcttgtactcgctcatgtttctactttggcactttgccatggaattattgggtgtcaattggtgtcagtgaccgtgaggatgtgaccacccgcgaggacgagatccttgcgcttagagccggtacaataaaataactcaacaggcttcaaaaagttacatatcatcgtatttctacgtggaggaaagataaaccagaaaaaggaagggaacggacgactaatctagcgccgacgatagcacggctccatatgcgcatgcaactagtactagcgattaaaaatacattttttgggccccacaccaccccatccgatcccgtgtggtttgctctccttctccttccgcccaagtagtatttcccattgccgagcagtgcaactgcgcaacacaggttcagatcaagcacgcggaatcgctctcctcttcctcctccatatcttctccgatgcagcgacgcttcttcctagcatcgccgtcggtgccaccgttcgccgcggcgtgcagatgaaggccatctgaaagcgtcggcactctcttccgttcattaaaagactgatcccagtttccagcctccgggcgacaccactgtgtgctagatctgcgccggtcgcttgatcgacgcccaccgcatgaagctggcgttgtctccatgctaagaccctgtttctttcaacttgagattattataatccagattatgagagtaaactgaaagaaacagacaacttattgaagtagcttattataatctggaacccagcttattataatctgataagctcatttaggtgagctttttccaaattattgggtaaaaaattacccatcatgccaccccacttcctctttagacttgcaaacc

SEQ ID NO: 41266 - DNA, 1501 bp, Oryza sativa
ctaatcggattagattagttttggtaactccctttatttagaggtatcttctgtatgaggaggtatacaaatacaactatcctaagataggagaaaacctcaccactaattaatacatagtttttaagtttaggacttccaacaccgtatgttaacgacgggaagggaaaggtattttttttcataataaaatctatcaaatgtcattgtagaagtataagggagatttcaaggataagattgagaaatacacatagagtgccaaaggaaaaaacaaaaagctacatcagtggctcaggaaggagtaaggggtgcccacaatatgatgggactagaatatctacaatgcttctttccaatcgcgtagtagtacaactacattataaacacctatatatatagtgggaagataaggatatgatacaattggctcatgttctgcaacaaggatagaagactcaaactaacagttcacaatgcaaaaaagaaacacggctctcactagctgcagtttggcaaattggcacatgccaccatcatggacgacaggacgacggtgcacaaaatatagtaatatgaacaactttagacgaaaatgtaagcaccgttaggactggccacaggacaaaagtataagcaactatatatctaattaattaagcagcaacagaaatcttgaaaacgacttttcattagagggatgcatcaaattaaaggctcaaactagtaatgctagagcaattcttttgttatcaaactagctattcgtgcccggtagccaaatacctccaactcaaccaacgaaacaagctagctgccacttggcagcattaacctctcccattacatccattaatacatagagtatgttaactaatttaaaattatttcctattgctatccgctttgagtagttgttttgttggtaacgtggaaaggtgtcttgacatcaaatcgcaccgtcacacttttagtacgtcatgtgcaacccgcggcggtacccggagatgcgttgccgcagggacttcacttggcattttgctactactgtaatccaagatcaatttgatccctcgaggctcaaattgcacaagaacaatgttgaataatgttaccaagcggaacaatgccactgtcattatgacttccacgtgtagatcaagagggagaagtcatcgccatgctgcatctcggtctccttggggttcaccctatccatgacgatcgagccgctggcccacaacaccattgatgaggccacgaatcctaacaaggaggagctcgtgttgtcgtcgtcccttgtcaaccaccgcctagatatggacgtttgctcaagatcgacgtcgtagatgccatcaccgagcgttggttgtcatcgccaccaccatctcagagccacaaacctagttaccatcacaaccaagagtcggggtcgcagagccatcgctgaggacagctggtgtcgtcgaaaagcaacccttgttattgccgccgctagatc

SEQ ID NO: 41267 - DNA, 959 bp, Oryza sativa
ttagttttcttttatctttaggaaagtgtgtttagtgtcctataaggactttatcttttcattttatctttacgaaggtttctttcttgtccgacaaggacttgtatcaacccatgggtataaatatgtacacccggggtcattgtaatctatcttcacgatcaatacaattcggcgcatcgctaccctttttcggtgggacttggcacccgacgcggggctacatcgtctttgatctccggcgaagggataagtccaatgttccgccggtccaggcaattgtatcgtctacgtcggcgtcgttcaaggctgcatcggtacatttgaccttttggattgctctggtttggatgatatatttgcctacctatttatcatatgtttctgttaatctagtcttagcatgtcaatttagctctatcggctgcttctcgttttagggtttctgccggtatcggctaaatcgcgttactagattagattagcttagacatctaccaccctgaaaactcagtcaacggcttgattgtctagatattatgtttcttttcatacttagtgctgcatcagttaagtttgatctactaagtcgtgcttaaaaccataatctctagcctgcttcttgattgccaataagggtttcatcagggtttcagccggtgagttatctggatgttgcatcggctcataatgattgcatatacatataagttggatttaaccgatgacaacaaaggtttcactgtttaatctaatcttgtggatttcatgatatcggacctccagccgatgtgtgttttaaccctcggatcgatgcttatttatcatatcattgctagccgattggtttatacaggactatattgttattttattatatcatcatcagtcgattgcctttatatcattatctacattggatatatagccgattgcttaaaccctatcgctatcggctg

SEQ ID NO: 41268 - DNA, 727 bp, Oryza sativa
acaggttcaattagatctcccggcgacttggcttctgtaggcttcaactccgtaggctgtggtgaatgtgctggctacgagattcgatgctttaggtccttccaaggggtcctttttatatcgcaggtcaaccggtctccaagtaggactcgaagacatcggactcggcacgatacaatgacgacctagttctgtccgagtaggagtctttccatctgtgaacctcgtgatgaatttccttaacgtatgccgaaaccgtccgtattcgcgcaggcatacaatatcgatatgtgacgtatatcgaagggtagagggtataccttacccataaccctgacagtagccccccgacttctgcttaaatgaacttgtgtaaccgatcatgacttctgatgtcgaggttgttgtcgttctcggtgtgaggactgagaaacgaagagtaatcgacaacgccaagtgaagctcaacggtcatgagtgaatttaaattaaagtccgacaaactgccgcacgtaacggacccagaaatttccggcggccatctcttcttttccttggaattcgcaccatcggaagtgtgactataaaagggagttttggggatcccttttgaagtccgcctgttgtgaaaaaactctccaacctccaagcattcctcgtcttctccgctcccgcaaaaaccctagctagctcatttcggtcccttctccggcgatctccagcggcaa

SEQ ID NO: 41269 - DNA, 1501 bp, Oryza sativa
atgctcgccaacttcaccatggccgccttgaacctgtcctcccaccacccggggatgacggcgttgtccaccaccatcttcgccgtctccggcgacgtcaggagcgccgcgtcagaggtgaagagcaccttgtggtcgagcacgttcttgtagtactggttgtccagcgtgttgggcgtcacgaagtccagcatcaccgtgggatcgttgccgccgggcgtcgcgtcgagcgggcactgcgacctgaggaaccaggcgaagccgccgtcgatgtcggagaagacggaggcgttgaggcggtcggggacgaaggaggagcagtgggagcggccgacggtgtgggcgcccgagagcaccaccatgtcctccacggagaggcccttgacggcgaagctggagacgaggtcgctgaggttggacgtcggcggcgggaggaagtcgatcgggccggagtcgttggagaaggtcccgtcgcggcggcccgacggcatgtcgaagtagaccttcccgccgctgaggaagtaggtggcgtcgcgcgccgcgaaggcgatgatgtcggcgcacgagacgacgcccgggcacgccgcctccacggcgtgcttgatcgcgtcgatgaggtcgaagccccgcatggacgggttgttcggcgcgctcagcttctctggcgtcgggttgaacggcgtcgggtccaggaggatcgaagcatcacaaccctaacaacaaaacaccatgcacatctaagtacacatagctcaagtcgatcaatcgatctcgccggagaagaggaagaagctaacgtacgcacctcgacaaagcagtcgtggaagagcatgcggatgacggcggcgccattgccggggttctggcggacggcctccccgacgacggccttgacgacggcctcggcctggggcacttgtcgcggtagtacgccaactccagtggccagtaagggtgagcctggcatgccacggccagcagcagcagcagggcacacgtcaccaatggcagacttggtgatgaagccatggctaataagcttgcttagtgtgtagctagcttaagcttactgtaccttttgtgcttaagctaattaaactggttttgcttataaccggaagaaaaaaaagtgcttcaagaacaaggctgataaccttaaggttaaaattggggttaatgaaaccattccccttgggcctgccttgccaattaaaagtttaaccagagtaatttacatggttgtacataaattatgcatagtgtacaacgattccctgttagctgcgatagttttagcgtgttaatagctacatgtttgaacagtagctattttcattttttttatttttatcgtttaccttttagtttggtgttctattgttttccaatgtgaagctgaacgattgggattttttgttagacacaaaatgttgtcacatgttggtgttatctcttttaggtgaatcagtactcttcttcacacgccacacatgtccagcct

SEQ ID NO: 41270 - DNA, 1073 bp, Oryza sativa
agaatagtcaaaggctgggtgggctcgagcctggagcggctggatccgcctaccaatgaagtcggcagcgacttcatacctcgacaaacctcatactcggaggtcatcgatggcatcgatgaaggattgaagagaaggggtcaagggaggttttgcggtccaagacgaaaatcttgtctggttgttcctcaggaacaatgaagactggatcagaattttctatctgaagatagaaccacctcacccgccatttgctacgagaagaagggcgctggaaggggatatagcgtgacttcaggccatcccggagtcggaaaccgaccaagaaacggctgtaccccaatgtagtcatcacaacgatgcgaaaaaatactgaggaaggcgatggaattggggttcaaatggagcaaggaaaggccgtagaaattcaagaccaagagaagaaattcagaaggcggagaagaaaaccacagagaatatagtcctcgatcgcaaccatgtgacccaggacaggctggggttcagtacctcctacttctctctccatggtcccgcgaccgggaagggcgccatccttctgtagcttcttcagcgacgcgctggtggaggtagacttgtcgagatccattgccgctggagatcgccggagaagggaccgaaatgagctagctagggtttttgcgggagcggagaagacgaggaatgcttggaggttggagagttttttcacaacaggcggacttcaaaagggatccccaaaactcccttttatagtcacacttccgatggtgcgaattccaaggaaaagaagagatggccgccggaaatttctgggtccgttacgtgcggcagtttgtcggactttaatttaaattcactcatgaccgttgagcttcacttggcgttgtcgattactcttcgtttctcagtcctcacaccgagaacgacaacaacctcgacatcagaagtcatgatcggttacacaagttcatttaagcagaagtcggggggctactgtcagggttatgggtaaggtataccctctacccttcgatatacgtcacatatcgata

SEQ ID NO: 41271 - DNA, 1501 bp, Oryza sativa
gaaactcaatattttcataataaacagtgccttggtcaagaacttgacaatgattttgagaaggttgccactagcaggaatactgaagaaatttgcaatgacaaggacttgaagattattctcaatgaatcttctattcaacatgatgacaatgactgcaaaatcctactgttctgattcatccatagaaatatcttgtttgacgaatatttctaaggtacacacttcacgtagttggagatcacactgcaaaattgttgtaacctgcctcccaagtcccaaatgaaaatttattttgtgaactacccacaaatagtgacctctaaataatctagttgtgttgtaatcttatttggcactaaacatgttttttttttataatttcaggcatataacaatcatggcaaaacactaaagagttgatatgtgatgtcaatgaacacatttggttagtcagccactagcatttgtctatatattgcctcattgggagaggttgtaagaattgagaatcatatatttctattgcatcatgtgcagagagtttgtagatccattaatattttgttattgtaccatgatgttcctattaatactgggagaatttgcagctaatgttcacatgacatgttcctgtgatgtatccttgcgctctgcttttcatgtttgcttgttgctgcgtttcagtgttgtacgataatgaatttatgaaatttctagaatcacgtattcaatgttacctagtgttaatagctctcggtaagttatgtaacagtaccgtgtgtttgactacaacacacggtaacattttattccttcccgtgagttcgtacctctcggtaacacccccgttccgtttccgcaacctgtcctgtgctggtcaatacattgttaccgagaaagtgctttcacccggtaatttttcttgtcttaccgagtgtacaagcgtagtctcacgggaaatattgcacggtaaaggtgtgaggccgctgagtgtctgttcccgagagtctgttctcgggaagctctgttcccgtgttttttcgctgtgttaccgagagcttttggcacacagtagcttccctctccctggtagtgtagcattctacaaaacgcttctaagacgccatgtgactatctaataaattagaaaaaaaatcctaaatattcctttaaagaggtggacccactattttcaaccattagatcactcaaaaagaaaaatccggtacccacgcccaccgtgtgtgggtatacacgtatagtacgtactccatgaaccctcctactttccttggggatcctactcccctcttcttttttctagccaacgtttcccttttttctagctaacacataatatataaaaataataatctgatagtttctcaaattatttgatttgttgtgttatttataattaagtacataattcaagatccatatcgtccatatttactatataaaatgtagataatctagccgttctgactacaaatat

SEQ ID NO: 41272 - DNA, 229 bp, Oryza sativa
tttgccttcacattggaagatatttttttggtacgttttggagttttggtgaaaacaaagaagtagtaaaatactcctacatgttactacatccgtttcaggttacaagactttttagcattgcctacattcatatagatgttaatgaatccagacatgtgtagattcattaatatatatataaatatggataatactagaaagtcttataatatgaaacgggaagtat

SEQ ID NO: 41273 - DNA, 1501 bp, Oryza sativa
cggcctgaaacgtcagttagcgtagatgggccgtgctttgtagcaggctgtacagtattcacacgcaacgcagagctgggtcgcattggaggccttctgggtcgtgggttttgccgcggcggaggcctgctcgctgtcagcctttgaggcaaagggtcgagatactctctagtcgaagtcaagtgacaaaacatgtggatccgatcttaatcattggaactatatgtcagtgacaaatgtacatttaactgcaaaggatctcaatctgagacaaagatgctggacagaagcaagcagcaatggcggcttcgttatcccctctgatctgcaacaacattggctggagatgaggctacgacagcagcttgggccttaaggaagaagagagcccaagtcaaagatagcttagcttgagaaatgcagagttcatcgggctacagaggagtgatggcgacaattaatctacacgtttgctggtagccggcgactgggagcacccgcgatcacactctaaggcactgttgccaatccggcaagtttcagaagggagtggaggaattagcaatgttcagaggaacttgagatgaagggcatccccaacagcatcaccatttgagttctcagggggcaaaaaaaataaattaatgtaagtttgcagcatcggagatgaatgaagacaataataatgtggctttcaggctggcttagctagcttgttattagcctctctattccgtttacaggcatgcattgtatacttgtgcgaactatttgtgcgtgtttgatcgatgaattgtgtggttgtgtttggttttgaaggttatcaagtattggaatataagtgaaaattgttcgtctttgctcttctgcttaaactttcgggttgatatagttagtgtgcacaactcaattagtatatataagagagagagaggtttcatgattgaatcctagttgacatataattaaataactattatctccaatttaatattatataagttgttttgattttttttctaagtcaacttctttataattgactaaatttataaaaaatatacaatatcttcaacacaaaataaagaaactatcaaaacatattgaatgttagatgtgatgaaactaacatgatgttataagtgttgctataattttaatgaacttagttaaaagaagtttaactaaaagaagaaggtcagaacaacttataatatagggggagtagtagggtggcccacgtagttacgtggctagcaccgaagttaaactgtatcatgatgtaaaattatctacctcctctatttcacaatataagtcattttagcatttctcatgttcatattgatgttaatgaatctagatagatatatatgtctagatttattaatatcaataagaatttggaaaatgttagaatgacttacgttttgaaacggagggagtacattgttttaacttgatttttttaaaaaaaacacaaattagaatattcgagtcg

SEQ ID NO: 41274 - DNA, 366 bp, Oryza sativa
actttatcattggtgtaagcttcaatatgttagtgcgcttggcgaattcgcatgccctatcttgtggtatgaactgagcacacgataatttatggtgcgtattgggggcttacaataagataatgccgtgaatttgctaagcgttcaaacccactgaagtgttgtgtgaaggtaaatatttgtaagtgttcgtgaaggaaagacatgcaaatattttgaatttatttatttagaaatgtagctgacatattagaaagttttaacacacaacattacatattaattagaataagaaaaatataaaatcgttctactcattagcctcatcatcgaaatttcaggatgtgctagtgtcctttttctttc

SEQ ID NO: 41275 - DNA, 1501 bp, Oryza sativa
tgctagaaacactgtatttagctggcaaagactccaacgataacattactggctgggattcttgggcttggtgatgctgttttgcttcttgttgcgccgtcgcgcaaatggttttagcatcttaatccaggcggttgcctaatcaactactttggcacgttgccatgttcctctagagcaatgcgatctttcaattgacgggttctttgcagtgaaatatacttctgcgataattaaaagaagagtcccgctccggtgctttctacttggagtagaaagtaatctgagccgttgatcatatttaattgtagggttatgatttatttctactcccaccaaaattagtggtagtagaaatgtggaagggtatattcgtccagggataataattcgcgtaaggtattattgtaatttatcagtatctaactcatcttcggcgacgcgcatcaccgccgtcttccaacactgcgacattgtcacgcgccttccctccgcggccagcagaacaccatcaccacccaatcccgcaccaccggcttctcgttccaggactgcaacatctacgccgacgacgacctcctccgcggcgcccccgccggcagcagcatggagacctacctcggccggccgtggcagccgatcccgaatagcccgccgttctccgacactgtaaaactgatggctgattcctctgacactgtggcaagaacttgccatgcagctcaagaacatcctctcaacctcttcagaggcatctctgctaatcaagcacatgacttgctccatcaccgacgcatcgcacgtcaacatgatcctgccatcgtcgccggcaaagccaaactcctcttgagacatgacgaggagctcgccgaggaccatcgtgccaaggtacaccaatggcacctcaaaccgcgccccgtcggcggtgtactccgcgctgtggcccttgccggcgagagacgacgatgccgtgctgcagcaatcgccggtggtgcctgccgtggccgtccactgaacctgatgcgatgcgaaccgaacaaaacatcccatgctaaaattactcctaaactatattaggagattacttacctgccctttaaaataaacggttgagattaattctacttgtagtagaatactgcaagtaaagagtaccggagcgtcacccttaaaagaaaaggatattttctacatttcatttttagacatattttctaagttccagtcacctaaaattgcacatcgctgattctaaaattatagtgccatatatgcaatgtgtatttttttagttattaaaactacagttttgttgttataaatttatcatcattcaactccatatgaaagagttacgattttttaaacacaaaagtattgctcgtatttccaaggacggttctattatgtgttttcttaatagaagcgtccgtaaaacccatcctattttcacaggcggttttattgatcgctagtgaaaattaattttcataggttgttt

SEQ ID NO: 41276 - DNA, 1501 bp, Oryza sativa
ctaaatatcaagtgccaaaatgaaatatgtgctgactgatttgtactcccttgtgtcttttttacttgtctagtacaactgagagagtatcaaatgcacatgttgttaccattctctttgtctaatcatatatctataagaattagtagaaatataactaaaatgccaaatttaacaaactcatttccacatatcaaatcttattatttttttcgatattttagctggtaaagatttttgaggtttgcatgtattctaatacaacaccgaaaaagaacagaggggttatgcattgtaaaagttgtgccttgaatggtttacgctgttctacacggtacatgtgacatgttcaagagcttgggagtgcaactcttgcagtgtggatggcctcatggcaatccagtaggtctgaacagaatcaagcaatattttcattgtcattaattaagcaatagatgccattgtttccatgaaaagtagctgcactggtctgtcactgtcattgttaagttgtccgttagcataattcacctctcaagaaaacccctacattttgatcctgaattcattgctgacatgtcattgtcctgattgacaggctaaatattatactaggctacttggagtctttgatccactggtggagaaaccatctttcgtcggtcggccaaattccacaatagtcccggatgcaataaaaaccgaggctaaagatgatttttagtcccggttcaaaagggtaatgggcatatttgatctttagtcccggttggtcaccatctttagtcccggttcaaatgctgtcagggcctgtcaggcccccgggatctttagtgatcgtaactttagtcccggttggtagatctcggggatctttagccccggttggtaacaccaaccggaattaaagtcccacccctatatatatatgtcttcttcctcctccagctgcccgagcaagcttcaaaatttcttcaaaaaagagggtaggtcatgccaaaatttctagtgaatttattttggtaattacatacaaatcggaggtgcctaaaaagtttgcaacttcatcctccaatgttttttttgtcatattacatttgcagtatgttttgcacacttttttgtctctaaaatttagttgtaagttgatgagagagaaaatttgtgtgggttagaaagaatatatacaaatttagttgatttgataaagaaggttttataaaatagttgagaaggaaaactatagtgaaagttaatcttgaatactagaaacaaactaaaatgaaaattaaaagaagtaaaacacattaaaattagtttaaaactttagaaatagtaaataagaattatttggtgtaatattttatgatttttgtatgaataaagatgtgtcattattgtatgactgttgaaacagtttgtaattatcttataattattgtatgactgtcattattgtaagaataattatttgtgtacgatttttttcgactcatgtaga

SEQ ID NO: 41277 - DNA, 272 bp, Oryza sativa
accaggtactcattccgtcccaaaatataagacctagaatcgtagatgagatgggatattttctattgttacgaatcagaaatatccatctgaatttagattcttatattgtaggatgtagggagtccattgcatttgtgcagttgatgttttactttggttgagaaatttcaatgcagaatgcagagataggaagtgatcgttcttctttttagcaaaatggaaaggattttgggtgagtgtgattgatgttgttttgcaacatggatgta

SEQ ID NO: 41278 - DNA, 1501 bp, Oryza sativa
agcgcctaatcttgcgcgatgaaggctttcttcttgatgctgctcctgctacgaatttggctagtgttgttgtgtctactgtggaggatagagctcatcccaactaacttttgattgtgctgcattcgttgtatgctcgtgtcatgtctgcaagtcatttcatagcttatgattctcttaatcacttctcagcttatttctcgacagaaatcttgttaggtcgttagattctagaacgccgaagaacgaatatttcggttgttttcctttactggcaaaccattttccctcaaatatattttctgtacttgggagctgtctgtaacaagacagacatgcctttcctttcagaattttattatatcggtgttcctgttcgaacctactgcttgcgtgctagtgtttttttttacactgatttaatcaagagtttgattatcctgtagatgcgattgatcgtttgcttgcccaagttttgcttttcctgctaaatgctgagggcgacgtctctgcttcaatcggtttcagacggtctaaaaacgtggctctgctgcttcgcggcgttctgctgatcacacaattaaacaactactcgaaagcacctgtttatttttagacaatgacatttgctaaatcgtcagcgttactaactgctcaaaagtagtactacttgcatgttgtatgtgtcgatatctcattcttgggaggtcggcactgtcagcaatcagcagtacatttttgtttaatggcaacattctcccatagctggttttaaggctatatttattgtccttgactccttatgcattgctgaattttcagggaactgcttgcttttttactgataatctgatgcttcctctatctctatgcagattgtgtgactgcatattttccttggtcaactttgtttcataaccggatagatgggttctgaaggaccttctggtgttaccgttcacgttactggattcaagaagttccatggagtcgctgagaatccgacggagaagattgtgcgcaatcttgagtcatttatggaaaagagagggttgcctaaaggtttaacacttggaagttgcactgttcttgagactgctgggcagggtgggcttggtccgttgtatgaagtgtttgaatcagccatcgtagacaaagagtatgggttgaatgatcaggggcaagtgattctggtcagttctcatctttacagatttactcaattgtacattattagaaagttcatgatgttatcctgagaagtccacagtaatgacttgacaagtttcatttgcccttaaatgtaattggatgctatagtgaaacttattttgcagccaaatttactgtttgataagaaaatatgaaacgcttttatattctagttttaaaggtccgtcaaggttctatttgtctaacatttgtgtgttggaaagaattgtttctctttaccttttattttttgattgaaaccaattacttttatggattttttttcagc

SEQ ID NO: 41279 - DNA, 1501 bp, Oryza sativa
gctgggccggcacgtaggcacgaccaacacactgtgctcgtccttagaataggtttattttgcattcctcctctttgggttgtgccctatatatggcttgaataagtctagattgcctccctcctctttggactgccttatacacatctgaataagtctattcgcctccctcgtgtgtcgtgccatgcgaagccagcccactgtgccaaggtagcgcccccaggctcagcccaactgtcaggccgggccggcataggcttgacaccaattaggccatgtcgtgcctggccggaccaaaaggtcgtgccatgggacgggatgtcgggccctggaccttttggccattatattcgcaactgcgtcaagtcaagcggagcgaggaatcctatctcacacagacgcacgagcaaactaactcgcacgtgatttggatccactaggccccactctagcctacagctctacactgcagtagcacatttctttttttcctttctttcgcgtgattttttttcacacgtgcttatctccctctccgtccttcgtttttgcgtgcaattttttttctcatgtgatttttcctttttctcacgcgattttttctctttttttcgcaagatagctaggtaagtttcaacctcattttattttgaaaatttttgactcaaaatttaaaaacttctaacacaaaattgaaaactttcaattagaaatttgaaactcttaactgaaaatttaaaacttttgatcaagatttgaaaactttcaactaagatttaaaatattcaactcatgatttgaaaactttcagcttaaactttaaaatttattaacttgaaatttaaatatgaaagataaattttgaaaattttcaactcatatttgaaaagtttcaacttgatatttgaaaactttcaatccgagaattgaaaacttttaactcgagatttgaaaattttcaagtcaagatttaaaaattttcaacacaaaacatttgaaaaccatgtgttgaagattaaaaaaatcgtgaaaggaaagaaaagaaaaaaaaatcgtgaaaagaaagaaaaggaaaaaaatcacttggggggagggggccagctggcgcacgcgttgccgcgccaatttgccacacccgagcggagcaccccgtcggatccgtacgtaatacacgcgtcgtccatcgagagcggtgctgcataggtggcgtgctgccgctgggatgcatcaattttttttatttacattttgaggcttttcttttcatcgtccgctctgttccattcgccgccgtcctccattccgttcttcctcagctcccgtcggtggtgcttgaaagagtccgttttggtgctggccttcttcaggtcgtcaagttcgccttggcgcgcggtgcttctcttcttcatcgtcaggtggttccctgcgctctcttcatgtcgtcaaattcgtgtcggtgtctcgtgctgctctccaacttgctcagatagagatagttcgg

SEQ ID NO: 41280 - DNA, 292 bp, Oryza sativa
tatttctaataatataattacttagataccgtatgaacccgcagaagggatccacggtacccagcccattgatctgctaggcttcatcagtcatggtactgccaccagacctggccaccatcagaggcatggggcagcaagtttttttttcttcgaacgatcaggccgttgccgacgttttacataaagaagaagttgttttattttaaagagaaaacgagaccaaagcttacagtgcatagttaattagggaaaactatgcgaaaaccacaactattccctgttataatta

SEQ ID NO: 41281 - DNA, 1501 bp, Oryza sativa
aggtagccgtagttgcgatgcgagatttatggagatcgaaacttggactggttgatgggccgagccgaaccagcagaccagcccaattccttcacatgagcaggcggcctagggaggagtcttgggctggtagttaatgggccgaagcagcagaccagcccaagtccgcacgcgaagctccccacggcctctccgccctctccgctcgaggatctccacctctctcgccatccgccgccgccgccgccgttacccgtgccgccgccgctctccgctcgccgttgccgggatggagggggaggaggaggagaacgtggggccgttccgccgcaccagcgcgcggacgcggcggatggccacgcgcatggcctccgcgctcgccagctccgacaaccgcgcgcaggttcgtttccggtcggtcgatgccttgcttgcttcctcccctccttccttcgattcgacaagctcgatttgctggctgagcttggcttccggcattaacagctgcttagtagtagtaattgttattgtctccggattaaagctcttgccctagtttatctcttccttacttgcacttgatttagtcgactttggaatccaaagatattattacatccatttcatcctatgtcttgctgtattcaatactatctcttgatttagcacttgagtagtcgacttgtcttgtcacttctcacggccgttcagaaggtgtagtaccagtattagatggagattaagaaaaggaaagaaattagtttttacagtttgaaatgtacctaatgtggttttgtgtcaaccctttattggggcgttctctgaacattgtggttctcttattgcaatgaaagcttgtaatggacttttttttttagagaggtagagacgtgttaataatatccaggccagtggccaccgctaatttctccatattattttccttttttgtgaaatccctccaaatacacttgattattgttctgaattatagttgcaaattgggcttgtgtactgaaccttcatggtaacaaacgcctgctccagactttgcttgattattgctccaatgttaagggccacacattgcaggttttgtttgtgttaaaatagagcaattgaaaggattgggccatcttgaccggtagttttagtaaatgacctctgcagatgtttgcatgaagagttttgtgtagaatttctactgctcatatatgtggcgaatatgctctgccttaattataccagcactaatgttttgcttatgaccctttgtcaaagaaggaactctacaggatatagagctttaattctttccatgtactcttaatttcatttttactcgtcttctgtttaggattcagagttttcagtacaaaagaattttgccttcttggttatccatggatatttgaaatttactgattcccagttatttagtttctctaatttctgtctacatttatgtgatggcatgtaggctgcactagctcgtcttgaa

SEQ ID NO: 41282 - DNA, 1501 bp, Oryza sativa
gaaaacattttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttgtctcttcggagacatccgataaaattggaacgatacagagaagattagcatggcccctgcgcaaggatgacacgcacaaatcgagaaatggtccaaatttttttgcgaattctggccaggtccttgcgcgttcggtattttgttcgttattttcgttgcacatatgcccctgggctctgatttcttacatccaggtccttcaagctttgcactttttccctcaaagtttccagatatcgaattatggccaggtccttgcgttcttcattttcgttgcacatatgcccctgggctctgatttcttacatccaggtccttccagctttgcactttttccctcagtttccagataccttacagatacgcctctccttttgcaccctcatctttttgcaacatcctacaggcaggtccatgtcggttcttgatgcgatcttcaggcttcttactgttgtacacaattcactatttctttgcaacaagatatatacggctgtgccttttgtaaccccttctagtttttttaaacaagtccttgtgggaatatggagttttcacttgtaactttctggtttttcgttctccatgattgaacaatttgttcgtttatgtttgccagaagtactggcaaatctccattcaagtgtgcaatcatgtgattggggtgatttttcctcctaagtttttgtttatttccatcggagcataacgccatttttccttgttggatactctcaattgaaatcctctactgttcttatgggagagtgactatcctagttccattttattctttatcatttatcaatttataacaaacaacatctctagaacatattttacctgttttttagaggcatttaactttttgccacttttaagatgtggctattaaggatttgccactcgtagcttagtggcaaatccttaattgttactggtaagtgacaaatagttaattattacccttttctat

SEQ ID NO: 41283 - DNA, 1501 bp, Oryza sativa
ttccatgctgacagaccagaagagaggcgcagtactgttaagagaacacctgagtaaagaggagtatgagtagacaaaactacacaggtattgtactccctccattcttagatatttgtcgccattgacttttttaaatatgtttgatctttcatcttattcaaaaaattaagtaattattaattcttttcatatcatttgattctttgttaaatacatttttatgcatgtatacatatagttttacatatttcacaaaaatgtttaagtaagacgaacgaccaaacatatttaaaaaagtcaacagtgtcaaatatttagggacggagggagtatttcttttgcccttaatcactagctaatatttgcatattctgaacggctggtgagaagtgggaagacaataacagaaaaaccgaatataccaagagatatattgacataagatacataatcaaatataccacttgtacagaaatatttttttcaaacagccaaaactagatttccgcatgcggatcggagacctgtctgcaccaaaggatcaaaagctgattgaagattggtcggagaaagtcctgctgaagtctgaagcccgggaattcgcttcctgaagggctttgatctcgatatgtgtttagcaatattttaaatagcgggctaatacatttaacggttagcttctcaaacagctatagcaggggttaaagttatatcggagcaagtagctagaactcttctcaaacagttacagtggaggatagtgcagcaatagcgggaggtccggttttaattagctcgtttgctgataggtttggtgttttgcagtttaaatagctcggtgttgtcgtttatcgatttcgctatatatttgtcgacaaatttttccccaaaaatttgacagatataattacagtacaatcgtagtgtaattatactgtaagttgcatataattacactgtaactatagtgtaacttgtatgtaactttcaaaaatctctcggtaacatgttatttcggtaaaatggagattgtgggaacaaattctttcatatatgtgtgtgctatgatttgttttcttcttcaccaaaacaaatattgtaatagatctaacgatttaaaattatgtgaaacttacatataagttacactgtagttacatgtaagttatagtgtaattacatataagttacagtgtaattacactacaattgtactgttattacatctgtcaaatttttggggaaaaatttgtcgacaaatgtgcaggcagtcccgtcgtttatcagtctaactctaatcgaatcgacgtactataccttgctgctgcagtgctgcttcggcccatcaactgatgacagcccaagccccaagtccccccacacaagttcgtactacaatataggagtacgagatttgtaacctaattaagctaaccagcgttttttcctcccggcgcccatggaatacgacgatcgggaacggcgacgcgggagaagg

SEQ ID NO: 41284 - DNA, 1501 bp, Oryza sativa
attaaaaccgtttcaaacacggatgacgtaccaaaattctggcaaaaacacctttaacttttataataggtaaagattacttgaatactgttttaactagtataaattgacatggcttccttgcatgctccatataagaatgttgtggatagccagaaggcttagataaactttaagtaaactcttaatgccttgacctacaatcacattcattaccatttacctcttgggttaatgctttcaatggaacttatatggaagtggatcatagactttcattgtaaggtcaacgttcctccttgtttcatgtactctgttagccatcctgttgcctgttgtcctttgggccaaagcacaaaatatttttttccaactcgccttttctgataacttgacaggaaaaggtttggtcaccactaaagggtttaaaggctcgtttgctgatgctgcatcttctgctaaggtaatgattcacattacacatgttcattttgcagcagatgtttcattgttcacagctcatgccattattttgtcttttgctctagatatttgctgttcttgctggtgttcaaagtttggttgcctgcactttgagacaactacgtgggaaagatgatggtcagtcttgatatctattgtgctcatttctttctctaggaaaccatgtcccaatccttaggatgtactacaatcaaatgtcaagtacaatcattaacttgtgaatccttttatatctgcagttctcaatgctggaattgcaggctgttgcactggccttgccctgagttttccaggtaacgttacacacacaatgtagctgtgagtgtgaactgtttaaatttacaacttgttcctggatgtcctggctaggactggtattaatatcaacaagagcaattttcattatgctgagttatggaataggtgatctcaaacggtcctgacattgttcattaagaatgcatgcagcccttttgggagttattaatctctggcatccgtttcaagtttgatgattcaatctctacaattttttcattttcatgttcccttagtttgttcatataggcatttgtatctttatctcctatcttgttgataatgcgtcctaaactaatttggtttggatgcacctgaaatatttgtttattttcactacagttgttattatttttgttctatatttcatttttcttgtcttttgctgtattggtgtgcacacagttttgcatttagagttgtccatttatgtcttcatttttgcactggtaaaatgaagcactacaaaatcgacaatttcttgtgagatcatgagtgtttcttatcattattgagaacacacttttgtcctgtgacaaaatagctccttattcgcatgatgataacattactattaacagtgatatcggattatcggttcttcctatataggaaaatgttaacaaaaagatcatagtttcgtacctattcattaactgatggtcctttttcttctttt

SEQ ID NO: 41285 - DNA, 641 bp, Oryza sativa
cctatgagcatcacacttaggccctgtatagatgggactaaaacttttaagtccctatcacatcggatatttagaaattaattataaatattaaacgtagactattaataaaacccatccataatcttggactaattcgcgagacgaatctattgagcctaattaatccatgattagccatgtgatgctacagtaaacgttctctaattatggattaattaggcttaaaaaaattatctcgtgaattagctttcatttatgtaattagttttataagtagtctatatttaatactataaattagtttctaaatatagggactaaagttaagtccctggatccaaacaccacctaagccgttgtagcctatagtagaccttgtccaatggcagtgccgcagaggacgaggtcactatcacagcttccataaaccccagcaagttctacactggcacaaccaccaacccaagatcgagggcctctgcaccatgaagcgtgaccgggacgaaaagttcaccgctattgacctgagaacaaagggctcaccacaaagaacaaggtcagggacgggcgacactcttggatggcagtaggatgccatgaatgagcgatgggagaggttaggaatagggcgctgtgca

SEQ ID NO: 41286 - DNA, 1501 bp, Oryza sativa
tgatcctcgggaacaacgaagacagggttcgagtccttgatctcaagatagaaccacctgttccgccacttgctgcgggaaaaaggacactggaaggggacataacgcgacttcatgccatcacgaagtcggaacccgacgcaaccagacactctattgggttccatccaacgcagctcataatagaagcggaagagatcaagaataaggctctaccccaatgtaggcctcacagagatgaacaaagatactaagaaaggcgatggaattaggattcaaatgaagaagagaaagaccatagaacttcaagaccaggagaagaaactcggaaggcggagggagaaaaccgcagagaacgtaatcttcgatcgcaaccatgtgacccaagatgggctgaggattagtacctcctgcttctctctccatgcttccacggccgggaagggcgccgtcctcctgaaggttcttcaacgtcgcgctggtggaagccgatttgccgagatccattgctgtttggagatcgccggaaaatgggccaaagttagtgaactagggtttcttgcggcggtggagaaggcaaagagcgctggtaggcggtgtgtgttcaacagggttggcggacttcaaaatgggctcccaaaattcctttaaatagacacactaccgacggtgcgaattatactaatctggctatagaggagattattggattatactaatctggctatagattataataatctagcataataatctacttgtttgtttcagttactccttgtcagggttacgggttcggcataccctttacccttcgatatacgttacatatcgatatggcatacccacgcgcacgcggatatttcctgcatattctaaggaaacctttcacgaaatctacagatgggaagaatcctactcggacagaactgggtcgttgatgtatcgtatagggtctgatacctccgagttctacttggaaacctccaggtctgcgatataaaagggacccccggggagggcataggacatcgaatctcagagccaatacaacccacacagcctacgaagccgaagtctacgaggagccaagtcatcgagagtaagtcgaaccaactcgactacaatctcgccagatctgacaagttccatcgttccctttgtaacctgtattttccaccatataatcccataccaactggattagggctattacctatcaaggggcttgaaccagtataattcttgtcttttggttgcttgatgtcgtactacgtagatccttgtaccaacgtaccccaataccctctatatccggtctacgggtatcacccgtcgatactcctaataatctagattataataatcctatgctgaaccaaacagggcctaaaagaatctattggtaaattttttatatatatgtttgtagtggctcaaaagctaataataaaaaatatacgttaaaaatatatttaaataactttaaaatcaagttcaa

SEQ ID NO: 41287 - DNA, 1501 bp, Oryza sativa
gcaattaaatgatagtgtaagtttatcttttggagctgtaactactaatcaatatttattgtatatttattctttttagggaactactctccagcgttgcatgcttgctcggttctgtttttcattttcccacctgtacagcacgaatcttgacacaaattctacggccaagcgattgcgagagctcctaccacactttgtaacttgtatagtgtatagctttgtatcttttcccttttctgtgtacagcatgaatcttaacacaaattctatggccaagcgattgcgagagctcctaccgcactttgtaactttgtatagtgtacagctgtatatcttttcccttttctacccctagggttgtattttttttctgctatattcaatgaaattttctgctatattcaatgaaaaggcataatctcgtgctgttttcccttcaattttttttctaattgctatattctagtatacatggcaagaattatctacttagtaccgttgcattcgcgactgtctacttttgtagtagtgtgtgtgatccaaaactgcttttttttacatgcagtttataaggaagatcacatgtgaaaatagatcgattttagtagacatacatcttagaccaacaatctcaaaattgttgtttttggatgcaaactgcgtggggcatgcacctcttaaaatacagggctggcccacctgaccacgagcaataaattaatataagtatagtacttacactcctctcctttatcctgtcctaccccctcccccctcccccgagctctctcttgctgttccctacttgaggcacagattcaatactcaccaaaataaccacacatcgactacagacggctcgttttagagctctgcatgtgaaaaatgattttctcaaaggaccttctaatttttaaagagccatctataaaaattgattttcgttggctggtgtatattatcaaccaaatgataccacactaaaagattcattaaaattgccaacatattttatgttttaggagtgtttagattttaggtgggtgtcacttttctaatctcttgaattctcttggatacactatagaacaacgattttgtggatgcttctccttttattttacaagtgaaatataagaaattatgataatgttgagagggccttatatagtttaaaacaacctatgaaaattaattttcactagcgatcaataaaaccgcctgtgaaaataggatgggttttacggacgcttctattaagaaaacacataatagaaccgtccttggaaatacgagcaatacttttgtgtttaaaaaatcgtaactctttcatatggagttgaatgatgataaatttataacaacaaaactgtagttttaataactaaaaaaatacacattgcatatatggcactataattttagaatcagcgatgtgcaattttaggtgactggaacttagaaaatatgtctaaaaatgaaatgtagaaaatatcct

SEQ ID NO: 41288 - DNA, 894 bp, Oryza sativa
cattgtgaaacgggggaagtacatcttatggtatagctacatgctccttaaatatattccaatatcaatcggtgacatttgaaattatctttgaaacatacgtctaacttattttttgggtttctcttcaaaattaactcgagtatatatcatacattctccttatccctatgtgtgatttgctaattaaaaaaagcaccacagtatgtttttctcctagagaacaccaacccagctagtaactagttccaaatcaaatagtagatgataacccccacttgtgttatccatcgagaaacatgtccaacttgctcggaagaagaacggttcacatcttttcaacaacacaaaagggcaaggcaacagtgcaacactcgccaaaaacggtttttaattaaaaagtaataaaaaacatttttaaccgaagagccgccaccgaatagcgccgtactccacccggccgcagagaatccccgccgacccagtcccgggcccacctgcagtcacagccacccccctcacttggatttaccagaaaattttaccccatggatcatccgtattccctgatatgccaagatactgtttgtttcagtttaagattattgtaatctagattattaaatcagattactctaagctagattataataagctgacatagaataagttgtgagttgtttgtttctttggattattagatgcatctaagggtagtgggtcttcagccactcaataatctgaaaaaaacctcctctagaggagattattggattatactaatctggctatagattataataatctagcataataatctacttgtttgtttcagttactccttgtcagggttacaggttcggcataccctttacccttcgatatacgttacat

SEQ ID NO: 41289 - DNA, 203 bp, Oryza sativa
atgcattgacagcttgtagcggcaggcccggggcgctttgattgcctgatttttccgagctgttgcacgatcagcttggaagtggatttgtcaccgcctctccatttccccaccacgtgcatggccaaatgattgcttgagcctagcacgggatttggacggaatggcttaacgaacattgtgttgggctagctagttgggta

SEQ ID NO: 41290 - DNA, 1501 bp, Oryza sativa
aggactgtgcctaggccgtaggttgtgcccgtgggcgggcacaacctgacccggtcattaagcgggttgtgcttgcccaacttatatcgggcctaggcctggtcgtgcacgggccgggtggctcatttggtcatctgtagttgcgaatcagcatcgctcctctcgatcggctccctctgacttgcttgttccattcgaacccatcccggcttgcacacatcgacctctccccacctcctctcgaacgatccagatggccaggcgaaccccgacgccaagggcggatctactatgggcacggaggggctcaagcccccacaagcatcgttagaactatgtaagccctcactgagtttcttataaaatgagggttaaaattatgtctagtttgttcagccccacgtgttacttcttctatcctccattgtcagtgcttacaactgctccttttgcatcatgggcatcttcccgtccccggtcgtgtgggcagcattacagcaacacgagtttgtcctggaactggtactcgcccaacatagtcgccggtgatgtacgagtactacactataccgcctgctgacgctggtcgtcgtggtgttattcttggtgctggcacacgcgctctctctctctctctctctctctctctctctctctctctctctctctctctctctctctctcatgaaagcggagtgtgcatccatcaccatttgcgaagatgacctttgattattattttgtgattagaaaaaaaggctcgtgcgttgaaacgggtgaaggctattttaatcgtattattgttattttttttatctaaaaagtatatgagatttctattttgatagtattgatatctaatttagaacctttgttgggattatggtcatatactgtacgttgctttcttagggcctgacaagaattctaaagcaattagcggtactcgttccaagttagctgtgagtgttttaaaaggatttcttatacgactcctggtgcattttcaaaagtgaacgaatttaataaccaactcaaatacggacaacgtacaaagtattggcggaaacattttcaatttttataataatagagaagagatgaacaattgattttgaagataattggttttgaagattttctgatgatgaattgacctgacgatgaacaatgagttttgttagtttgggtctggtcagaccgacgtgtgttgtgcagtcaaatcggccagcccgatggtctgatcggacggctctgtgtcggttctggtttcggattgtttttttatacttgtgattaatttatgtttatgaattctagatgaatattatgcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcagg

SEQ ID NO: 41291 - DNA, 1501 bp, Oryza sativa
cctgagtgtaaccaaggatccttgatcccggtgccctggagtgaaatttccctagcgaatacacaatcgcacgaaagtagaacgaagagcacacagatgaatttggcgcaagaacttgcattctacttttcaggttttctctccttttatgagtactaaaaagaagtggctttgaggccgacgattgcgcacccacgaacgaggaattccacagcgggtccgacggaagggcattccaccacggtgccatcaggggcagtcccaaatgggactccggtagaagggggaaccaccacgacgctggtggggcaggctacggtagagtgcggtggtggtggggaagtaagtcgctgtcgggaaccaccacgacgtcggcgggggcatgttgtgctggattgcatcggcggtggggaaggacctcgccgtcaggaaccaccacggcgcctgcggtgaagtgcgtcggtggtggggaaggaccttgccgtcaggaatgaccacgacgtcggcgagggcaggatgcggtgtagcgcagcggtggcggggacaagcgaggagtcggacggagcaaggacgtgcaacggcaagtagcgcggcggcagaatcatagcgtggggaaagtgcagtggtggagtcatagctccgtcgacggctggggatgacctcggcttcggcagcggcggaagggacgaccacggctccggcggtggcggaaagggtcagccacagctccagtggcagctggggaagacctcagctccggtgggggcagcggtggagtgtgggtatggcggcggctagagaagaactcactccgacggcagcaatacacgcgaggaggaggaggtgagaggaggagcgagtactgcaaaggtgcagtcttcgtgcgaacatcttcgtgcggtgttcgcacggaggcgtagtattcgtgcggtggagatggagagggttaaatcgcggtggacggtagggatcagatcagggcaatacagatgcagatggacggcagagattacacatgttggattggaagggtaaattcttcctttttatatcttagtatagaaaagggtaataattaactatttgtcacttaccagtaacaattaaggatttgccactaagctacgagtggcaaatccttaatagccacatcttaaaagtggcaaaaagttaaatgcctctaaaaaacaggtaaaatatgttctagagatgttgtttgttataaattgataaatgataaagaataaaatggaactaggatagtcactctcccataagaacagtagaggatttcaattgagagtatccaacaaggaaaaatggcgttatgctccgatggaaataaacaaaaacttaggaggaaaaatcaccccaatcacatgattgcacacttgaatggagatttgccagtacttctggcaaacataaacgaacaaattgttcaatcatggagaacgaaaaaccagaaagttacaagtgaaaactccatattcccacaagg

SEQ ID NO: 41292 - DNA, 1501 bp, Oryza sativa
tctttagtcccggttgataacaccaaccgggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaataaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatatagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtcgggggaaaacggattgtatcctatatcgcggtgaggagtacgagaacctagaagcatgccctgtttgcaaagcactacgatacaagattagacgggacgatccaggagaagttgacgggcagctaacaaagaagagaattcctgctaagg

SEQ ID NO: 41293 - DNA, 1501 bp, Oryza sativa
caccattgaagccgttgagcgtcatgttggtcttcttcaactcttcatctccacgccccaacttcttgaatagtaagtatggcatcaaattcacggtggcaccaccatccactaacatcctaaagatcgtcttccatcaatatgtcccttgagatatagaggcttcatatgacgattagactcatcaggcttctcaaaaaccatatcccttggtcctagtgaaagttgggcaattctggcctcatccatggcatggaactccataggcaacatacacaccatgttgacatccatgttcccttggcggtgaatcattactaacaattggtggctcatcttctttcaagtcttcccttcctcatcttgagcaaccaccggcttttagacctccattggcttaggcctccactcttgtcttgctggtggtcgcaactcattgaatctcatatctctccactcttcggatttcttttccctcatttcttgagcacgaagatgttgcaacctcctcttttgtgaagccgtcaaattcttaggcatccacctttaatttgtctctatcccaggagcaatgtaatgtccctaattgattttacttgatgaagatgaagctcccgaactgctccctagatgaccccggtcagaccgacctcgagaccaggtcaaaccggttgaagaccgccggtcagacaggcccttcgcgatggtccagctcctaattggcttcaatcagaccggccctaaggcgcggttagaccggccagaaggcctggtcagaccagcactctgcgttatgctggtcccggctttggttttcttactctggaccaccttggctctatttccagtaggtattggtacatcataagaccccactttgacagtaatcaccttcgaagtccttggctccactttagcatgctttcttcctcctctttcctcctcaaaccgattttttgactgaaaccggtctttgcttgataaagacaaccgctcatgcactgaccttcgtggctctagctaacctttataaaattgcattggcagcatgtactcgtacattggtggtggtgcctttcatggcatgaagtaagggaaaggataacccagcggcgtcattggacaaggcccccatggcatgagttgaggattgtaaggaaaaggttgctccaattgccttggtaatcaacacattctctcccaaggaagtgatcttggtcttttacccttattaggatgttcctcggcactcttcttcccatacttgttcaaaagcatctaaaaagacgcctttgacttttgtggcgttctagaacttgaagcttcacctttattctccttccatacaccaacttctagactttttggcacaatcatcttaggtctagattctcctatcacaacttccttcccctttgtagatatagcttgctcccgccaaattaacacattcttatcattgaaatcaatagtattcacaggaaaaaaaaatcataatcta

SEQ ID NO: 41294 - DNA, 1501 bp, Oryza sativa
attatgattagaatttaatggctgatccaacgtgtcatcacattgaatttcgcaaaaaaaaagagtaaatttactcacgagtaagaggtgtcgcgtgctcgcatgctttgccaagacgtgccctgcactgcatgatgctagctttgagctactaactctcctaggtttgtgttaaatgcagctagcgaatgcgtgcgtttgcagaagagagattgaaagggcaataggagtaggagcactagggcacgctcaaaacaaggcgataatgtgattaatgtcacattgatgcgtgggcgacgtgtcattgccatatgccctacatctttggactggctgtgtttagtcacctttaaacttctaaaaattccgtcacatcaaatatttggatacatgtataaaatattaaatatggacgaaaaaaatcaattgcataatttacatgtaaattgcgagatgaatcttttgagcctaattacgtcatgatttgataatataatgctacagtaaatatttgctaatgatagattaattagtcttaataaattcacttcgcagtttaccagtggattatgtaatttgttttgttattatactacatttaatatttcaaatgtatgtccgtatacatcagaaaaattttgggcatgccaaagtggaaatgacgcatagatctagtagtgcttgcttgacatgtgccacaaaatgattcatccagaaacagctgattaatttgtagaatggcaaatctatatttgatctgttgatatggttccatttgttttgttaactcttgaaaaaaaaatcaatttcagtccctgaatttgtttgttttcaatttgtcccctaaaaaagatcaatttcagtccctgaatttcaaaacaatatagaacttgtcaatatactatcaatcatcagcagaaaactggtgagtgttgtcaaaaagggagtaatgagaggcagaggagcatggctgagatagtggaatattaggtgtcacaagggtaggaatatgggggcagaacacaattctaggtttcacatttgcacaaaagccatgtgggtcatcatcacatgatcacattcatgcccaccaagaagaagagacaaatctcacaagtttagcttcattcacatttccaggattgtatgtatggtggatgctactctccttgtaccagccatttaagagagtgtttgggagagagaggctaaactttagtccctgacttatgcttttgtgagagggactaaagtttagtccctagttcccaaacaccccctaaggaccatgccctgtttagttccaaagtttttttttaaacttccaactttccatcgcatcaaatctttcatacacacataacttttctatcacatcgtaccaatttcaaccaaactttagtgtgaactaaacacagcccagccatggaagttgccagtgcagtgtggtacagactgacacttctcttggatcacgcaggcttttccagaagtatgtctc

SEQ ID NO: 41295 - DNA, 153 bp, Oryza sativa
tccccagatggtatacccgagcaatgatgagagggagtaatatagatagctgaatattgtggtgacttggtcttatcttattattattttttcaacatatataaacccatgttgcatgtaactcaaaaccatgctgtgtagtatctttacagg

SEQ ID NO: 41296 - DNA, 1501 bp, Oryza sativa
tgacagttctaacacattgtaaatgtgatagtagtcacagtttacatttccttaagcacaggccacatatttaacatataaaaacaaacaacatccctgaatgaatgtactttctattcatcatggataatactccagattttatggtggttaacactacaagaaagttcagaaatatgtcactatatatggttcaacaaccaacatgtttacaatgcactatcaaatgaaaaatatccagccatctagcggcgaaaagacaccttggccaaccatgtttggaaaacctcaaccacaaacttatgagtgataagaaatatcttgttcaacaagtcagacagctaacatggacagtggaaaagagaacctttcctaaggaggtacaaagtcaacctagtggtaagtaaatgttacaggaggccttcagtgcaaaatgctaactcagcagtcataaagctagtcagattgatttcataaagctgaagatgcatatatactattttgtgcatgtgcattcctgcgaaccacaccacaagggatactgaaatatcaaacagacaggaataggaaagtgaagggccaaagcttacatgatccaatgacgacaaaaatgaagaacccaagcaccatgggtccaacagggtagtcattccccttcttcacagtagtctcaggcactgaacccctcttcgtgatattcttctggaactttgcgctcttcctgtcagcaagacgccttgaggtagtctgaatgcaatgaaatagtttaggatacagtaaaaagaaattgcttgaagtggacaaatataacataaggacagaacgtatttgcattctgctaaccataaggaaataacataaaaaggtagtgacattatcccgtaggaggaaacgacaacagctgaatgatgtcagatcaaacttagtatcacttctatcattactaatgaagtaatgataaaacttcagagtatctggtaagctacccctgaaaatgcttactaataaaacaaaataaattttatcatttccctctaacataactactcaatgacccaaaggagctgttgaagaccacaattgtcttaattagaaacaaatatatataaataagtagttcaacaactacaattctcaccatagaaaaaataactaaacccaaggagaacactgattattatattatatatatcattgtagcactcatcagaaatacagaattcagtaataagtacgagcccacaactcaagacaagtgaccggtggcaacaaaggacccaattatatccagaattatccctattttcttaaaacagactgctccgcatttctcatttctaacaccaaacaacatttcctgctaagatttcaacttttcaaggcttatatgaatttctcatctaaaattgcaggaataagcatgtcatggccgatatatggtactgaaatattgcatccgtttcttataattcatttttttggagatgagcacatcatagct

SEQ ID NO: 41297 - DNA, 1049 bp, Oryza sativa
agggttggcacatcataacggaagtggacgaagacggccgacctagtgccccggtagaagccgccaagaactatgtgtcatgcccggaaattcactagtaatttccgaacttatttgtgtataaaaccctcatccaggaatcagccgaggtacacaaactgacaatttaatatacaaatccatcataataacgttacatacttacaaaagaaaagaaaacagcagcggaattacggtctagcgatggcttcagctccactcccacaggcagctcaactggggtataagccaaacgtcttctccttctggatcctttctcttcaactgaggtttgatggttattgcaagaatgagcatatgacatactcaacaagccacacagcaaatatgcaagtgcacaaggataccaaaggatggcataatatagggttcatatgcgaaagcagcatttaacaaagagttgagaatttgtaaaacagtagagtaattaatcattaatattaatcaacactgaacagcacacccatgctgcacaggcccaaccaaacctgaataaccaaccccggtcatacagatcaaacctccaaaccaggaattatccattccaaatcaggagtcaaattaattatcacattattatcattaatgagtagtgtgggactaatcacaaaaaacattgctcaaagggttgtttgggatctgtgtgacttgccttgagcttcctcaaacgcttccgaaccttcctcaacgaaaacgctctccttcggaacgtcggaaactaaagcgaaagaacaaaatcaagaacaagcataaatagtacatgtggatatttttaacatgtagatcttgattttagaaaaaattagcaacttgaaccactgaaatccgagttacgatgatttagttatgaatttccgaagtttaaatcgattttcatctaataaagaaaactaaaagagatttatgacgtcatcatcgccggcatgacgcgagcgacgacatcaccggcgctagagagatcggccgggctaacggaggacatctacgcg

SEQ ID NO: 41298 - DNA, 1501 bp, Oryza sativa
ccaaattgcccttggattcctccatccctatcttctatttcaactccgattacccctcgccgtcattgatggttggccattggacatcgctctcgtctcatcttctcaaattgttgtagtaggggctcgcaactgactgagaccagcaaaggggctggtagtgaggccttcgagtgcgagcgcggacaaggggagctcctgtgcagtggcgaagctcgagcacaagggccaacgccgacaagcaaaagactcagctactggttggcctacctctctccctcacagtactgctcgatgacaagaaggggaggggagatccatgcctctatggaggcggtggttcaaggcgaagcacggcggtggatctcaagctctcctcgaggaggttgctgaaggcgacgattggtcggcaacaaagctctcggtagccatggaggcagctaatggagcaacaccatgcagggaaggagccggagttggagtgaagaggagtcgcgacaactggggaaacagagctctcgcataggcggttgtactagcgagagagatcatcctcgatggtgcctccaccgccggagacctcgttgttgactgccaccctagggaagttcatcctgaggaacaacttcgctcctcgttgccgctggtgtcctcaccgccgctgctgccatgagtaccatgtcacacactgacccaacagttacatgcccaggcaagaaaggagagggtaatttggtcccatatagcattctagcgtgtagccacgggtttaggatggcattttatcgattcccttttgtggtgtggcattttatcaaattcattttgtggaatggcattttatcaaatcccttttgcggagtggcatttagaagaaacctagttttgacaatggcacaatgtctaatttcttcatgtagatagaactccgctgcgaataatatcatatcatgaaagtatatggagagatgtgtctttatgatatttccttttcgaaaaagtatgagggaaaaaagttatagccataactggatgtgcaaatgtgcaacataaaagcaaaatggtataactgaaaagccactttatttattcacattatgtagcgtcatcctttggaaaagaaaagaaaaaaaaagggggcaatggaaatacttgcaaaatttaccaattgcagggacctgcgcgcaaaaggtatcacaaacctcaaagccgtcaaacgcgtcgtgatgccaaagcgaagttagaaaaaaaaaaggttgggaaatgaagtccaccacccacctactcgccggcggcggtggcggcggctccgtcgcgccaccaacggctgccacggcgccgacgctggccatggaagtaggggatccctctggcgccctcgtcggcggggccggcggcgccggagccggaggaggagacggggatgcccgcgacgcgctcctccggttggttgctctcggcgaccgcatggccgccgtccgccgccgcatcgccgcatcta

SEQ ID NO: 41299 - DNA, 1501 bp, Oryza sativa
agttagtagctcaaagctagcatcatgcagtgcagggcacgtcttggcaaagcatgcgagcacgcgacacctcttactcgtgagtaaatttactctttttttttgcgaaattcaatgtgatgacacgttggatcagccattaaattctaatcataatcgcaggatcagcgcgaaatctgaaggcgacatgatcgcacgaaggttctcgtgcaggggatttcctgtgcacctgtttcagttgcttactttagaagataaatttcggccgaatagggcttcggtaaatcgacattggatgcaatttttaacttgtttttgccttttgaggtttatgttcttgttaatttgtccttgatgaggcactattttttttctataataaattattcaccggattattttctatgcttcgaaaactacgttctcttaaaaaactttcttctactttattgctattagatcacttgacttgagctatttatttagtttatttcttataaattatataacattcctataatcaagcagataatttatgcaacaatacaatcaaaaatctaaatcaaacaaaggcagcatttcttatatgtcgatgcgattgataaaaaccctactcttatactacattcgttccaaaataatttcatttttagaacgaaggaagtaccttttattattttatttttttgaaaataaggttttatgtttcgagtactaggcactaataataagcatgctgcttgtagttaaaattcatgcaacttgaatagcaaatccagacatctaaaaaaagctattccttctagagataaagcataatatacaaacatatgtggcctcatcctttcgcttatatttatacctatcagctaaaaattaaattttcaaccttaagcttgaagctgattttaggttttttcatcaaagtataaaaattttatttacaaattacttttcgtttgcaaatatatcgttttacttattccacgaaaaaaccaagctatggggccagatgtagtttgttgggagggccatggtgtgaagccattttccaccaaattaaagctggtcttggcgtgcacctgtaaaatatactattgctcacttgttgggaaagaacactttctagtgatgatggcaataataactagatgaattaaaaaaaaagaggatgcaagaaagctacaggcactgcccacagatcccacattcccactactgcatgcttagttgattactctctccattccattttaagtttttatatacaacgtttaaccgtcttatttaaaaaaattataaaataattaaaaataagacacgtctaaaataatatttatattttattatctaataaaaatactaatcataattttttaaataaaataaatggttaaacattgaacacaaaaatttatggctgtaattaaaaatgataaaatggaggggggggggagtactattttttccactataaaatggcccatcgatggcgccatct

SEQ ID NO: 41300 - DNA, 1501 bp, Oryza sativa
aataaaccttttctttgttctaacttgacaccgactactcgcaaggatcagcaaagtgagattaagaatagttttgatgtggccaagtgtgataagatttttgattatcttttgcaaaaaaaaaacaaattagattacccagaggccatgtcataccatctttagaggagttgaagagtcgttttttttgcaaatggcatgattcttattctcatactactaatgaatgcaatgtgtttcatcggccatagaagaaggatgattgaaatttactgaaggttctaagatgaagctagattatgatttttttttcctgtgaatactattgatttcaatgataagaatgtgttaatttggcgggagcaagctatatctacaaaggggaaggaagttgtgataggagaatctagacctaagatgattgtgccaaaaagtctagaagttggtgtatggaaggagaataaaggtgaagcttcaagttctagaacgccacaaaagtcaaaggcgtctttttagatgcttttgaacaagtatgggaagaagagtgccgaggaacatcctaataagggtaaaagaccaagatcacttccttgggagagaatgtgttgattaccaaggcaattggagcaaccttttccttacaatcctcaactcatgccatgggggccttgtccaatgacgccgctgggttatcctttcccttacttcatgccatgaaaggcaccaccaccaatgtacgagtacatgctgccaatgcaattttataaaggttagctagagccacgaaggtcagtgcatgagcggttgtctttatcaagcaaagaccggtttcagtcaaaaaatcggtttgaggaggaaagaggaggaagaaagcatgctaaagtggagccaaggacttcgaaggtgattactgtcaaagtggggtcttatgatgtaccaatacctactggaaatagagccaaggtggtccagagtaagaaaaccaaagccgggaccagcataacgcagagtgctggtctgaccaggccttctggccggtctaaccgcgccttagggccggtctgattgaagccaattaggagctggaccatcgcgaagggcctgtctgaccggcggtcttcaaccggtttgacctggtctcgaggtcggtctgaccggggtcatctagggagcagttcgggagcttcatcttcatcaagtaaaatcaattagggacattacattgctcctgggatagagacaaattaaaggtggatgcctaagaatttgacggcttcacaaaagaggaggttgcaacatcttcgtgctcaagaaatgagggaaaagaaatccgaagagtggagagatatgagattcaatgagttgcgaccaccagcaagacaagagtggaggcctaagccaatggaggtctaaaagccggtggttgctcaagatgaggaagggaagacttgaaagaagatgagccaccaattgttagtaatgattcaccgccaagggaaca

SEQ ID NO: 41301 - DNA, 1501 bp, Oryza sativa
aacgcctctcgactccggcgagttcatcaccggcgttcacgaggatggtgagtttggttaggggggcagagccccttctcaggcctgaaatgtttttaccctcggattgtttaggatttcgcgattcaattcgcgctattttttttttagttttagttttattatttcgtgtgatctgagaggctgagatgtgtggatgcgtatgtgtggttccggggtggagcgattttggtcgatccgtggggaattgatcggtgggggttgcgttttgaaatgaggggatttgggccgcggtttggatatggatctgcgtgcgtgtctgcgacatctgacctcgaattttagccagggttttgttgatttctcccgcttcgttggggtttcgtatcatccacattatggaattatggaatagagatgatttaggggggaagacaggagcggtgatgtctgtccttcgattttttttcctgcttttggttgattgctgttgtagattttgctggataggcacgattcagggggtggatctgtggtttcgtcgatatgtttctgagcttagtgtggtagattttatttttgcggagttcagttgtgtgggttgaactcatgcagttgtgcagccaatgaatacgatctggtaggaaattatttcgattaagcttttgaaaagaaataaaaattgcactgctgaaccgattataatgaattgaaaagaaataggaattgctgtggcatttatacaattaagctatgatgtgctcatctccaaaaaaatgaattataagaaacggatgcaatatttcagtaccatatatcggccatgacatgcttattcctgcaattttagatgagaaattcatataagccttgaaaagttgaaatcttagcaggaaatgttgtttggtgttagaaatgagaaatgcggagcagtctgttttaagaaaatagggataattctggatataattgggtcctttgttgccaccggtcacttgtcttgagttgtgggctcgtacttattactgaattctgtatttctgatgagtgctacaatgatatatataatataataatcagtgttctccttgggtttagttattttttctatggtgagaattgtagttgttgaactacttatttatatatatttgtttctaattaagacaattgtggtcttcaacagctcctttgggtcattgagtagttatgttagagggaaatgataaaatttattttgttttattagtaagcattttcaggggtagcttaccagatactctgaagttttatcattacttcattagtaatgatagaagtgatactaagtttgatctgacatcattcagctgttgtcgtttcctcctacgggataatgtcactacctttttatgttatttccttatggttagcagaatgcaaatacgttctgtccttatgttatatttgtccacttcaagcaatttctttttactgtatcctaaactatttcattgcattc

SEQ ID NO: 41302 - DNA, 701 bp, Oryza sativa
cccctttccccccccccccccccccccgccgcggtgattcattgccgcccccatctttcccctcttatctgattcatcgccgcccccatcgtggtggatcaccaccaccgacggtaggtaagctccatcccttttgttctatccaaaactgacaaaccaaggtgcattttcatcatgtttgcaaaccgaaaattctccctataatgaaatgtctgcagttgcataaacagtttcacaggattgttccgttctgcatatcttttttcaagagagtatacaatttcagcattttttgtgatattcatcattacaatttgctttcaaaaagtcatggtttatatgactgcatcaaataaaactcgaaacttcagggaggtggcatttctgtaaaaaaaaaagatatagaatggaaatttttgtacttttggtcctcttattttttatatcctgtcaaaatatcaaccaagatgatgaacccattggaccgtcagagtaccatgtggctccgggaaaatgcatgggaactggtcagagtaccatgtggctgtgaacactctgatttatagggtttatgagaacactcacttagctgaatattgattctgaactttatcttattatcttcctcagataatgtatttcatgaggaatggttaaaataaattaacaggcaaattgctgtactcctattaaggccactg

SEQ ID NO: 41303 - DNA, 724 bp, Oryza sativa
acgcgggctaaccaggccgcgcgggaggcggcgaatgccggcctaggcccaggttgttgggcctggagcccaggcggaaggcggcgcggcaatgacgggccaggccgagtgcggcctggctcgagaacgtggcccagttcaaaaaaaaaggttatgtgggctgcatactaatgggcctaattaaaaggattgggctgagataatattacaattaaaattttcttttttgaagaattatgattatgattatgatatttgtgtttaaacattgaagatattttattatgttttagttaatgataataagaataataagtgattttgttatgtgataaaattctctttcatttatttatttattttatgatcattacattatatttattacttaaagttattattgttttatgcattatgagtttatttccgttacaaataaatattataattaagtgtgacaaataattgtcattctggccaaagctgattgacttttatttgatcacaaaattttattaattcaattcaaatctggctaaagctgttttgattgaattaataaaaggagttttaaacaaattaataaagtgtggtttgtatttattattctggccaaagctgattaataaatacttattcacaaaattttattgttcatttccttctctggccaaagctgttttggatttgatcaataaaagaaggtactcatcttatgcctcac

SEQ ID NO: 41304 - DNA, 1501 bp, Oryza sativa
  unsure (1)..(1501): unsure at all n locations
ttatctgagaaacaaccacgactcaaaagttattcagtgggcattagatcaagttccttaaacagttaatctgtactaaaatccaacaacaatccatccaagcaagcaaaatcgcaaggggaaaaaagaggtccaccggccatttctaaacgcgtatagtatcacgtctatccaaaagcatacagtgtaattataaccaaacttttagcccgtcatttggtctctctaggactctaggtaattggattggagccagggatttatatatagtcacacttcatatgacatccccatttcgatactgaaacaatgcacaccgtgacaaaaatatactcctctatttggtagtattgtttttcggctcgtgagttgtcatggccgtgccaatggtagcccgacacatcaacgtccgtgacaaataaaatatacgatgactgcttcgccactggaccgcccaaaaactgctacttgatcagggtgatgcacgaacgttggcggctttcacttgtatttggcatcatctagggctagctagcttggacatgatatgtatcaaatccaaattacctacctatacaaacggattaagctaacgactcgatggaagcaactgaaaaactcccaaaattcccattggatcgcgagcagatagatatactagtcgtaaactcgcatgggatcactcgcgacggtccagatcgaacacgctgtctctttcactcgctcacctgctccatgctcgtccagtactactgccacgattattctacactatcctggtgttatttgctaatcccgatgcgtcactgcactgaaagtctgaaaccttctaatccctctgctataaaatcgctctgctttactgctgttttctggcattgcctgtgcgccgcgctgcgctgcgtacgtgacagcagaagcgacgcgcgcgcgcgcgagcgacaccagatgttgccgtccaggccgaggtgagcgcgcgaaaccgtctctctgccgccatttttttttaactcggcgatcgagcgagcgagcattccgaactgactgactgactgggtgagatgatcgccgtgcagatccgggtcctggggaggcgggacgcggagttctccggtgtccacgccgaggtctcgccacgagcgcagcaaatccgtcgccaccatcttctcgccgtcgtctcccgaggtgcgtctcctgatcgtgcgtgaaacttgtgtttgatcggcagcggtggtgagcggtgacaggtgacgcactggctggtgcagagttacggcggcgtcgtgatggagatggaggagaagaagacnnnnnnnnnnnnnnnnnnnnnnnntgggttgcggcagagcgacggtggcgtggacaaggaagtggtgggcggcggcgcggcgtgctccgacgaccgggtgcggctgctggagcgggaggtggcgacggcgaaggcgacggagatgaatatgctggagtcgctgatacagcagacgaaggagatggagcaggc

SEQ ID NO: 41305 - DNA, 1501 bp, Oryza sativa
tgttttgtcaagtgtaacatacacattggacaggttaggtgcatgcagatgaaagtcttcaaaggaccctttaacctcttaaacctgtagtgcttgagcttgaattcggagacgattgatacccttaaaatgtttcaaacgcaatgtgttcagccgagggcatgaggagatcagattatttatgtcactgcctgttgaggagaaatatttcagattcagaacaattagctgcttaaaaccttcaaactctcgagacaagctgatgatgcatcttttctatctgtagatattccaaatcactgatagagaagaggcatgatggagtcttttaataattcccacgggagaactcaattgtgatggaacttggttttttccttgacagcatgtgcatccacctatcaaatacatcgcgtagccaatcttgctgcagttgtcgtggtcgcgcgccagcttcttgatgatgagtaggcctaggaggttgcactcctcgtcggcgatgtagagcagcaacaacaccgactcgatggagccggggaagccggcgacgcggagcgtgttccgcttcttgctggcgagcttggacacgacgagcgcggcggacgccctggcggcggcctcggcggcgccgttccagctgagcatctccaccagctggtccaccaccgcagccgacgtgccgacccgccggagcgcggcctcgccgagccgcgggttcgccgcgacattgacgaagatgacgaagggagggggagagagagatgaggaagggtgagaagaggggaaagagggagaggaggctgacgtggacacatgacatgtggggcccacgtagaccaaaactggaatcaaaaccaccgaaggaccttgggtgaccggttttgtatagtcaagggacctcgcatatctggttttgcggttcgaggatgttttttatcccgatgacaagttgagggaccttcggtgtactttttcccatattaggcctgcttctgatatttaacgtgctaaatgaaatttggcccacttgagaggattaacgagccaaaattaggcctttgtcgtatctagcttcaatggtctagtatacttgttttaggctgaatgtaggtggataaacaggctatatggaccaaagccgaaatttagcagagcaaatagcaaatcatgcccaaattaggcctcccattaacctcccattaaaatagtccttctgtacccactagactagtagtagagattggaacttggaacttgagatatggctcgcctgataaatagcaaaaccaaccgataaaggctcgtcaagaaaatttacaggatttttacaaaattaaacacacatgttttagttttctttctataatacaaaatccctccgttctaaacttttctcttttccccatattcagccagtatgtatccactgtcccaccgatctttacatgtcaatttcaacagtaataataaatttatagtataccaattaatcagccaaatg

SEQ ID NO: 41306 - DNA, 211 bp, Oryza sativa
taatatgaaaaacgacttatatagcacgaaacaggaagaacatacagcgcattgttgcttacaatgaagcacacagttacactatcctgagcccacatatatatatccgccttcactttatgtacatatatggagtacctacagactacagttatcaaaccaattgcttttgcacctatagagtcagagatcaggatgagtagcaaatttc

SEQ ID NO: 41307 - DNA, 1501 bp, Oryza sativa
tagtcatgtgatagttccatatgaaatggtacacatctatactatctatatagttgatgcccactaactcataaatctcaacatgtaagtgtgtcacatcatcacccactagcaattattatctagagtattttcaatcacatgcaagtgtaccacattatcatccactagcaattattatctagagtattttaaatatcatgcaaacatgacatatcattaacaattttgttgtatttttagaactcaatatacaagcaatgttaaatcattatctccagatcatttttcacattatttaaacatatacatctatcatttctataatgtataacatgcattcatccacatatcccacagcaaagtgcggggtataaactagtttaacagagtgcatggctacaagcagtccagagatataatatgggtactaaaagcaatttaaagaagctgttggctatatagttcaagtttacatttctagtattgagccttacccttgttcttgccaaaactttggtacttttaggttttattaataagcatagtttcttcctaccctatttggttggtgtatgccacattacaaaagaaggcttgcagtttgtcaacctttgcaaatagatgagatacaaatagtcctacatatgccgttttctcaaaagagataaaataacaacaaagaatgaagactagcagttaagtatattaacaaaatgcaagtccaagctgtaaattattacaattgagatatcattatgaaagaacactcaggcgaaacttcgttgtggagcaggtcaatcagcaaagcagtagcacatacatcgtatggttatatatccaggccacggaagtaaaaaaaattggagataatggacccctttattacctccttccaagttactccatccgtctcaaaagaaaaacccagcctaggataggatgtgatctatcctaggacaacgaatccggacaagcgcttatccagattcgttgtcaatagattctatcctatcctaggttgggtttttttttgagtcggagggaatattctagtccaagtggcacatctccttacctcatttaacatcatgccaaaaatagaatcattttaccctccacaatcctacatattcccattactgtattgccatccacccaatatactcctggtttattttagcgttattaacacgtaactaatgcgccgtcataaaattgcaagtattctactatagtgaccacctaacaagtaactcggaacccagatcataataataattgtttaataaaagagcacagcaaatcgaccttgaggagctccagttcgaagatcaccctacgaattccaacccaggaacaacgcgcacgcgcatttccgaacaatagcaatccccgatcgattagccgatctataacaggctgagtgagcgagcggggggactgacctctccttgcgctcctcgagcgacctcatctggtccttgtagtggttctcgat

SEQ ID NO: 41308 - DNA, 1501 bp, Oryza sativa
tccgtggacagttggtgtgcgttttccccacggagcatctgcgaaccgcgaccaacatccagcttcagcctgtcacgctgcggatgggaatggttaggttctggattgaacctaaaccatttcacgtgaccactctgatccatggttcaatagggacaacccttaatgatcccattaaataaataggttatccaatggagcaaaaggttaacctattgaacctagcagacaacatttaattcacatgttcatggggccacacatatacaacacaatatatcacagacgcaaaggcatcccagggctacatttaagatatatgcaaagcagtacatccaatggctaatttttcggcgtacggccgtgtgactcacctatttttcggccgtggccgtaccggaaattattttctccacggcggcgaacgatcctgacgtcgcgcgtgctgtcacccacacgtaaagaaacggaaccctttgagcgtcgtcgtcgtcaccggattcaggatcacacgtcgggagggagaagggtagagataggagaacgagctggaaaaggaaacggagttaaaagtgagctccgcttctcgcttgaccctcaaaaaagggtaaaaaagaagaaagcgcggatgggccccgccggctttgcaccacttcaacccggtcaaatcttatccagatccagttggagtgtaattcgtattttttttctttaattaataattacatattatgaacaaattttatatgaatgaataaaatatactataaattaaaataacttagagcaacttatataattaatgctagcatcgaaagtttttagaaaagaaatttaaaaacatggcgtgaataatacatagtaaatccataatgaaaagacgtagcatgcgaattggcgtcagctggttaggatatttgtggtggaaccttcccacctggatttaatttgtagacttgaaacgggtgtttatgtttgcggctaactattcttacaatgctagcaacgtactcatcgacaacataatgacttcatcaatctcaagatatgccacctcaatttcaaaggtgcttataaaaatgctgtgtgcaagagtgtttatgagtgtccatgtttatagtcaatttgtgatgtgcttcgaaaaagaaaactagaaaaaagagggagctagttggcaaagggccatctaaaattctaggtctagccctacctccttaaagtggtggataatgagcaagttaggctcatttgagcttattacattaacgagatagctcggatcggcttgtgaaccttaacgagctaaaacactagttctgcttgtaagctaattaggctcgttaacaagatttatttcatttataaacctttagaaatttgaatttacaatgttatcatatattaacataataatacactaactaataaagaactaaataaatacaatgagtttgtatgtagttaaaagactaaacaatactccctccgtccttaaaaaaat

SEQ ID NO: 41309 - DNA, 1501 bp, Oryza sativa
atcaacaaacagagttgtacaaataattcaacatgcatctaaagaaaagaggaaccttcaacaagcatgtggttattccatttctcccatacaacaaaacaacaaaacaaatacattcactgaccattcctgttctcccatgtgctttgagttcaaaggccaaaactatacacatcatgagcatgtggcaagcaatccaagtaccaccctagcacataggaaactcctatatccctacgacaagtaaaactcgtcattttccaatttaataatctacatagaaatgattttgtgaaggtgtgtgacattttgtttgagcgacactcaaaagtactatctcttaatgccaaataaaaagttatacaacctccgtccaaaaagaatacatttctggctgcatgcacggatgcacctggattgtccaggtacgcacaaatacattccttttggacggaggtagtagttttatgttttaatgacaaacaaaacagtactccaactgtaatacaacaacacaagaacatggcttgtgatatgtgtccgatcaacacttacattataaaccatactctatcacaacaaataaaaactatagttttcctaatacaaggacttcaaattttcttttcgaaaatgttattcaatcattaatgactaataacaactataccccgaaattaagcccaaaacaaaaatcaatcacaattgctacgacatttctcctacggtccaagaatgaaaaaactatgaacctgcgagtgcgtgcaatatgccatctaactgatattgccaaacaaatacttcctctattccgtgttgtaaggtgttttagctttgagtcaacttgttttaagtttgatcaagcttataaaaaccggtcatatttctaacataaaattaagatacattcgatgttcgatttaacgaagcaaacttggtattgtagatgttatgttttcctattaatttgatcaaatataacaagtttaagttaggagttaggacaaacttaaaacaccctctaggagtaaattttttttttttgagggaacactaggagtaaaatctgatgtgacactaccatgacatttgaaggtgtatcgctagccaaaaaaactctcacaagatatcatcacctattccttttgttattgcaatccacatcttttcctctcatggaccatgtggttgctagcaattttgtctagtataaatcaacgccacaccacttgcctagtcatcaacacatcaaaaatattcatctttaattttttttgaattcatttcttcacgtaaacatcctactccatctctctcattacactcctttcaaaaacctccaaaacaaaaagaaaaaaaaagaagaagaagaagaaaaaaaccctccaaaacaaaagaaaaaaaagagaaaaaaagaagaagaaaaaaacatccagatatatatagccatactgcatactgttgtagctaattaagctatagcttggtaatccgcagccat

SEQ ID NO: 41310 - DNA, 1501 bp, Oryza sativa
catcattaaactagtgacgatccttctttcgtcattgagttatgacgctcatgttcgtcattatgaagccggaaaacgtcacaaatcacaaagcctggatgactatgcagtttccatgtaggacaagaaacatcataaaattgtagtacaatgccacatggagctgacatggcatgttaattgtgacaacctgaatcatcatgaaatttcttatgggctgttaaggtccatgtatggagcaatatgtttatgggctaagcataattgtaggtccgataagatagaggaatgaccatataagcccattacaaaagcccatataagctcgagatgtaaagaacccatatatcataatatatataagcccaattattattcaatatagcacaagtccatttatcatcccagccgcatacaggtaaagcctagtctcatacaatcaaagctcattcacatatacaggtgatctctgtatagaccatagcaaaataataagtttagtacatcttcactaaatcctagatatcaaaataagttcctaggttaacttaccaaatacaaccacaagcagtggtgaagccaggatttgatattaggggggtgtggggtgaggataagctataagaacgaacaaccactccataccccgctaatctcaaaagatagcaaaggagaccaaatagtcaccatcaataaaaatcaatgcgtaaactagtcctttacattttggaactaggctctattgctaaatcctttcaatctaaactactgaataatcacacaaataagtatcttctattttactttgaaaaaagatgagaaatcataaactaaatttgtaatcatgtttcttgctaatgtttttttagaagtaacattgtaagtacagccatacaacaacaggaatgagaggagggggtgtggggatggttcggatagggggtgttggccccctccggcaccccccacagctgcgcccctgaccacaagagcaaactagattcactaagtccacactagttccacccacatgtaactcagcaaaaaatcaatgtccaactcagccaaccatactctgcaacaacctcaaatgtagtcctcttaggcatctgtgagacaacaaaatttaggaattaagccccagtttatagaacataaatttaaatttaaaccgacacctgttaattgcgcaacacacaactttcctgcgtcaacagctctcttatcccctgagctttactagttttgtactaacgttgaacaaaaaccatccatataccaattctactttaatactatgcataacagagtcgattttagcaagtaactgctaagtactcttcttcaaacaaaaccacaaaactgactttaaatcgcatgacaaaatgactgctaactactagacttaaatttcccctttaatggataaaaatgctatatgttcatgtgaccaggattaagaaaaaacaacacaagaagtttcggattattgaagaatgaa

SEQ ID NO: 41311 - DNA, 1501 bp, Oryza sativa
gctattaggtgaaatattagatctaactgatcctcaatggtcccgcacgttttggagttcccttcccgtatttgtcgctgagggtccctcccaactcccaatcgtgcgatgcttcgtcaaatcgagccggtcgtccatggcctccaccatcattagctgctagctggtgaccaccatcgtcgctcccactctgcctaggccgtgtttagttttccccctattcctaactttccatcacatcatatcacatcaaaaacttttctacacacgtaaactttcaacttttttttcaaactttcaacttttttcaaacttacaacttttttcaggaactaaacacacccctagtttcgttgacagcctcgtcggtagtctcgtactctcatgcgaagtactatcaccaacgtcgtcttcctcgtactaatcttcctccataagacacccaaaacgagaaccaccgaccacgtactagagaggaaactggagccaaggtgaggtgccagcgcgatcaccgtcgacccgcctctcgtagaacctcacacccagctcatctcgtggatgggcatggagcagagcaaatagagagacctgagccagccgcttctactcgatacgaagctaaaatgagcgaatgtttgccgtctgaaatacacgcagggtaggagtgccgtcgcagacgatggaagtgtggtggtgcgacgtgtgcgtggaggcggaattaggggtgaaaacaaacgggtacttactaaccgcctgcccaacccaaagcttgctggaataatatagagaaaataggatacccgatagtatccgagttcaaacccgaatccgtaaaaaatatgagttaggatagggaagggttgtatccacccgtatgtcccatgctataaaacatatgtgaatatctattataaattcacctataaatatgataaaagattagttaatcactatctttatgagctcacatgtaatattatataatttaatcattgatgtatctcttttagcacttcaattatcttatattaaatatctatcaattagtgatataaattaaatatccgttcctgaatctaattcgaagaatattgggtatgatacgggatgagtgatatgttatccaacgctacccgtatccgattctaaatttaaaggaagatactccctctgttttaggttataagacgttttaactttggtcaaagtcaaactactttaaatttgactaggtttatacacaaatatactaatatttatattaccaaattagtttcattaaatcaataattgaatatatttttacaataaatttgtgttgagttaaaaatattattattatttttacaaatttgaagcggtttgactttgaccagagtcaaaacattttaaactgaaacggagaaagtataagttagaatatagaaatattgtgatccgatcgtaccctaccagttttcaccccataggcggaatgccaggtggtctccggcaagccact

SEQ ID NO: 41312 - DNA, 1501 bp, Oryza sativa
cagtagtggcgtctcgccagaggagaggcggtgatggccttgcgactttatgagagggcaggaggtggaggaaccaaccgaggaagcgacggagaaaatatttccgaccctgtgaggccaggattgtttcccatggaaacgacgttgattggcccaggttttcccctcctcgcgggcttccaaaggcacagtttatcccgtggaagtttccccagcaggctttctccctagggtagttgggccaggaaccccaagatcccgagctgccatgccccgcgctttagtacgggctatatattagatattggagaaatgatgaaatgatttggattgaaatatttgaaaatgatgatttagcatgtgtgtacactacaaaagatcttatgatagcgtttcatttatgtcacaaaaactacaaaatatgtcacatttcaaattctatgacgatcgcgtgatcaaaagtcaatcgtcacctatcatgtgtctctaatcatgttctgtgacaaaatcatatcttttcatcattaaactagtgacgatccttctttcgtcattgagttatgacgctcatgttcgtcattatgaagccggaaaacgtcacaaatcacaaagcctggatgactatgcagtttccatgtaggacaagaaacatcataaaattgtagtacaatgccacatggagctgacatggcatgttaattgtgacaacctgaatcatcatgaaatttcttatgggctgttaaggtccatgtatggagcaatatgtttatgggctaagcataattgtaggtccgataagatagaggaatgaccatataagcccattacaaaagcccatataagctcgagatgtaaagaacccatatatcataatatatataagcccaattattattcaatatagcacaagtccatttatcatcccagccgcatacaggtaaagcctagtctcatacaatcaaagctcattcacatatacaggtgatctctgtatagaccatagcaaaataataagtttagtacatcttcactaaatcctagatatcaaaataagttcctaggttaacttaccaaatacaaccacaagcagtggtgaagccaggatttgatattaggggggtgtggggtgaggataagctataagaacgaacaaccactccataccccgctaatctcaaaagatagcaaaggagaccaaatagtcaccatcaataaaaatcaatgcgtaaactagtcctttacattttggaactaggctctattgctaaatcctttcaatctaaactactgaataatcacacaaataagtatcttctattttactttgaaaaaagatgagaaatcataaactaaatttgtaatcatgtttcttgctaatgtttttttagaagtaacattgtaagtacagccatacaacaacaggaatgagaggagggggtgtggggatggttcggatagggggtgttggccccctccggcaccccccacagctgcgcccctg

SEQ ID NO: 41313 - DNA, 1172 bp, Oryza sativa
accccgagctttcccaacgccaagagatcgtgtccggttcctcacctagctaaaccaatcgcagaatgtcccaaagcttgagatattccaggattgcctgaatccccaatgccgaacagatgtctcgaatccacctcttgtcttgcaaagcctcagctaccgttcgtctgttccggaaccgagcgggaacagctgcgtagaccgcgggcgccagcgaccgaattgaagagccctgtaggcaataatcctcctagaaccgtaccaacttcccatcgcccactgagcaaaccaaagaaaccgagacaaggttatgttccttgccacggcttatccggcgaggttctttgagagcttattattgcccccgtttaagtttagctttgcttaagaggatgattaaataccgggcatgtaaaaaaaatattaatacttgattaattgaaatttagttattttaaaattgaaaaatgtatctgatatttttaagtaacttctatatagaaagttttcgcatgaaatatataccgtttgatagtttgaaaagcatgttaataaaaactaagatgaaatcagtatcttaataaaaaaaataacaggggccgtatgtattagcagtagtcagtacaacatttttagctcagactagcatcagtcgaatagtcgatgttcatattccagcgagaaaaaggcagccaaacacaagaacagatcgcttgacaaagactctggcagcatatgcgtagtgcaagaaataatgtaaggatccaaaggcttcccagaacaaaaattctttcaatattgggagttagattcatactagtattgccttggatctcagtcgatatttttatcgccagtcttctcaattcaggtaaggctggagtctgtacccgctagggagcagtttatgtgtgtgtatatatttacagtaataacccagttgtgtggctgtggattacaacaaataaagggatacttttattacgcccatctttcaacctactgtcagctaaaaaaaaattggttcaccacgaacatatgttgtagcataatttgacaaactccatcacataagattgtcgtggattagaatgtgaacctgagtccgattggcctaatgctcccctttggcaccattgctgcccgtctgatggctagcttggccattggcc

SEQ ID NO: 41314 - DNA, 724 bp, Oryza sativa
atttaaatgaagaaattcgtaaatattcatttaaagagcatataaacttcaaatggccataacttggccatttgaactcggaattggaccgttcaagtctctaattttttcttaagaagtcaagaacccatttttgtgctttgttcttgcttgttatatggagtttattagagtaaaagcccttttcttttccgttggtcgtgtagacgctgcagcttcgaaagatccgctcttcgtggaggttgaagccgacgtttgggaaagcgagcaaggcaagtcacatcattctttgaacatattggatcccactttatgaaattactttgatttaaattattgcattatcactttatttaaattcccgcgttatcactgttttatttagccatgcctatttacctttgttatgaccttattattgctattgtattattaccttgttcaccctagaataaacaaaacccctactagtgggcactctactcatggttcccctggtatgaatttaggtagatgcttcgctgattaataagacaacattaggtggtttttataactttagactttgggaacattcatatctcttggactttatggaatggttggactattgtggaattggatgcacacctctccctctattcaaaactctcaaaatggttttacgctgggcttggggtgcatggttttgatagtagcacctcgaccacataaggaccggact

SEQ ID NO: 41315 - DNA, 1501 bp, Oryza sativa
gcacccgtcacgcgtgagcatgtccgcggtgtacaagccaacattgccgctgtagcaccggaaagctccttcgatacagtggtcaattgcatcttgatggctcacattgcccagccgctgcaagaagctacggcagaatcggttcttgtgaacttccatattgctggtgctcttgttgccatggtgataggggccgatggagaccactctaggctcgaacaaacccctattggcctcccgcatgtatgtcgggagctgcaccaagttgttgatctccatagcaatagcggcagacaagacaatcgtagaacttgtgtatttcttgtatttttttataaacgactgtgtatttcttgtataacttgatggattaatactagtgcatggtgccttatatatatagttatcacatatacatggtgatacgtgatatatggctagcggcatgttacttacgtagtcatacacatcacagcagaaattaaaattgatggcgtgcaagtgttgctaaatttagtttaagtttaaatcagttaaggaaatgtttacccagctgcaggacctgtagttttttgtatttattactactgttgaggaaatacttgatcttaaggtcaacggatttccctcatagagcaactccttgcctcccacttggtgcagtcaacttgcacaactttgtattttaggatttgaatgagaatttgccagttttgctttgattaaaaatgcttaatgtaacttgtctacagtaagcatagaaagtgattgaattgggctgtgtttagttccattcaaacttccaacttttccgtcacatcaaatgtttagacacatgcatggagcattaaatgtggaaaaaaaaagccaattgcacagtttacatataaattgcgagacgaatcttttgagcctaattacgccatgatttgataatgtggtactacaataaacatttgctaatgatggattaattaggcttaatagattcatctcgcagtttacatgcggaatctataatttgttttgttattagtctacgtttaatatttcaaatgtgtgtccgtatacgtcaatttttttttccaaaacaactaaacatggccttgaaaataacgacagggcgtcacatacgatgttactttcaattgaaaagaagcaaaaccaggtgtgtgtgtttttttgtgtgtaaaacaaactgattcaaagagtgaaaacagagtgcggtcttttcctttaaagaaaaaacagagtgtggtcattgatcccctaacatatattatttttatatagttattacagcgcactacattctaaaactcaaaatacaaaaatatcacaccatcatattaaacctcattcttacatgctatattatgaatactttactatgtttcagagctttaaaatgtaaaaatgttgaatcattatcccccataacttacatagtattttactatatacatatccattatttttttattatatcatatatcatata

SEQ ID NO: 41316 - DNA, 712 bp, Oryza sativa
accccgagctttcccaacgccaagagatcgtgtccggttcctcacctagctaaaccaatcgcagaatgtcccaaagcttgagatattccaggattgcctgaatccccaatgccgaacagatgtctcgaatccacctcttgtcttgcaaagcctcagctaccgttcgtctgttccggaaccgagcgggaacagctgcgtagaccgcgggcgccagcgaccgaattgaagagccctgtaggcaataatcctcctagaaccgtaccaacttcccatcgcccactgagcaaaccaaagaaaccgagacaaggttatgttccttgccacggcttatccggcgaggttctttgagagcttattattgcccccgtttaagtttagctttgcttaagaggatgattaaataccgggcatgtaaaaaaaatattaatacttgattaattgaaatttagttattttaaaattgaaaaatgtatctgatatttttaagtaacttctatatagaaagttttcgcatgaaatatataccgtttgatagtttgaaaagcatgttaataaaaactaagatgaaatcagtatcttaataaaaaaaataacaggggccgtatgtattagcagtagtcagtacaacatttttagctcagactagcatcagtcgaatagtcgatgttcatattccagcgagaaaaaggcagccaaacacaagaacagatcg

SEQ ID NO: 41317 - DNA, 255 bp, Oryza sativa
aatggaggtagagtgtctgatagtgaagattcagatcaagtctcctcagatgatgaagatgaagtagaacttaaggcatgccctcgttgtggagaaatcggtcatgttgccagctcgtgtgcctctacatgcgttcattgtgaggaagacatctacccgacaggtgtccaacgagcaggatcacttgtttcttttgtgaaggaactgatcatgtaccaaaagattgtcaattcagttttctgctgacaaagaaga

SEQ ID NO: 41318 - DNA, 1501 bp, Oryza sativa
cagtgtgtttttactgggaaccagaagagtccaagtgcattactactttctgttttacaatgctagcagtccaggtgcattactaccatatggactattaaggcaacttgtactgaaggggaaaaatcatgcaaacatgagtgaaccaaaaccacttattgtacaagttcaagtcaaatcaattttcaattccaacactctacacccaaaacaaaaaggtaagttgtttaaaacagataaaggggatatgaagtgacaagctatgctgaaatagtcatctggacataaaccttgtcaacattatcaattaatggtgatcagtgaaatcgtaccaacataatttatctagattctgaagaagaaaaagggatcaggtagtaagtcacatttgacaaaaatctccatgaatatcttacagccatatgttctaaaaaaaagtcatggtcccttttgaaattaaactgtcatgatttatgtgatttgatgccatacatgaaactgcacttgtttgttgattgaaaacatttcacatgaacagcatgagattgctggagacaggtcacaacattaagtttccgatccatataaacataactagcgtgtgcaggtgtattaatctagggcaaacattcatcgatgaatgtttaaaccatagcagctatgaagtccaagtgcattactaccaaaatgctagcagtccaagtgtatattgctacaaatttttataataaagagtacattttacaatgggccacagattttgacaaaggtacgttgtacaatgaactagggttaagtcaatgtagtaactacaaactataaatcttacataagtttttactttctaaacatctacttgttagaaacaaaacttctacttgtttctaaactatacatctctttagaaacataacatctacttgtttctaaatatattgttcttattactatggcagtagaattgatgatgtcaactatgttatctctgacaacttcatttcatgtgatcaaccctagtccaaagtgccaactagtgcaaacatctatgttgtaagttaaaagattgctgtggaccttttaaattgaacatctaatacataatgcatggttcaaactactgccaactagtgcaaacacataatacatggtgcaatgtgaaatgcactcaattataaattgaacatgttcctcaactgtcacatgtacaatatcaattactgataactttttgcaatcagtgcccatcaactgaattcatagttatgctcgaccattgatgaattaaacattttttaacttaccaactgctctaaataaaagggaatggcacaactggctacaacatgtatgcacagttctaactataaagcatatatgagcacaatgcttccattactacagctggtcatttgtttcgacaaacacaaggagagaaactgatttttgtcctgacaaactgaaaatataactatatgcatataataaattgcagttcatacca

SEQ ID NO: 41319 - DNA, 226 bp, Oryza sativa
ttatgcatatcaaatgctgaccaacagtatttaacctaaggaaaaacttgtgttctttagaaaattttcaaatcaacggaacagatacagcctacttactagtttagttactccatttcataatgaaagagtaaacatcctgccttgtgagtttgtgttgaacaaatttgttttgatgatttgtttgagctactgagatgaaattcatctgcttttggcttatagg

SEQ ID NO: 41320 - DNA, 1501 bp, Oryza sativa
gcaggtattcaaatgttcaatgtgacggggtgaaaaattttggggtgggatctaaacagggccatagaaaacaaaatgtcataccctgcttatagccttgtacaccagcttaataaagaaccatgtggtttatatatctgttcatagcatatgtttcaacttgcttacgttgaggcctgaggggctgtaaaggcatatgttcagaatctgatgcatacaaccaacaagtgtagatgaaataaaaaattattcccaactgaaccaaaatatattttctactttaatggacttggccgccttgcttagcgctttcctttcttgtcatgaatttgatgctgccaacaatttcatggagacaatttaagaattaccatgcattcatttcatttgttcaatggattgacatttgtactgttgctttgtagatattacgtgatctgggggtccgttcaatgaagttgatgactaataacccagcaaagtatggtggtctcaagggttatggattgagcattgtgggcagggttcccttggtaactccaatcacctcagagaatcggagatacctggaaacaaagagaacaaagatggggcatgtatatggattggccaatggccaagctagccatcagacgggcagcaatggtgccaaaggggagcattaggccaatcggactcaggttcacattctaatccacgacaatcttatgtgatggagtttgtcaaattatgctacaacatatgttcgtggtgaaccaatttttttttagctgacagtaggttgaaagatgggcgtaataaaagtatccctttatttgttgtaatccacagccacacaactgggttattactgtaaatatatacacacacataaactgctccctagcgggtacagactccagccttacctgaattgagaagactggcgataaaaatatcgactgagatccaaggcaatactagtatgaatctaactcccaatattgaaagaatttttgttctgggaagcctttggatccttacattatttcttgcactacgcatatgctgccagagtctttgtcaagcgatctgttcttgtgtttggctgcctttttctcgctggaatatgaacatcgactattcgactgatgctagtctgagctaaaaatgttgtactgactactgctaatacatacggcccctgttattttttttattaagatactgatttcatcttagtttttattaacatgcttttcaaactatcaaacggtatatatttcatgcgaaaactttctatatagaagttacttaaaaatatcagatacatttttcaattttaaaataactaaatttcaattaatcaagtattaatattttttttacatgcccggtatttaatcatcctcttaagcaaagctaaacttaaacgggggcaataataagctctcaaagaacctcgccggataagccgtggcaaggaacataaccttgtctcggtttctttggtttgctcagt

SEQ ID NO: 41321 - DNA, 1501 bp, Oryza sativa
tccagcgatcgctggcgcggggagggggtggacgaggtcggcggcgatggtgatgccagtggtggtggcaccgaggcgaggggtgtcctgaatggcggcgaggcttggctggagctcggcggtgatgacggagagagagagagagatggcggtggctcgattctatggatgagaggaagcgcaaggtggcgaaaacgagagaggggttgcggtgagggtttttgtagcaacgggggagagagagagagagagccgaggagagagggaaacgatggcggcaaattttgccgccatcaatggtgccagcgagatttgccggactaaatctgaccacgttgatgagggagagagaggggtaagtggggggaatgagagagggaatcttggggagtgattccccttccaacatggacggaaacggccgggagcagcgggactcgcggcagcggcggaggcgctaggcggaagcggcgagaggacggggatgatagtggcccagggcgtggccgagtgggccggcccaccagcgtgctcgcgggggaaggagagatagaccgggccggtgagaggggagagagtgaggaagtgggccgactttcggcctagagagagaaggaggtttttagggtttttcttttaagaaaattcataataatttctttattgctttataattattatttgtgctctgaaaactccattaaaattttgttaagccttttaggccttgagaaaatatacaaaaattctctaagcctcatttgatttttttagattgtatatttttaatgttggaagctttaaaccaatttttactttttctatgaataatttaaaagatactttttagggtaaatttgggatgtgaaatcatggcctgatttgtcagtttccctttttgcggcatctacccctaaggctctaaacgaagcagcgttttagcgcgtgattaattaagttttagctatttttttttcaaaaatggattaatatgatttttttaagcaactttcatagaaactttttataaaaaatgcaccgtttagcagtttgaaaagcttgcgcgcaaaaaacgaggaggaggagttggtaacttgtactaccgaacggagcctaagtactattgtcctcgagttgcatctcgagcacccaaccctagctcaagtgtagcgacttacctttctcagtcaagggctcctcctcaactgcttcgctatcttcgtcaaacctaagagcatctccaacagcttcttcaaattggactctccaaacactcatataggcctggtttagttcctaactttttcttcaaatttccaacttttccatcacatcaaaactttcctacacacacaaacttccaacttttctgtacatcattccaatttcaatcaaacttccaattttggcgtgaactaaacacacccatagccaactcttcaattgatttgtcaagccaaactcattcctcgctccaacaacctctccatctatactctcc

SEQ ID NO: 41322 - DNA, 1501 bp, Oryza sativa
tttttaaataagacaaatggttaaacgtatcttaaaaaatcaataacatcatattgaaaaatggagaagtactatggtgcagacccagtatcgcgcgccccctcatttgatgttgctctctccccgcgttggctctcctttatataccttgacaagcctagaggcgagaggctagtggatctggacatgcactttaccgtcctttatttgctatataaatttattggattttttgaaacaaatatgaacttgttggaaaatcacatagacttccacaaagtgcactgctggctagtacaaggatatatgtgtacttgtgaccaataatataacaatgggcctgttaggtgtgactagataacagccagcagctacagtagcaccatataatttttaccatagtcgcagcagcagcgccgcacaaccactgcaattggacagccgaacacacccaatgtaacccatggagacaagtacagccatgtcactcaattactgtaacagtaaaacaacatgcacctcaccttcatccgaagagatcagaaatagcacctaataagctcatcaacgacacatgtgacatatattcttgttcaactctatgttctacatccgctccagcatggttgatgcccctttgattcaaaagaaaattcatagtaattttagaggatttcacttttatatgattttttttctacatagccctttgaatgaaaggaatgaacctcatggaatcctatgaaattccaatggaatgcctctttccacgtaagttttggagaaaatttaacaagaggtagaacctcatggaaagaatcctttgagtctttatctcttttcaaatttctgtgtttttcttgcggcccgatcaaacaatcattcatatgttttttctatgtgttctaatcatttgttttatacttgtatttctatcggaatcccatattttttctattctttttttttcattcctgtgatttaaaatagccacaagtcttgggccaagaacatgtcgccatcaaggtactacgtacctgactcatcacatactcaggccctgtttatttcgcgaaaagaaaatttttgggtgacgtttcaccggatgtcggaaggagttttcggacacgaatgaaaaaactaattaaggctaattaatctgtcattaacatatatgggatactatattacttatggctaatcatggactaattaggctcaaaaaatttgtctcgagatttccatgcaaactatgcaattagttttttcttttgatctatatttaatgcttaatgcatgtgtcaaagattcgatgtgatgtttttgggaaaaaaattgggaaccgggcagtgttccgtgcactggaagcatggtcccacacacagtaatctaacgacgtggtgtgaggcggacctcattgcgttaactgacgtgagaagtggccgttgcgagacaccttttccgtctggaggcagcgcatccaatgcgctttccctttctt

SEQ ID NO: 41323 - DNA, 1501 bp, Oryza sativa
gtagcgcgtcgatgtagaggaagtagtcgatcgcaccagctcgaccttctcctcctcgtgcgttctcctcgccgtattcccaccccgatcagcactgcaaaccagcggcgcctctaccggtatccacacgtacagggacggaacgccacgtgcagatgtgctagcacccgcgcacgtctagggttttgctcggggaggggagtgacggctagggtttctcatgtgatgcaatacctccgctggtcacacccctcacgaatatataggatccatcactcaggcctccaaggcacgtaggagacctattccggcccattaagcgtgcgaccctgtaggttcatgtacactcggctgaaacccaaaaactccttttcagttcacgcgtcaacagcggcccctagcagaacgtattgacccaccgggcatacataaagatcatatcgattgaacctctagtgtatacttatatgaaccactttgcctcatgatatcgattaagctcaaggctagatatgtgccatcctctaatagctcaatcattcactcgaacctattgatacattatataacttgtgattgactcctcaatcacctttggcatggccatgcacttccataatctacaacatcgaggggcccagagatatctttccataggaggggcaaatcccatcttgattattcatatcccactacatgtttcatggcatacccaaaaactacttttataactacccaattacggagtagcgtttagtagtccctaagtaagctactacacatgttgggaaccatgataatctcaggtctaaggattcaacaccaacactaaataagatcactgatgacacaacacatatggctcttgcagtgtctcatgttgggtctatccaacaacatgttcaccaacatgtgtccacattattaatttggtatctctatatcatgatccatgagacatgatcatcaattaatacatgtgctgattatttaaacatatttgttccacatatgatatttgatcagggatcctttagaaatagtaacaaacaacataaagagtctcatgaaagaatcacatatccattaaccaataatgagttatctatttcaaggaataaagtcagataaatatgtaaacatagtatgtgatacaatcatctctatgattgcctctagggcatatcactaatacagaggtgtacatctttacccacaagacacgccttcctcacgtgtcgccacacgccacataccaccacggtatatggacggagggcgtaacatacttcttcgctcaccctagccctgaacaaaagtaccaactcaacgcccacctacggccggggttcctgggacaggtaggttatggtcgagccccacggcattagaacatccttcgggagtggccttctggatgcccatcccatgccacgagatcttgactaccggacacctcctcgtatagccttcatttgcctcagagatatccatcacccta

SEQ ID NO: 41324 - DNA, 221 bp, Oryza sativa
taaaggttccactgtttatctaatcttctggatttaatgacatcggtcttccagccgatgtatgctttaacttttgaatctgtgcttattttatcatatcattattagacagttggtttctactggattatattactatattgattatcattagccgattgtctttgtatgattatttattcatgcgccagattctacattggacatatagccaatcaaga

SEQ ID NO: 41325 - DNA, 182 bp, Oryza sativa
agtaggtgggtggaaaattcactgccaccaccattggaatctttttaaaggagtatagatacccatgcaagttttaaaattctatacagcaagccatataaaaatctggaatcagttttacttttattttaaaaaaacatcctttttatatacaaatcaagggaatactaattctctttctt

SEQ ID NO: 41326 - DNA, 1501 bp, Oryza sativa
actttcagaaatccttgggacatgctaattccgtgaaaacggaggtaataatggtaccgaatctcctctcatgtatgtgttgtgattttttttctacctctcttgcatgaattttaaagaaaatcgaacggttcaaaattatattgtaagttatatgtaaattacaatgcaattacactacgattgtactatatttacacatgttaaaattttagaaaaaaaattatcgacaaatatgaagtggaattgtgccataatatgtcagagatttgaactatggtggaaattcacgacagatgtgcaatactcctcaagttgcatacaagatgttcttcattgggaaagaaaaggccgcctgcggcgaattcctttggaaaccgaagatactagcccgatgcaagttttttttttttgtatgttcttagcaataaggggcatctatttaatttcgttccgacaatctggatcgctgtggccgacaaagccaagatgtgcgccctctatggacatatattttcatccctcaagaaaatgtcccctcgctgtttgaatgttattgttacctatctggttataaaaaaaatattttttttggataacatagattaatatgaaatggcataacaagcggctggcttggctggaccgaccgatgccgctctttgattaaacttgcatatacatgtgtataggtttgtgcatgttgtagagtgtttacggccgttttgaaacctatgtagatctgtgaccacaatctgtacgtagaatcggcgtgtgctttatgtaatttcattcctaaatcttaatgcatttagccgatgtcctatcgctagcctagcgaaaaagattacatattaattcttttcttatttcatggtgcacacccacacatcactacacaagtaacaccagacacacgcagtcgcaaatacactaactcacgcacaaataaatgaagaccaacatcatatcgctttagtctcactataagatcctactaaagccaacctacacgtgtgtaattgagtataactctgggctttgcaccatccctacggtgcacacagtcattttagtaactgtttagtttattatggtgttagatcagagtagacatgataacttaagagcatcttcaacagtctctctaaatttgactctccaaatgtctatttggccaactctccattcaatttagcaagtcaaattgtcttttaccccaacagcctctccattcgtcctctctattctgagtctatgacaattgggtccacatgtcagcctctacacctccttcttctccctcatctttctccccttctctccaaaccccccttccctctcccatccgtcgctgccgcccatccccatccccaccgccgctcgcgaggaggtgacgcaaggaggcgggcggccacgcgcggtgctgccgtgacgcggggaggcgggaggcgagacgccggcggctcgcgacgacgacctcgacgccgctcggggcaga

SEQ ID NO: 41327 - DNA, 676 bp, Oryza sativa
gacgccgcggggacaggcctgcaatgcatacatgcaaggccttctcccatagtgggctgcattgcagtttatgtgggccttactgatctcctcttacaaaaggattcggcccacccacaagcttaatcaggcacgacccgatcattaccgtgggccttcatccagccactatcatccaaacgcagcgatgatagacaccatatctaattttacgattttgctatacatctcacgggtgattttttttgactgatatttcatgtttttctatccataggatccctcgctaggatttgtgcaataattggtggaggctgcatacgtggataataccatgcgtcggatggtaggcctggttcttttcactttacaaatttttgaaactataaaataaaaaataaaatacaaaattatagtcctatataactaaaattacatgtgcatattaggttgatatgacatgtaagcacactgtaattttgataaaaaatattgtgtaagtagatatgtattgattattttctttaaaatataaaattatagtcatatataactaaaattacatttgtaaatttagttgatatgacatgtaagtacactgtaattttgataattctttaaaatataaaattataatcctatataactaaaattatatttgtaaatttagttgata

SEQ ID NO: 41328 - DNA, 1501 bp, Oryza sativa
tccagacgaaggtgaaatacatgttgtgttgaaatatttgtgttagactcggttgtactcgtctctaatgggttctgttgttatggtattcatcacaagtaagtgtatatccttgtaaccagtactttgagaaagtttgcgttgttttccaataagtttatatttatttttgaaaatttccaataagttcggataaagcaagtaaaggacggtaggtccatatctggtggctgctcatctctgggttcgtctccaagctccagagcttggtggggaagggtatcatgggataggtggagcagccgaggcagaggaatgaaagacacaaggaaactgacagaggaagaggtctgggagttagaaaaaaaatgcagtctgccccctgtgcctccctttgggggctctttttatcgagtaaattccttggtatctatgaaaactcacttaatcctttcatacccatgaaatttatccgatcccttctatatccctgaaatttcaacttatcccttttatgctcctaccgttacattttctatcatttcactattacgtttggttgcaaatgtcttttttgtccttgatgttttaggtttcaatgtaagcttaaaaacgattgaaaactttgtttgagtgcgcagtatgtgtattttatgaaactaaagagactaaataattagtgcagaaaattttgacataaattttagaaataaaacaaatataataaattaaaatttttatttgaaattttaataggacaatggattttttatcgggagcattcataaataaaattattgtgaaaattggtagtcctatctttaaatgaatgctccttatttttatgcctttttttgaaaaataaatacataatattttttcaaggttatggataccacatacctaatagtagtcgactacatcttggcaggacccaccacataccatgtcctatacggaaacaacctgcggatataggaggagttccggataaggaaagacaaccagagttctacatggaaacgaccaggactactcggattgtatccatattggtctctctagttctactcagacaaggggacacctatgggtatgaatacaagaccccctaggaggagaggggacacgatcaacacggtcaccacgatcaagacccaccacgagacaatcaactcccaacacaatcaacatagaagccaacatacgccaagacaagccgccggatatcgacatcagagatacgcctggattgaccctatccggtaccttcagaggccggccgtagggatctagcactgtctctgattccgtcgggcacgagctcgaggaggaaggctaccctgttgtcgactacgagtcagaccttcagaccgacatgtcgacaacagttagataggctaccccacatattgtactggtatgattatggtgaataaaaagcaacatcggctccggccaacaggatgtagggctattacccgacaatttaggggcccga

SEQ ID NO: 41329 - DNA, 200 bp, Oryza sativa
caccaaccctcccaagtcccaaccgagctgagctgaccgcacgaaaagccaaccgaaaacggccgggaggaagaggcaaaaacgcggcgtggtgacgccaccccgcgctccgtttttctccacgcgacacttgacttcaccgcgacacatgacttcaccgcctgacgccgcctcaccacccactcccccctaatccctcc

SEQ ID NO: 41330 - DNA, 485 bp, Oryza sativa
ttttcatttttggcctgtggatgtcctcgtttttcctttcttattccagaagacttgtaaatgccaaatggaacttatacattttgtgctaagatcaaatctactgaggtgacatggaaaggcagcatgtgctgaatcacgataagatttgccatgaactcttgatagctaagtgactgcagagggtgattccaccagtggatggaacttacatatggcgctgttccagttatctgcagcctattattactgagggtacgaaaaaattgggcaggaattgagtgctaaagtattgtagttttgtgaatcaaaacttccaagtcaacaacatctcaatctcgagtcaacagcatcacaatctcctcttaatacaaagatgcgctccttgcgtattcctgaaaaaaaaaacatcacaatcttgtagagtaatcgccctacttaatgtggcaaaatcttgttcatccctcccaagagtctatctgcca

SEQ ID NO: 41331 - DNA, 1501 bp, Oryza sativa
ttttttccattaactaaaatccttgaaacatggcacatacctgcagggtttgatgattccactcacatcttctagaacgttgatttttgctctttctgtttctaagcctagcaacttcacaaggccctatatgaatcaaacaaaatgctggtaaggtaggttaatctatttatgtatatacatatggtaattgggcattttgtaatagctctcatgtaactgaaaggatcatattagtgacagcagaatgttgagattccgtgttaacgaaatcatgcaattaagaagagaattaatagttacgaaatttgtagttaataaatattgtatagtacatatactcttaatttattattttattaaataaattttaacaaggaatataaaaaatgttagcaagttgtaactgatccaggctcttgttttaagtggaacaactacaatgtcaaatataatcaacatatcaaacacaatattagaattataatatttatagtgttgataataataacccatgcaacgcttggattgacagcgagtaaaagtgtatgaatttcctaaatgatattcaatgaatagttattgcttcagatgccgctatttgatccataacagaatcaatcatgtcagaattgtcttactgagaaagctcccttggtactattccatagcgacggcagatgatctccattcgcagttctgcactctgcttccacagacagattattatacctcacctctattgctggcaatttgacatcaactctgtggatatgaatcatagaaaaacaacagttagaaacacatatacgaggtgacttcattaatctcaaaatatgttggcgcagtgttcaaaaatgctcattggaacacggtgtgcatgtatgtttataaggtgagtgtgtactgtatctcggaaaaggaaaacaacagttgtataaacagagattttatcttcatccagacatacacataaacggtgtgctgaaaaaagaactaaaaacgtgcctgtcaattctttccttctgtctgtgcaggaagcggatatggtcatcctggacattcttcagcagattgtcgaagaacaaacgcctcttcagagctcccgacttgctgctgtcatcaagcagcaacaggttctcacgctcatgctgatcagtgtttgcactaccattattctgctgccgctgcacatcttgcactaccaattctaactcgaactcatcgagatggtgctcatcatcatttgcagtacaagaggcaaattctggatggtgtgatgatgatgagctcatctctacctctctcttgcctttgcgaaattgccttgcgtagtctaattaagcatctgtatgtcttatgtagacaacggattgattggactctcactactaagtacaccagtcagcagtcaagtccatactgcagtgcaacaaaaaagtcctcgtccttgaccacataggagttactccaagacaaaattaaacatcttggtgaatcg

SEQ ID NO: 41332 - DNA, 195 bp, Oryza sativa
tgcaagttgattaagcaaacaacctagcatggttacatcacaacccactgatgcaaaccacgcgctacacacacaagcaaggaacacacgactaacaacactaccctatagggtggcttaggttctacgacgggttctccaagatcttcactcctgcttcacagctggcttcactgcttcctttgcttcgctagc

SEQ ID NO: 41333 - DNA, 559 bp, Oryza sativa
gcggcgtagggggcgcgtgctttttcgtagggtggatcggtgcgggtggtgttgggaattggaaattctgaaggctcttggaaaaagggcaaacgcagcttcaccggtagtgcactgcagtggtagtgggcggtagcgtgtgaaacgttcggacgctgatggagtgggccagtggcgcagccgtccacctgtcccgccatgcgatccctctaccccggtcatccaatgatcgtgttagtttgagtactgccgggaggaaattcaattcatagcacagcttctcccagtagcagaaaatagcacaaaaaaatttatgcctctttaaaagcacagctccgtcatttttttccaatcttacagcacttccatcagtttggccgttagtcagaggaatcagaatgcagaaagacaaaaggaactttgtttcaccatcgtcctcctgctgtcttatttgcttctctccaagcgcggctgcacggcaccgtgtagcctacgcagccatgtctccatggctacgagctcgttcgaccgcgccgctattgtcggagcccgttcgcca

SEQ ID NO: 41334 - DNA, 1501 bp, Oryza sativa
tgatcgagtggaaaagctcaagaggcatggcttctgcatcaatttgctcagacgttgtagatagtgttgcgcaaggtcaggaaaatgccctgctttaatttggtaccagattaatttggatttctgaattgtactaaggtagtttaagcttttctttagctttttggtggcatgtaaacgagataattcatttgcacataaataattaaatattaactattataaacttttaaaatgactttatttgatttttaaaagattttttttgaaaaatgtgttaacggaaaatgagaaagctggcctaattaaataagatattttcgtttgattttcccttgcagtaacgcggtcaagggaaaactctcacttggctggtgtgtctagcccatttcaaactttttagtccatattacatcggatgtttggatgctaatttagagtattaaatatagactaataacaaaacaaatttcataaatgagagctaatctgcgagacgaatttttaagcctaattaatctataattatgaaaaatttactatagcatcatattgtcaaatcatggcgtaattagacttaaaagattcgtctcgtgaattagtccaaggttatggaatgagttttgtaattaggatatgtttaatactccaaattagtgtcaactgatgtgacaggaacttaaataagtccctcttttccaaacaggccagctaccaactggaaggaaggtatggatggaatggaatgtggtcaaggacgaggactttgttgcgctgaagtatggacctgactgctgactgaggagagtgatgaccggtaaattcttagactgtcaagttgttgtatttcctccgttgatttttctattagttaaatttctttaagtttgattaagtctatagcaaaatataataacattttcaatacaaaacaaacattgtatcaaaatatatatattcgactccctatggaagcgaattttccaggatttaacggcattgtactttcagtggtaggcggcgtacccgtcaacagcgaggcgcctgtagtgacttcgtcaatctctaggatttgccggcctagtcttcgaaaatactcataggggtagggtttgcatgcgtgtgttcacaggggtgagtacgcgtgcgttgtactgtataattctaaaaaaattcaatattaaatttaatgaaactaatttggcgcatatatgttgctattttttttataaacttagtcaaatctaataaactttgattaagaaaaaaaatcaaacaacttataataaaaaaatgaacgagtacttgacttaattagctatgtgttggatgtctcaacggtgagctcgtagcgatacgtgcctttaaatagttacgatgagatgtgtactcggcacgtcctctcttccgttgttccttttgcccaacatactttggaatataaatcacacatacacgggctaagctgaagaagttatatagttgtccaaaaaataatcaa

SEQ ID NO: 41335 - DNA, 1501 bp, Oryza sativa
tcaccttcgtctggagaaatcataaatgatatccaattaaacttgtcgatgacacatattacattatattattgtccaactcagtgatgtacatccgctccaacatgtttgagctaaggtatgccggtaacaagtttgggggtatggagcatgtttccgtcaaggtactacatgacctgttgcatgggtaaccttgcattaggaagtgggtatgaccatgtgagatagaagcccgagttttaacactagggaaacctagtcaagactacacctatttagaatcctcatgtctgctgccttagtgactagatcattacgccaatgttccacaacccaatctaggagaatgatgctgctgtttcccttatctggctcaattggcctccgctcaaggtgatccccagaaggaatacaccaaaggcgaacacattgatggatggggtagtcttgctggtctgtcctagttcaggagctacgtatcccagagtgcggaccatgtgtgtggtttgcatatctgtcccatgatcgtaaagttttgctaggacaaactcccattcatctggtcatcgaggagtacgttacctgctttaatatcttgacggaggacaatttgctcccaatcctcatggagtatgataaccctgaagctacttccctgatggccaatccaatgtacccttgctacaatcatataggtatttatccatgctaccatttggtatgtaactatagaccaagagaagtacttatccctttcgctagcaactgcacgaggtcgtggtggccagtggcgcagctatggggggtgtgaaagggtgccaacacccctatgcaaacactaccaccactaaacccccatgtttttactctatattaagattagctaagataagtatttatctagtttattttgtatagcttgaaagtattattagtttagttagttagcaagtctaaaaatattagcaagaaacatgatctacaaaattagtttgtgatttctcatctttttcaaagtaaaatagatgaatgtgagattattcaatagtttacattaaaagaattagcaataaagactagtttcaaacttccaatgatattattaaacagctaaaattcaagtttttcttaaaggactagtttacgtattgtttgttattgacggtgactatttgacctcctttgctatcaatattaattattcggtctcatggtttatcttcaccccacacccccctaatctcaaatcctggcttcgcccctggtggtggtgcaactgtcgcatgcttaacctctacaatgaactccttcatcccatctcccatgccatgattcatgtgacatcctctttacagcgaccttgatggcggacttgtggagcacaccctttgtagacgctacctcgattcaccaagatgtttaattttgtcttggagtaactcctatgtggtcaaggacgaggacttttttgttgcactgcagtatggacttgactgctgac

SEQ ID NO: 41336 - DNA, 1501 bp, Oryza sativa
ttctgatactagatagtactatcgcaacagtgctattgcttaatggatttactacctcctatactacttacccactccttactatcaacatttcatatatctctactcctttaaagaaactttaatgatggtgacagtgaatctgtcacccccttacttatagatggccaaatgggccgttcggcccggcacggcccaagattagtcggaccgatatggctcgctcaacgggcgggctaggccgcgccagcccacgtgctccacctacggccacggcacagtccaataagggtcaggttgtgccgggccaggttgtgccgagccggcttgaaggcacagcagctcatcgtgctttctttcatataagtctattttgccttcctcttctttgggttgtgacatatatatatacatatatatattatatatatatatatatatatatatatatatatatatatatatatatggctaaagtaagtctattttttgtccctcctctttgggccgtatcttatacatggttaaaataagtccattttccctcactcttcttgggggtcgtgccatacatatggcagaaagtaagtctatttcgcctccctgaacttcgtgccatgccgggccaccatgccaaggcagcagccaactgtcaaactgtgccaaagcgggccgtcggaccacggggcatatagccatctatgcccatacgtaactttacatgtttaaatctaaataaatagcttcatataaaattaaattaagaagagtcttcccctatacgaaaatatgggtaacatatttcataaaaaaaatatgtttttatttatttaagaaagtattatgattttttttacccgtaacaaagcaagagcatttagctagtattatggacgcccttagtgctcagtcaatcaccacacagccatttcttttttattcaggccggtcaaaaggggttcaggagttggtagcatcactaatatgctctgttcgtttgggcaggttcccaactcctctttcttgttttccgtgcgcacgcttttcaaactgctaaacggtacgtttttttgcaaaaaaattctttaagaaagttgcttaaaaaaatcatattaatctatttttgaaaaaaaattagctaatacttaattaatcacgtgctaatggaccgctccgtttttcgtgcataggagtttggttcccatctcccccaaacgaacaggggcgtgaacagttggggcatgtggcatcgtctcatctttccgcggatcgccagcacaacacagccatcgcgcccccaaccgccgtcaggctgctaacatgtcaacagctagcaacctggcaccacaaagcaaagcatatcatccgtccgtccgtccgtccatccacggctgaggagcgcacgaaccgacgaagaaaaagggggcaaatcgcaaatccatccatcactttgccgccgccgccgccgtttcctcctcctccctttccgagagagatgggg

SEQ ID NO: 41337 - DNA, 227 bp, Oryza sativa
ccctaacagatgcacctccaatatcgacaatttctatcgagtttttcttgtaaatttatttcttcttaatatacttggatggcctctttcaaccttcccggcaaattcacacctgtgattacccaccaccggccagtcactctgctactccaagccatgccaaattcacccgttgatttcagtaccaacacgctaaaagcgagtttcttttaatttttttttacaga

SEQ ID NO: 41338 - DNA, 1501 bp, Oryza sativa
taaggtgtcgggccatatttatacccgaagtatataacatgtccttgctggacacgactctatctctattacaatttaaaacacgaacaagtcccttaggcggaattttaccaaaaatatctataaggaatttaacaaaatattctaattaatagatacaatttccttttctggactctaatccttgcgtggcaatgcctatgaagtgccttaattgatcccgacaacagttgcaggaccacctgttcgggatcggttgcatcggcttgtccttgtcggatttagtgtcagccgatgcatatggcagccgatgccatccgtagccgatacacactctgcttttctcaaccagaatcccttcaaatccgccctgactctggtcttgaatccgatctatggttctaccaaatttggtcattaacagatacattaagctattattatgaattaattatgtgatttataagatcatgtacgtaaatgacataacgaatcatgtatttcacttattttttaacatccattgtaacgcatgagcacttaggcaccaatttttctttagccccaacaaacctacgacatttaactatttaccacttttaagttgtgacatttaataatttgccactcatatgtcatatgggccctaatatatctatgacatgtgagtcccgtggcaaattgttaaattctacgttaaaagtgataaatacttcatttgtaaaataaaaaacaatctagtattggagatgcagtattttttttggatggtgactagtgagagtagtaaatattcggatggtatgcttgtgtttattaatattgtcagtatcctgattcatatcgtatcttacgatattacgatcctaccaagccaaaacaataccgatcccacctagtattttaattttcatagtatctcgatcctactattcattattacacgatcctataaaattttaggtagtatcccgattctacgatcccttcgatactataaaatattatttaaaataagatagtttgaaaataatgtaaataaatattctcaagtttatataaaaatcaattaaatatatgaaaaccaacgtggtttctattaataaatatttatatttgcatgacatatattattattactatattatatatatatagtggctatatgtaattaatataaatattaattaaactttttttaaaaaatctcatatcccgatactaagataccattttaagtatccttatcccgataaccttgtgtttatagcagaaaatgctttcctgattctcccatccgactatgctgttctgcactggcgcacggcaccaaataaaagcctcggctcgcctcgagctgtccccccatcccccaactggagagtagtagatcgattcgatccaccctccgattcctttaccgaaccgtgggggaaatccgcgccggggatgtcgtcgtcggtcggaggcggagggggaggtggcgcgggcggcggcggcg

SEQ ID NO: 41339 - DNA, 1501 bp, Oryza sativa
gtggccctcgagccaggggtcgatgcagtcggggtggaacgcgtgggagcactgcgggaggaggcggaggtcgtccccgtcgtcgaacacggtgaggcacacggcgcactccagcgcgccgccgccgccgctcctgtgcttcctgacctccgcgtacggcacgaccgggatcgccgccaccgccgccgggtcgagcccgcggcggcgccgagcagccgacgactgcccttgcccagccccagcgccagcggaggagtcgcagtcgcagcactggttgacgatgacgcatacgaagacgaggacgaagaagacgccgatgacgacggtgatgacggtggacacggcgcggttgaccgccctcgtgcccgtctgtggcggcgccggcgacgcctgcgcgttggccacgtggaaaccgccacctacgacgaggaggaggaggaggaggaggcagaggcagcgcgcgcgccgccccatctctctcggaaagggaggaggaggaaacggcggcggcggcggcaaagtgatggatggatttgcgatttgccccctttttcttcgtcggttcgtgcgctcctcagccgtggatggacggacggacggacggatgatatgctttgctttgtggtgccaggttgctagctgttgacatgttagcagcctgacggcggttgggggcgcgatggctgtgttgtgctggcgatccgcggaaagatgagacgatgccacatgccccaactgttcacgcccctgttcgtttgggggagatgggaaccaaactcctatgcacgaaaaacggagcggtccattagcacgtgattaattaagtattagctaattttttttcaaaaatagattaatatgatttttttaagcaactttcttaaagaatttttttgcaaaaaaacgtaccgtttagcagtttgaaaagcgtgcgcacggaaaacaagaaagaggagttgggaacctgcccaaacgaacagagcatattagtgatgctaccaactcctgaaccccttttgaccggcctgaataaaaaagaaatggctgtgtggtgattgactgagcactaagggcgtccataatactagctaaatgctcttgctttgttacgggtaaaaaaaatcataatactttcttaaataaataaaaacatattttttttatgaaatatgttacccatattttcgtataggggaagactcttcttaatttaattttatatgaagctatttatttagatttaaacatgtaaagttacgtatgggcatagatggctatatgccccgtggtccgacggcccgctttggcacagtttgacagttggctgctgccttggcatggtggcccggcatggcacgaagttcagggaggcgaaatagacttactttctgccatatgtatggcacgacccccaagaagagtgagggaaaatggacttattttaaccatgtataagatacggcccaaagaggagggacaaaaaatagacttactttagcca

SEQ ID NO: 41340 - DNA, 1501 bp, Oryza sativa
ttgggctccgcaacttgctcattttcaattatgttcagcagagtatctaggtgctataacctcatgagtattcttaagcacatagtaatatattgtgtttcttattcatttggattcgacaaaaaaagtatagcctatgatcatccagtctactcgtatatatattccttactcttatatacattccttcttcaagaaacaataattgactagcttgattggcgaaatattaacgttttcataaagatgattacccaaattgatcgaagaaatatcaaggttttcataatcttctactattagttatattcttatcttctactattagttataatggtatatcattaactatagaagctataaagttctaattcgtctcatttaccctactacccttctgtagaaaataccatttttgcacacctccatgcgctgctcttgtggcatgtatggaggaaaacctacagtttttgttcagttacccataagagatttcgtatctctgctgctcctgataaatatgcatttatgttacctataagaaatttgtgtctatcctccttaaaaatatgcatttatgattgagtcaaaaagaagttgagcatgagcaagcatcttgacttaagttaactcacaaaatggtcttcatacgtaagtagccttcgagattgtttctttcatactcacactccccagccaataaatgttgttaaataatagaagaaaacaatatttactgatccaagtatttcagcaatgcatcatatcattacaaatttggcttttcaaaacacaaacctagaggttatattcatatttcgatttttttttatgaacaaagataactgggtaacttaacagagatgtatactgacatttttttttctactttaccttgctcccacttcccaacaaaaacactacttcttacgcatctccatggcatataattttactctcgaacgtctggaaaagaaaacatctactctttttcataggaagatttgtatgtttgacacatgcatgagattcatacaccctgaaactttaaccaaacaagcaagcacaatcaagaaaaggacaacagatcagagtttcagttctgtttttttttttaatagagggccaaaaggcctctttccagcgatcctagagtggagacaacagcagtcatgcacgccccatccaccccgcacaatcaatcctaatggttgtgctcgagcaagctatcagtcttgcagctaaacacatcctagccaactactagcatatcgcacaaaccaacaaaacaagtcaaaacccccgtagcaccgcctcccaatccacctaattcgaggtagcaagcagctagaaatccatctaaaccgtccaaaactgaacatccagctactggataagaaacgcatccaacatctaactgaagggggccgaaaaccgttcgtccgttatctacaaatataatccaacacctcggcaacaattcgaacagcacggaaacgaa

SEQ ID NO: 41341 - DNA, 261 bp, Oryza sativa
attcctgcagcccggcaaagggtggaaatgggcgaaggaggtgcggggagggtttaaatggggttgggaggggcagagggcggccggggaaggaaggaaaccggccgggaggtccggccgccatcaatggcgccggcgagatttgcgggggcaaatccggccgtttgaatgcgagagagagagaggggaaaatggggggaaagagggaggggatcacggggagtaattccccccacttaaatgcacgcggggaccgcggga

SEQ ID NO: 41342 - DNA, 1501 bp, Oryza sativa
attaagaatatggcactatgtaatgacataaatatatttatttatttattcagtgacatataagaatggggctgcatgtggatattggacaagtcatgtgatgcatcagaagatagagatcaagtcttcacaagttcaaacggttacatatcgttacttctagtgtggtagttacaattatttcgtaacaatctcaatcttagtgatttgagattaagggagaatgttagataataaggcatagatttgtacttttttgtgttgtgttgataagatagtttctaaccctagaggttgttgtaaccatgaggatataagatatatatctcctgaccttttgtaatcaccatgccaaggggtttttctagctatataaacacacagacgagcttggaggaagggcatcgattcaactaacatcaataacaaaataattttaggaactaggaagagctaagcggcacgctttgctccatccggactcattgatttgctctagaacaaagagaacctccacattataataatttatagataacatgtgttgaatctcatcccaagagaatcaattttctggaagaatgtggtttgggtttctcaaagcacaaaagtcaacaagcgcaccaccatttagagacccaggatatcagagaagacaatgtatgaactatttgtggcgcaaaactaacaatggatgttggcatgttgcataactaccaatggcaggaagataaagatgtggggagcacaaatgaataaatgtcactcatgattcacttataccatttttcagaagcttaggatggccatatctccatggtgctcaagcatcgcatggttcacgttgtaagaaccaatcaattgtaggaagggatgttcattgcataaaggactaagagtatggcgggctcctcaatagattgaatagacatgatgtaaacattcattcagtcatttgtttaataggacttcagtaagaacaaagaaaaagagaagattttcattccacttttgtaggttatgcattgatagtaaaacaacataactagtgctctcaacctctgttacctaaacatcacaaacttgtcatccaatggaccatcaggagtatacacttatactacctttgttttctaatagatgacgtcgttgacttgtagaataacatttgaatattcatcttattaaaaaaatagtgtacatatgtcaaactgtaattcatattttgagagggaggctgagcaccacctcgtgcggagacaaaaataatgggattgctgggaagcgacacaagataatgtggaagcagtgagcccatgtgggggggggttgtaggatcgagatatcgactagagggggggtgaataggcgatttaaaattaaatgtcacctgatcaaaactaacctaagttgctaagctcggcgagggacaagtctaactaagcaactaagttatgttatgcaatcctagggtgaaaatggctcaagtatgtctctatga

SEQ ID NO: 41343 - DNA, 295 bp, Oryza sativa
cccccctaagccccactaaatttttcacgagatgtggtggctggagcttcgtcaggttggctggagggaaggctggaggttgaagacgatgttatttcgcgatttgggcttgtttcgaagagcagcccacgaccacgagcgcagtcttcaagttttgtctagcccactccaagcaaaggcccacggtggcagattccagccggcccatttggctactccccctcccggcctcccgcctccccaattccccaatcccactggccacctcctcctctcctaaatccctaaccctagg

SEQ ID NO: 41344 - DNA, 646 bp, Oryza sativa
gaccatgtggatgtgggtggatgcaagattcaagacaagcatgaatctctctctttattactgcaccggccggtgttgtcgatcttgctagccaccgatttcactgctcaatacacaatgccacagctagcagctactgttgggtgtaatggcatacttaacgcagtcgatccaccaagctcacatacgcaggacattttttttactctttgaatttactgaaacagccagtacaccaagtacactctgtttttttttatttgacactgttgactagtataattttaattttggtcaataatattttttttctgaattacgatgttttgataaatacaagtagtagtatatccagttctttagcatgcaaattgccaaattacatagataatgatatgttttcaaatgttcgtatttttttaaaaaaaagaagatgagcagtcaaagtctgtacttgcatagtacgtactatctgttgtcaaacaaacaaagatgaacggggggagtaaataggtacaaaatcacaaacattttcccgcgtttcatattatttgaggtagaaatgcattcatgtgtaccgtgcagtgaaaatggcctcgtcgtggtaccgaatcaattcaacgattttgatcttgggttttttttt

SEQ ID NO: 41345 - DNA, 1501 bp, Oryza sativa
gcgggagaatttatctgtccggtcttgtatattactccctccgtttctaaatatttgacaccgttaattttttagcacatgtttgaccgttcattttattaaaaatttttgtgaaatatgtaaaactatacgtatacatataagtatatttaacaataaatcaaatgactggaaaaaaattaataactacttaacttttttaataagacgaacgatcaaacatatttaataacattaacagcgtctactatcattttaattgtctgtgtctgtatgttgtctgtttcgttcaaatttgacctgccacatgcaggtgcagctaagagtgtggctgatatataaacatagctcttcagtcagacatgcccaaaatacaattgattaaacttgctgtcatatatataaacgaaaacgatatacttgtgatgtatttatggatgtaacttgaacggaacctgtacatccaaccgtaagagtttccgtggttgacggagcagacgatcgaggacggcaaccaggcgcgggtggcggtagaaagacgatgctcatcagtcctgtgtccatacgctattatgatggagcagggctaggttccaaattaatcccgatcgtctgttggtgtagatcagacggctcagaattggtagtactgagcagtaccatgtcgctagcgaggtggtaccggcaaagggatcgtgaagtcgaatagtagtattgttttggggagtaaaatgtcagacacattttagactaaaaattattcagtttttttttccactacggtagtagttaggcttaacctatcacagtgaaccattaatgtgcacatcaatttaaaagggagtatctatctaaatgtcagacacattttagactaaaaattagtcaattttttttccactagtaaggcttaacctatcactgtgaaccattaacttgcatgcacatcaatataaaagatgttgggtactcattccaattctactttagtaattacactatagttacaccctacttacattatgtaagtaggctgtaaatgtagtgtaattagggtgtaattatgacatataccctttaatttgttctgtttctttaatttgttctgtttgatctattctcttgatgtaaaaaaaattgaattaattgcattggccattctttgcctagtatcattcgtggtagcaaaaactcaattaacttgtgccatgggccaacagccatgccgccttgttccactactggagaaaccaggactagaaaccggtttaagcagtacatggggactctatgatcttaagtctcggttggtaatcatttttagtcccggttctatttgtgtcagacgatgtcagggcgccgaggatctttagtcccggttgatatcaccaaccgggactaaatatctccctcccacgtcttaaatggatcgaaccagacactatcttctgcagcggagtcgacgggagaaggggcggcggccgccgggctggggaggcga

SEQ ID NO: 41346 - DNA, 348 bp, Oryza sativa
cagcccgtatcagggtggtaggccagcgagatggaagagtgtcgtcgacttcaccttgatgccctacaccgagtctctcgttagaattaccgctgcttagcttcttcggtcttgctactttttatcccatgagaatcagtttgtatgcactgcttgtatttccccccctctgtttatcactacaagtactcctgcaaatgacaaggctatttatttgaatgctctattattaatttattttactcccttcgtttcataatgcggggcaattttttactttgcattgttttagtttgatcactcctattttgtcaacgctcttttggtgcagaatgtgcaaatgcacaa

SEQ ID NO: 41347 - DNA, 1501 bp, Oryza sativa
aataggtcccattctagcccaagttcatccatggcagcactagcttaattggagctagggcacttaatcaacgctgcacattaaatcttgagcacgaatgaatgtggcaggggcagcgaaggctgagtagagctcgagcatgactgtactggtggagcttgagctctatctctactaaaaccaactagccaggtatgtgaatctcaaactgaaggtagagagagtgaggaagcagagttggaagaagaacactaggtcctaagtgtaacattttgtaaaaattattagcccaaagtgaaaataatagcttgttcctagtccaagctgcgaccatggtaaagaaagccggtccaatatgcaattaactcttcttctttttttcttttcttttcttttttattttttttgctactttcatattgatttcgcaccgaactcaaccacacagacaaaaacatcaatcacacagacaaaatcatcagcaaattgacatcacatattcatctgcaacttcatagaaacatctagaaatcatccacaaatttacatcccaaaatcatccacagattcaaaaaacatgtaaaaatcacctacaaatttacatcacaaaattatccccaaaatcatccccaaaatcatcgtcaagtcgtcgcctccggattgcccgctgcttgccacctctcctccgtgtgcgccaccgccggccacatcctcccggcgcgcccgcctcctcccctcccaccgccacctcctcccggttgcccaccgcatccaccgcctcgccgtcgccgctcggggccgccacctccctccaccgccgcgtgggccgtcactgccgccgctgctgctgctcgctcccgccctccacggctttggcgctccgccgcgcaccaccgtccgccgccgcctgccaccgcgtgcccaacgccaagaaagaagagaggaaggagagaaaatcgagaggagaggggaagggcgctagtaagaagcgctaagggatgagaagggataagaagcgtagggataagaagagagtggagaggcaccggttaccgaggagatagcacgaggggagatgtgcgggctgcagtttttcttttgaattttggtccaacaaccgggactaaagatagcagggggtctgatacggcctaaccaccttttgaaccatgactaaaattcataaagtatcgtgccggtttagaaccggggttaaagatctttttagttccggttcctattcgaaccggggttaatgtgatttttgtctaacctagcaaagatggtttctcaagtagtgtgttagtcccgtaaggtagaaagaacaaagacaatgcttgttttaattagtaaagctaggaaataaatatattcaacagctgcaaattaattaatacaatatattcctgcatgccctgtataaatgcggaggcccgcaggcacgaacgcggcaaccaagaacgtacaccagccagcaggaaattaaatagtcatcgaccaa

SEQ ID NO: 41348 - DNA, 688 bp, Oryza sativa
  unsure (1)..(688): unsure at all n locations
ttaattagctagctagccccaactcagcccctgcattaaaaaggttgttcccgcaattaattaggccagatcggtcagtcccatcgttcggtatactcgagaaaaaacgaaacggtatatttacaagtagaaaataaccctcggtcccaaaatgtaagcatttttagctgtgaatctggatgtatggagtattttataaccatctaaactacgacaaaaaatttctaaaatcaactttaaatttaaggttaaaaatttagattttagctaacaaattaaacataaatatagcgaaaagatgggtcacacacacggcacactctccttgatgtaaaatatggcaccccgtgcccatcttattgtactcttaggcctggtttagatccaaaaaattttagccaaaaacgtcacatcaaatatttgaacacatgcatagagtattaaatgtgggaaaaaaaatcaattgcacagtttgcatgtaaattgcgagacgaatcttttgagtctaattacgccatgatttaacaatatgatgctacagtaaatatttgctaatgatgggttaattaggtttaataaattcgtcccgtagcttatatgcggaatatgtaatttgttttgttattaatgaacgtaaactaaatacaaccnnnnnnnnnnnnnnnnnnnnagctcaacgtctcaacga

SEQ ID NO: 41349 - DNA, 649 bp, Oryza sativa
atctaaagtagacaagggataggaaccaattcatgctcaaatccaaattaaacaaagcaaaagaagactcaaataaataaccgagcatgatgattttatgcatagaacaacatttttcacgaaccgagacaaaagacactaatgcaactgactaaacaataacttaatgcatgaaatagatgcatagtcatactgatacgcataaacttaccccacctgaacatagacacgacctaatgcatatcacccgacaattcccgaccgactgccgaataaattccgaataaacttttactaaatccctagactgtcccaagtcgagaaatccaattaaataagcgaccaagatttttcccacaaatcaaaagaacaaaccccaaaatgttcccgaaacaaaatccaagtgcaaaagggcatatgcataagaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccaaggcacacaaacgacaattgttgacatacagacccacgtcttacaaaaatataaaagattacaaatgcagcggg

SEQ ID NO: 41350 - DNA, 396 bp, Oryza sativa
ttggcctcggtactgactagtattaagccaaaaatgtgcccaaccaaaaatactgccaaaattagtagaaaaaccccaacaacatgccaaaagatgaaaatgcattttgaaagatatatgaaaaaagaatacatgaaggccatctatgcaaatgaggcactctccaagagactgcgatagtaccctcccaaagaaaacatcatatatatgtttaccaatattgtcctatcaaaaagttaggttttcaccacaacaatttcaatacaacacctttaacaagggatagataaacgttggccaccaaggcaccaacgattgcatcctattaaagctttaaaaaaccagactcgattagttgtgactatcaacagatttagggtagatcaaacagcagcg

SEQ ID NO: 41351 - DNA, 1501 bp, Oryza sativa
gacatgaatcttaacgtggatctaacggttcaaaatctgtaagatttcattcttaaatttttgtggaatgctattaagcaaatccattttattaaagagaatggttaaaatgcgagaggaaatggcctaagacataatataggaccaaccaaaccgaagaagattatttaaagaaaaagactaaatctagcggcacaggattaaaaacgacctagttatgttgctgggaatgaaacatggcacatgtaattttttttatataatatggcacatgtaatatatcttgtaccacctattggtatatttttttcgttccatatagtaccgaatatgatatattatagtattacgaagtataggctggttttgttttttatatgacagagagcatgctgtttgtccttgtccttgttttgcctctcaattctctatggtggagtagatatgtactgagtagtcaagtcggtcaagccctccaggatggaataatggaattaacaacagattctggtgccatcctgagtcgtgctgtagccgagctgataaggtctctattgattaattactctaccagatgagacgtctcatattgtggaaaaaacgaagacttaatttgttggccagtgccaaaaaaattttttttttgagggaactgccaaaaaatttttgagggaaaagaccagtgccaaattggtcccggaagaaattaggggctcaactttttttacttatgcttatatatatatatcatctaaaatttaaatttttaatcttaaatttgaagctgattttgagttttttatctgaatttattttttagattttgcttttagatcgttaagaacacatatatgaaaatcttatttataaattatttttcatttacaaatatatcgtttggattatttcacaaatataaaccaaacgatggggttgtaacttgtaagagatcgggccagccattgactcgtagtaaacgatagcgaactgcactattaattctggaaacccacggccttttgacgaagaagcaacaactaaactcaggaggtgcatgtaatttataaggataattcgttatattccacttcaaattagcctgttttctcatatgtcacttaaaattagccctttcactctatgtcactagtttaaacttgcctatcctcgtgtgtcactgacgtcactcctctggctcttcactagtaatagggtttaatcagttatcagttttttcaaaagtgacccaaaatgttttcgagggaaaagatcagtgccaaattggtcctgggattaatcaagaggcccggccagccattgactcctagtaaacgatagcgaagtgcactaaatatactttactaccctgcctgcttgcctgcaggctctataaattctggaaacccacggcctgtagtcgatcgaagaagcaacaattaaacccagggggtgcatacattccagtcagagagaagaacaggataattaattagtggagtgg

SEQ ID NO: 41352 - DNA, 1501 bp, Oryza sativa
atcctacccagttagtattctttacaagtcaattgatgttcctgcaaggtttcatggccttcagcttcacaatttcttttattcgttacaaaagtatcacatttatttgtaatcaatagtttggatggtactatctaaaacaactgatttggagatgaattgttgacctgttaggatccttaaaggttcccttcgattttggtaagatagagttgtattgttttctttaattagtgtgtgaattaggtgttctagttgtgtgcctataaaacattcattattctgattcttctatttggcataacaaaaactgaaatggtgatatgttgcatgtcttattacttcctttttcagggctatgcattgttgtgtgttggttttccaacttctgatgttgaagttgaaacacaagatgaagatgaggcaagcattaagccaccttgttaatagtagtaactgtcttatctaaccatacagaaggaactagactgtattcttctgaattcttatgataagtcctacatgttccactaagcacataacacctcaatgtataggtctactggctccagtttggaagatatttcgcacgaggacctgttgtaagtattattaaatttgtatttcacaactcatagtttttatgcctaggaactcccgtgtagacaatttatagcataagcgcataactgttgatgttggctgtggttgtcaacaccactgttattccaattccactttaaacatgaaattatatcttctagcttttctcagaaagtggactgctcttttttttcaggaaagggatgattatgcactggagcttgcaatgggtgatgagtgagccgtgtctaaagaggtgacaccaccagaaatttcaatctctacattgtttaatctgttcatttttccccttatattctcatctaactctcagttctcgtccttcacagtggtgtttgcagtcgggagctcatgttgtcttaaggactttctttgaaagtggagaaaggggctttttcctcagctcacaattttccatcttcagtgctgttactctgttagcgattgtttggcatgtaaaaaagtgtgctttcttgtaaaaataccattttctagttcgcacctgacagacgaagaacaccatggattacatgtaaagttgtaaactgaacacctaatcttgagtgcgaataatgaataatgatcaccggagttatgagtttgggaatgatatgctgccatgaaaaccttgaattgagtgaatttgaatcttaaatttatattcaaagcaaatgtagtttcaaatacttccgttctatacaaccagtttgaaaatgagcttctagagttcgttgtagctgagaatttgtagtaaactagagtactgatgcagggcaagttggttttatgttcatgttgcctcacgttacaccgttgtccaattctgcgtggaaccaacctgagaatgctcaattctctgaaactggagtagccgaga

SEQ ID NO: 41353 - DNA, 340 bp, Oryza sativa
ggaatcaatcttcttctttgatttcgcttcgatctatttttcatcttcgatactgatattaccaaatttggtcgtcaacacatgcccccaagtccggaatatttggtaatgtttcggatttgccatatatcaactccgagtgaaattcgcaccttgtcgttttccgaccgttattccaatgctttaaatactaaccgttgccccctaaaaaatcttcactccgttacttccgtttttaccgcctaagccaactttgtcctttctctctccggcgatttctccgacgcacaaggcgatccccaagcgactccatctccggccagatctccgcccgcggcga

SEQ ID NO: 41354 - DNA, 1501 bp, Oryza sativa
accgattcaaagttccagacttttcaaaattctcagggcaggatagtgtttcaacctatgaacacgttagccggtttttaactcagtatggtgaagcatcggctgtggatgccttgagggttaggttgtttccattgtctttatctggatcgactttcacttggttttcttctttgccatgtgggtcaatcaacagttgggccgatttggagaagcattttcatagttatttctatagtgggattcacgagatgaaactatcagatttaacagcgattaagcaaaggcatgatgagcctgtgcaggaatacattcagaggttcagagagatgaggaataaatgctacagcttggccttgactgatgctcagttagccgatttggcttttcagggtatgatagctccgatcagggagaagttctcatcccaagactttgatagtttgtctcaccttgcgcaaaaggtaaaccttgcatgaacagaggtttgcacaggccaaaaagaactttaaaaaggttaatcatgtctgtccttacatatatggatcggatgatgatgatgatgatgactccgaaatagcaacagccgaatgggttacaagcaagaaggttataccatgccaatgggtaaagaattctggagaagaggagaggtatgactttgatatcaccaaggctaataagatttctgatttgctacttcgggagaaacagattcaacttcctgctggtcatacaatcccatcggctgaagaattgggcaagaaaaggtattgtaagtggcataattctggatctcattctactaatgattgcaaagtcttcagacagcaaatctagccggctattgagggaggcaaaatcaaatttgatgattccaagaggccgatgaaggtcgatggcaatccttttcctgttaatatggcacacacggttggccgaacaacagatggaggaagagccaaaaggtttcaggggaattcggctaaattatcaagaagtatcacaagaagtctgacaaacaataaaagaggcattatgaagaagatgatggcggttttgatcctcaatggggctgtaagttctttagattttgctggaattaaggtatgagggtgccatttattgaagactgtccttaaggcaagaattgtgcaaaaatttccagtggatccatttaatagaagcaatcggctaaagcaaacaagggttcctgtggatcaaaggttgggcccagtgaaccaagatcgtaaccaaaaggacaatgaagacaggaagactcaatggtgtccttctggtatctttacaaaaaatcagaagagaagggtttaaaggttgaggaactggaagcgctttcaggaggttgagcaagaaatcaatcatcggttgaagaaggcgaagccgagacaggtgtggcgtgttagaaatcaagctcctgtagccgatgaagccgcagccgatgaagcgaagatgttggctaaaggaaaaagtgttgtgaccg

SEQ ID NO: 41355 - DNA, 1501 bp, Oryza sativa
gttaatttgatcctgcaatcaacaagaaacaaagacaaaaaaaaaccgcggttaaatccataaacgatagccgatcggctaagtgccgatgacatatcatttatctttgagccgatgtcataaatgcatcgatcgacagtcattaataagaactagatctgctcaatcggctgtagatattaacggtatatagtccttatatcgatatatacttaaatcaagtgattgagatagatcggtcaccgtgccgagacagtataaatcacttagatcgaaatatatattaataacaagactatatgtgtttatagcaaagccgatcagatagatctagcgtatatcggctaatactccgataccactctatattaagatattaaagtaagtaagatataccaaacaaaaagcctaatatacttagatgtaacaagatcttaacataaagggcagatttaacatgtcaataaggcaaataagataaatgtagttaaatcaggtaagatcggctgaaacctcgatactaccctaatcggcaaccaaagacaggctagagattgagattctaatcacgactcataagatcaaactcaactgatgcagctataagtatgaaaagaaagaaaatatctagacaatcaagccgttggaaatttcatagagtggtggatatcatatataatctaagtcaacgtcggtatttaacctaatcggctaccctcttctgacagatgttagccgattgtaggttagataacgatatcgtcgaagattatgtaggatatatgataactcgacgagttacataaacaagattagagtatcataaagatggaagcactaatcccgagaacgcaagccgccatagcaagttttacctcttgttgaagatcgaaaccgatacagcttaacccgaaaacaagaactcgtagtaaaaagggtggcgatgcgccgagattgtattgaacgtgtgttagtttgattacatggggctcagggtctatttacacctgagaattacaaaatatgtccatatcggacatgactcttatctctaacaaactctaaaataccataagtctttgcggcagacttttgcccaaacatatctctaaggaaattacataaaatatcctaattaatagatacaattgccttcttaggactctatccatctgtggcaatcatcttgaagcacgtcaacctaaaccaacaacatatgttgcgtcatattgtcggatggctcaatcgactaacccagtccgactcgaactctgccgattttagttgtagccgattcggacttcagccgatcctcactctgtttccgggacgatttccatctcgaattccatctcggtttcttcttcatctccgatccttggattaccaaatttggtcgttaacacatgccccccaagttcggaatattagataatgtttcggatttgccatacgtcgactccgagagaaatcctctcgtgccgttttctgaccgttagtc

SEQ ID NO: 41356 - DNA, 1501 bp, Oryza sativa
tatgccctgtcccatcggcacgctgccaagtgtgcccctatatatggtgaatccaccaaagtctccatgcatttaagagggaatgacggggatgtcctccgtgtcaggcggaggacggcgctgggccccacctaggggcgggcaaccactttgcttccggttgaaggcacggatagtgatctgactcaggctatgtgggcccccctcccatggaggggtagggatgaacggtgcatgtggtatccccttgaactacaagaggaggaccttacccaccgaaaagagggacgactcttaatagctcgaactctaaaggaagcacagctagggtttcccaggagctcaagatctcttgtaagatctccacgataatttcacacataggagtagggtgttacgcctcccggcggcccgaacctgtataatcccttgtctctctcacggattcgtaagcgatctagtagcccgaccttaagcggagatgcgctcttgatcatcgcgccttatcccccggccgaactcacaaaaggagggtctcacaacctcccactagagaggatcactcctcgacaagaataatcttcactagaatcatatatgtaggttcatcagttatctcattcaagctatcatctccatgacctattaactcaacgggcacactgtttgcatcaggatcttgtagaatcagcttcattgcttttaactttttgttatacatctcagcaaacttctgtaaggtttactacctactcatcatctgcagagctatttccactttctggttgatagtcactatcagtagtgtcactatcttctcccacgcttccttctttgtttgcatcgtattgtgtcccttccacgttttccatctcatcagatttcatattgtcagtttcccaatcactttcttcagaattataatatgacattgtttcctccacgaaaatttcagccactccaccttcagcaatgcaacttgacatatcaaggcatgccttgttatctatcactctgtcagtaaccgtaatcctgtgcttaattcttttccaggggaaacaaccagtggagctgcatggcatccttgacctcgatatggtctgcaaggtggcctctaatttcaggcatagaaatcttgtccttttctatatatgacatcccttcatctccaccaacgtattgcacaatccttctagaattgacaaactccccactataataaaatctgacaagaagtatctccaaattattcattctttctagcttgtgctgcattataaaagacgaaattaatttaatttatactagacttgacaagattagaaaagatcatcctacacacatcgatctgcactatgcaacagaaaaacatcaaagccctaaacctcaatgacagaactaaagaaatcaaaaccaaagaaaccaaagataattatatcttgactccatgcctccctcgtggaggctgtcaaccaatgtgagtaaaacaatcaccacaaaa

SEQ ID NO: 41357 - DNA, 1501 bp, Oryza sativa
gattgccaataagggtttcatcggggtttcagctgatgagttatctggacgttgcatcggcttacaaggattgcatacctattggatttagccgatagcaacaaagattttactgtttatctaatcttctgaatttaatgacatcggacctccagccgatgtatgctttaaccttcggatcaatacttgttctatcatatcattattagccgattggtttctactcgattatattgttaatttattacatcatcatcagccgattttctatatgtcattatttacatcaagtgtgagactccacatcaacacatagccgatagctcgaaaccctatcgctatcggccggtatcggcatcggctggaattaatctatcggcttgtcagccgatcggctcattgatctgctatttgtatatcttgtcagttgcagggtcaaactgactggtatgcccgtatctcatcaacctttggacctacgctggagctaagcagatctcccaggccagtgtgtgtttttcgcgtcaacaccatggtctgtatttcatgggcctgctcaactacaaaagagttgtcaaccatcttgtagtcatgaaactgctccgtgacgtacatatcattgctagcatcagtagcaccaaatttggtattcagtgcatcccatagctccttaacgtcggtcatatgcatatacagctcgaccagacgatcgccaagaacgctaagaatgcatcccacaaagagagtagtggcctcattgaatgctttctactggtcagcagtaagaactcccataggttttgtcacaccctaaaaatccccaaatgtataaattgttgcttaattggaattattagaaatgattttaaaagtctagaagaaaagatctaattttaaataataaattccaatataaaagtgggctagataaaattttattaaatacttcatttgattctatagttcctagatttttctgagatttatttaaggcaaggaagtatttttaataaatggaattgcatttcatgaataatttaaattgaaaaaggttttaaaagtcctcttttggctttgggccgaaagtcggcccaaaaccccctctctttctctccccggcccaatcgcgcccggcccagtccgccaagccgagccaccgctcgctcctctctctctctcccgctgacaggtggggcccacctgtcagggcagtcgtattcctcccgccgcagccgcgccctaatgcgcgcaagccgccgctaccgcccttccaaattcgaccgctccttttccgatccgatcgaatcaatagaggggaaatgatccccgggataccctatatcttttctctttcggaatcgtcatctaaattcgtttggaaatcgtgggattcgagctcgattcagattcctttttcctcccgaaccctaaaccttccatcgccgtcgccggtcgccgtgggcctcaatcgccgtcctctagccctttataaggaccctcg

SEQ ID NO: 41358 - DNA, 1501 bp, Oryza sativa
tggctgaacatcggtgatcaaagatcgataatttgggaagacacctccttgcaaataaactgggcatgcggcctgatgcttagctattgaactatcggctattgtcttcatcatgtttgacaaggtattgactaataccctggactgattgatcaaagcatgatgcacggcgtaatcaacccgatcttggaagttattgaaaaagtcctgcgctacttcgctattctgattaagatttcctccttgtggcccctgagcaccatcaccttgaacgccatgaactccttgagaattgtcaccttgatcgcctagagagccgttggtagcacctttggtactcggctgagccgagccgcctggagcttgtttcacttctccatctttagaagaaccggtcctaggactatcagcaaccacttttattttatacttctgaacaagtgtccctttgcgggtctgcatgaatgagttcagaaactgatcccgtgcttgctgcaacgttgcttcaaactcttccttctgctcaggcgtgaatttctctggatcgatcggcataacgttttcttcaatgatgtcagtcaatcccaacttcaatgccttgcctttaacagaacctgggctagatggtggtggtggttgtttctcggccatgaggaagaactgacgtctgacttcttacaggtcccactgggcgtgccaaaagcgtgttgacagaaaacacgtgggctgggagatctactgtcacaccctaaaaatcctaaatatataaattgttgtttaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaagtcttcttttggctttgggccgaaagtcggcccaaaaccctctctctctcctcctcggcccaagccggcccagtcaagccgagccgcccgcgcgcgctcgctgccgctgacaagtggggcccacctgtcaggcctgtcgtctacctccggccggccgccgcccgaaccctagcgccgcgccgccgtcgtctctttccaaattcggccgcctctttccttttccggtgaaatcaatagaggggaaatgatcttcgggatctcctctaccttttctcttttggaatcgtcggctaaaatcgtttggaaatccgtggattcgatctcgaatcggattcgtctatctccccgaaccctacaccttccttcgccgtcgccggttgctgtgggcctttgccgccgcctccttgcccctataaaaggacccccaagcccgccgttacctgccgccaccctcgccttcgtctctcgtcgccggtagaaccctagcaccgtgtagcctcgc

SEQ ID NO: 41359 - DNA, 1501 bp, Oryza sativa
gtggccaaataacgctgtcacgtcaacgagactggcgtgacagtattgttttaccacgccagctaaataccactctagtttgactagcgtgaacaatagatacatatcttgaaaaataaattttgaaaggccttattgtttggccaatctatatgtgcatggttgcagatttggtgagctcaagcctttcgctagtcgctatcacatccgtcgcgattgccacactcaagaccctgcattgtccaagaccgactcagtggcctagaattagaacataaatttttattccatccagggattggttgatttctcttgctgcctaaccggtgagttctctctctcatgaatccctttcccttcgtatctttgcttgtttgcataatgcagaagcagcagggaggaagagggagaagcagaagaaatagaaatagtaagaagtgatcgagaacataatggcaggtaattttttatacaacgtatgattgattgtattttttttttgttttggaatgtaaacatccgagttatatctcatatttgttctttggaactccttctttaccatgtttgtaattatgcatattttgtagtttgctaatattcaagttgattttgggtagttcgttcagaaaaaagtttatacaaaatatcttcttattataagcaatatgctatatgtgtggtagatatttttgttgtctttgtctttaagaaaactggccaattaataagatattaatgctatatgtgtgtgataatttgaacaaattttatatatgtatactaagtttgggtgttatgaaattttaaaggcctgaagtaggaccatccaacgaaaaatttgtaaagccgccactacaagtagcagcaccattattcctgctggctagtgtgtccatttgacgctggtaaagtcaattcgtcaagattattttaactcttttgaaggaaagataaaagctttgccttatatattgtcaagattcttttaacatccactaatccatgatatatccagttatccaccatgattgattgctccatgcacacacattgagacacgccgagaatgggtggtgggtggcctgtgagtggctaccggctagtgccaaattggccgtggaaggaggagctacgccgccgcgcgcacaatttctttctaaaaaaaagtttgaatgcacttttctttctcaaaatctcgttttccaaaataaaactatttcttcatatgtttcattctcttaactaatcacaatcattttctattttgatttcatcatctactatcttttctcaattaatcataatatatctttaagtattttggtctactttttaaatatctgtgtccatctaaaaatggttggttagggacggagaaagtaaaggatacaacagcaaattgcactccccagcactgcaggcgctataagttgtgatgagcaccaaaccaagaggtaaggttcaacaagttcgaccagtgagacgaagaaactgaaga

SEQ ID NO: 41360 - DNA, 549 bp, Oryza sativa
attctcgtggaggtggattgcataattacattgcttggttcaactggcaaaaacattattcatggcatgcatgcctcttgttatggcgttacagtacagggcatgttaaggcagtggccctgttttgctatcttatgcggttgataatgcacttgcagcaatggtgtatatgcagtaccaactagggtaaaaagagtcatggtttttgaaccatattatgaagacatggacacatggttatatctgtcatattgtaccttttcttttatttttcgttggctttctaggtacgccgttgacttcaatagctatatgtcagaattgcgggtatggtcattttggaaattagggggtatacgaaaaaaataaaagtaaagagagcctaccattgttgttaattaagccgcttgtttcatgttattgttgactgattctctgtgcaaggaacatatctcaaacatcactatgtgacttcttattctgatgtttgcaatttgcctttgctggcactagtccctgtgtctggtaattgcctaattggtatctgca

SEQ ID NO: 41361 - DNA, 1501 bp, Oryza sativa
caccgtaacggtgctctaaaatgatctatggattttgtataaacttgtgtggactctgtctattgttaggcttgtcccactcataaaaatttcgaatatgggtctgcccactgtttttttaatacgtaaggagcgcatctttacattaaaaatgagcaaaagttatttacaagggtaacctaagaaaataaaagaagacggagacatgatacaggaaagaccaaagatcaaaagcctattctctacgactgaatttgcgaccccgttccaactacaggaacaaccaaggcgggaatcgctgccctagctagccaccacagctcggcttcatttgtcatgaccctcgcaatctctgtccaagatcgagtttcctgattgaagattttattgtttctcttcttcgaaatcgtccatgctactagggccgtaatggtgtcgaaccttcgacggtgcgcctttgatcactttctttcgggcatcacaaagccacaagtgaaaataagcctcattgtggggcaaacaaactgcatacccaattgcttgaagtgcagtccaccaaagttgtcgggacttcggacatgcgaccaagaggtgatctatcatttcatcacattgatcgcaaaggacacaacggtcaggatgcgatagcccacggttccaaagtcgatccgctgtccaacacctattaagagtaaccaaccaaagaaagtaatgacacctgggagggagaggggcaaggatttccagattggtttgtataggaagcgacttcttcccaagaacataacttgatatgccgagcgagaagaatactcacctaaggactcccatctccaagacaatgagtcaggctcatctgagagctgcaccgatctgagtgtcatccaaaggttgatgtactccaaaattgcttggacacccagtgcggtagaaatgtcccgtatccaacgcctgtcgtggagcgcctcggccacagttcaacgactccacaaacgcgcagggacaatagcataaaccgctggcgccaaagagcgtatcgatgttccatctatctagtagtcctcccagaacaacgtcgtattcccatctcccaccgaaatcaaagtggaaactgcgaccagattcttttctttctgggagattgggatattaagcccctgccatcgtttatccggcgatgttctctgctgccatttacagcatagccagcgagatcttagtgcaatgcccaattttccaaatcctggatccctaatccgcctgtatggctgattactcaacattccacgaagatgaggcattgcatatcgtggaaaaaaatgaccactatattggccagtgcctaatttgtcctaaaaggagcgcattgacccctggtaaacgatagcgaactgcactacgtaccctgccttgctaagttagctgtctctataaattctgaaaacccaacagctagctcgtacacaacaaacaaaccaagagctaaaatttcagtcagtga

SEQ ID NO: 41362 - DNA, 347 bp, Oryza sativa
acaaaagagaagagaagagctattagagccatacccgaactcttccgaaggcttccagactcctgatttatactctattcctattccaccaactagatactactaaactaaacttgagagaaatgagagcccctgagcccctgattcatatttaatacatcgtaaaatctaattcgagagccatctcgttttagcgttatcgcacgacgctgggagagtcgtcctattgcgcgcgtcatcgtggagtccatctgcgtgggcctcgcagtcacatgcgtggctttctggataaggatcgagattaaaccactccaaccgcacatcacacgtaattcttgcttcaaaga

SEQ ID NO: 41363 - DNA, 283 bp, Oryza sativa
atcatgcgccttgatgagacgatttaatcaaaagaattttgagtatcttgcactcgcatttttcatttgtggtcgtactacacggtatgtgtatagatggattatatgataattaactagcaatagttttttatttattcgagaaaaaagaaacatgattcaaaaatcgtaagtacttaatccatctcctacttaagtttgtgaatggttttttaagatacgttaagaaaaatagaacccttaaattattataaaataatattatctaaactttagtttgccc

SEQ ID NO: 41364 - DNA, 1501 bp, Oryza sativa
tagggatccaggatttggaaaattgggcattgcactaagatctcgctggctatgctgtaaatggcagcagagaacatcgccggataaacgatggcaggggcttaatatcccaatctcccagaaagaaaagaatctggtcgcagtttccactttgatttcggtgggagatgggaatacgacgttgttctgggaggactactagatagatggaacatcgatacgctctttggcgccagcggtttatgctattgtccctgcgcgtttgtggagtcgttgaactgtggccgaggcgctccacgacaggcgttggatacgggacatttctaccgcactgggtgtccaagcaattttggagtacatcaacctttggatgacactcagatcggtgcagctctcagatgagcctgactcattgtcttggagatgggagtccttaggtgagtattcttctcgctcggcatatcaagttatgttcttgggaagaagtcgcttcctatacaaaccaatctggaaatccttgcccctctccctcccaggtgtcattactttctttggttggttactcttaataggtgttggacagcggatcgactttggaaccgtgggctatcgcatcctgaccgttgtgtcctttgcgatcaatgtgatgaaatgatagatcacctcttggtcgcatgtccgaagtcccgacaactttggtggactgcacttcaagcaattgggtatgcagtttgtttgccccacaatgaggcttattttcacttgtggctttgtgatgcccgaaagaaagtgatcaaaggcgcaccgtcgaaggttcgacaccattacggccctagtagcatggacgatttcgaagaagagaaacaataaaatcttcaatcaggaaactcgatcttggacagagattgcgagggtcatgacaaatgaagccgagctgtggtggctagctagggcagcgattcccgccttggttgttcctgtagttggaacggggtcgcaaattcagtcgtagagaataggcttttgatctttggtctttcctgtatcatgtctccgtcttcttttattttcttaggttacccttgtaaataacttttgctcatttttaatgtaaagatgcgctccttacgtattaaaaaaacagtgggcagacccatattcgaaatttttatgagtgggacaagcctaacaatagacagagtccacacaagtttatacaaaatccatagatcattttagagcaccgttacggtgctctctacctataatattctactagcactaccggtagaagtaatctgagccgttaatttataagggtacattagtattttactaattaaaggttaagggtaattttaacatttacttttctttttcttaatagaacgatcagttcgtctgtgtcaccgctcctttcgttctggcgtgcacccaactccggcggcagggcccactccggcaagtgagagctcctccatcgaacaaaactactgaacaa

SEQ ID NO: 41365 - DNA, 1501 bp, Oryza sativa
ttgatatgtacctattaaataaacaatatctatattaattaatttatacatgcacataaattgatggccccattacataaatcatcagatctacttttcattaccttggtctattattcactgtttcaaaataaggtctacaccactatattgtgtacccattaaattaacaatttaaaatctatattaactaatttaacttacactagaactggtggacttattattataatcatcggatctattgtttgctaataaataaagcgtccgaaattctctttttgcccactgcacaatacacgtatgcacctttgcctttcgcatgtgtgacaaagtgtagtgtctgagacatataaggtgatcacaaccgctgtagagctaccactttgccacaaatcaaatcatatatggagatgattaattttgttaataacatgaaaagaaaattaaatgtgtgatgcagtgagagaataattaagtaccatggattgtgcttttctcaacactaattagctttgtttaagttgaaaccgagagttgattacataataattataatgtatctgtgttatgtcatatttagattttgtactatttgttcgtataggtgaaatgaatcattatgttataaatgtgagcgcaatattgacgaatattgatagaactcttactacgacaagggtgataaagggagtttaaggccctctctttttttcccgattccatattttggaattttgtttgcatgctttccaagtttctaaatagtgtcttctttaaattaaaaacattctaactttttagaagtcaattcattcatttataccctcaaaaaaatatcacataaattatataattcatccattttcaaaaaaaatatatcacataaattatataattcatcaatttcagctatcgtaaaccttaagtactacattttttttttcatgcgagtcatggtgataaattattaaagtcgtaagatgaatatgtaagagttactttgaacaattgtaaataggtgtcaaaattaattgctattaattagaggcttgcaagccacaaaattaatttcactctacatgtatataaacatggacgaaactggaacaaatattaccatatgtcccatacatatatattgcacagttaatattctaattacatgtgttaagtcatttaaaattccttaaaatgctctcaagctgcgacgtggtgctctaataaattagggcaaatattagaaattctaagaaaaaaacaaagtatctatttcttgattttcacttaaatcggttggtccaatattacaaaccgttagattaaattgatcttagaacaaactaaatagtacgaggtcccatctctcctcccgcggcataggtacggacctacgtgcatgggtacgtacgcttcccctccctttttcattttttctccttcttcctttttttcccatgcatatgcttccctctctttattactatatcatgcgccttca

SEQ ID NO: 41366 - DNA, 1004 bp, Oryza sativa
ggtatcggtttggtttcgtttggtttgcttcctccgatcgagagcttccttcctcgtctcgaatccaatccgttctctgtgtagttctttactgggctgtggggatcgggattccgagttagcttagagcttagcccccttctagttctagttctactgtgtagagagaatctgcacctgccaggtggttttttgttgttgcggatcgagttgtgtgatgatgattccccgaccaagctatgcagcgagtatccgcgatttcttaccttttgcttgctgagttgtatggcgaagcccccgatgcttccgcgacaggctgatttttggtcatttctaggtggccattgaccttgtagatatgggaactggttaaattggttatgccttgtcacgactaaatctctcgctccttcagttcagttgctttgtttcatcattcgatctcccgtgttagctagcataatatctgctgatgaactgcctcgggggttgagaatccattatcagaaaactctatataggcattcgaaagggtcccatgccaggttcgatttgaattggtacatactacctccgtttcacaatgtaaatcattttagtattttccatatttatattgatattaatgaacctagatagatatatatgtgtctagattcattaacatcaatatgaatgtgggaaatgctagaatgacttacattgtgaaacggaggaagtatatgctattttggaaatagttaacgtcatactaattggttaggagtcaaataggcatcaccaagcactttttgaattgactcaatgtttcccctgtttgtgcttttgccatctactaacatatatacactgcaaacatttttgggttatggaagaaactcccagtctctgcatgttctgcaaatatttcaattcataaattcatttagaataactaagtttcctgtaataattttctgaaattcgttcaaaattgtttccctgcaacaatttcaggttcatga

SEQ ID NO: 41367 - DNA, 1501 bp, Oryza sativa
tccgggaaaggtgttatacaaccttccattttcttatacctataacaataaaccatataaaaaatcattaatgaaacaacatataaatactgtcagaaatagaaatcttcagataagcatctattcttgattccaccattaagagagcatttgcatatatcagcagcgatcactgtaataagttgcccctgacaaggagtaagggcaatcacctacaaatcctataatctagtggtatatgaaaaagctagctgtttttcttgtataacaaggattttggaattatggcgattataacttagtcgagttgatatggcatgttagaggttaacagcacgcatatagtagaactagatacatagagaacacaccagacatcatctgcatcttgaattttgcacatcctgctaggatggtcatccttattatgacattcatttgaatctgcctttttgcgccaaataacagtatctcccttctcatgaatcttaccccagcacaacatttcagcaattttttcgattacattttgttctgcctctaaatcttccttggatcttttccatgcttggtgatttgtcttccaattgatgggaggaccagacaatatccaatagccaccaggcctcagaacccgatctactttaaacatgtacatcgcatctgcatgaagcgaaataatatagcatatgcaaaaaagaacagctgatagaggcactacattttgtatgcacagttgacactactaaccatttgacttccaggagattaagcagcgtgagcaatgggccatatcaaaagatccagaggggtatggtagttttatagttccaagcactccaattactgcaggaacacctcgctccaatgcaaattgaacctgagcttcatgtgagtctcgaggtgcaaatgacatggttaatacatttctgtccattaggtaagcaccccagctggcaacctacaagtggcttaaattgttattgcagctacaacaggtgatcaagaaaatactaacataaggtcaatgaaactaaatggcctaattatacacatgaaagttcagagaaattgggctaagatgcactaatatttcatgaattactgctatgaggtacatcataaattaaggaaagaagcaactaaaaagacgctaacagagaggctaaaagtagctgctcaatgtttatacatgttcaagaatgataggatctgtttagatgacataccccgcatccagtatcaagtgcagtcctaatggtgccatcagtaaatggaatgacggatgcaagctcatcaatgtaggcatttgctccattgggaaacattgtcccccctcctggaaatctaaacacatctccctcaaactggacccagttctgaacagccttctcaactgtcaaattcttatatggtgcatttgcatatggaacatagtcacggctcttgggccaaggaaaaggggtgacatagcctttgggtgctgggattagacagcgca

SEQ ID NO: 41368 - DNA, 1301 bp, Oryza sativa
ggtcgctccccgaccacgtccgctccaaccgctgcctgcaaaacaaaaaaaaaaaccagaatattcttttattaagctcacagatctgagattatttatactggagtagcataattcaatgtgtttgaactggtacactgtatgactttatttttctgaactgaagttttattggttagatctagtcagttagagaaacctctttgttttttttttcaaaacatagtacaatgtactctatttttatgaacacatttgaagactagattgatatatttttatcttcagatttcatcacaggtgactccctgtcaaggggtatatcatctataaccaacagaataatatctaatcagatgagttatgctcgctttgcgaaaatctcttatgtgtttgtttacctgtgacttaaatgcattcaacttacttgacactttacgaaatatcaaatcgaggtttaattctaataatgaaaaaaatcaaacagaaacatatatatttttcatactctagtagtaatttattgttatattgacatattcgcatggtagtaactaattgcggaatagctaattgaaagtccgtttgatatctgaatgaagtcatgaaccttgcatatcgttgaatggagagcatagataatagggttttgatttcctatgttagatagatggggttgcgaggtaatggctattttatttatatacaaatattgcgaggtaaaaataatgcttcggtgtagaactacttaacaggtttcagtgtagatcatctacttagttgtgtagttgtgagtgtattcgtttgtactgttttttttataaaaaagctacataaattaaccagatccatacttctccaaataacaaatcttaaacgatttattgaagaacttcgcaaatttgaagatcaagaaaaaaccgatttctattttatgaacgatgggcttgggtttgtgctggtccatacttatgggcttaatatggcccgacccaaaagtcacagaggcccgagagagagagaacgcgcgcatctactggacttctgggcccacctgtcggcgtcagtcacaaaggcaatagaatcccgaaccgtccttcacagcgccgcttcaaaaccctagccgactcaatcccggccacactcccacccccacgcttccctcgccgccgccgccgccgccgccgccgccgcctctctccccgcaatctcctcgccgccgccaccgcagtcaacgacgccggccgtcgctgtctttctcgcgcgcgcgtggaggattcgaggttttatgtaggcgaaga

SEQ ID NO: 41369 - DNA, 320 bp, Oryza sativa
ccgctctcgccgtggatgggacgttggagtagtggagtccaccctcaccgttgtttgcttgctgagacctaccgccacctcacgtgtgtatttactatcttcgtctaaaaaattaatcctaactatatacgtagataattgattttttttattacgaggaaagtatgtccatggtatgggtctgtacgaatggtcaaatgattggattgggcagcaccgtgcggggcctatgtgtgcccctattgcccccaaaacccaacggcattgacactcatgggattatataatttggataatatactctgttcttttttaaaaga

SEQ ID NO: 41370 - DNA, 514 bp, Oryza sativa
tcccgcatgctacaattcagaccatgtgtaaggaatttcttgcattggctatgcaacggtgtcatattaagtcaaagtattggttcgggcagaaaagcagtgcagggagactcgacctgtcaagcagcatgcgagtaggacccacgcagcagcagatgaatatcatttggagtgtcaacggactgtttgacagtacatgatatatttaggatacataaagggttctcttcatttctagtgtatttgatttatctattttggtgatacgtgtattatcacatcatggattagatcaactcaaacttaaaatggaaagtgaaggtgaacaaggtctttgcggagtctgctgtgtgccactaagaagaaatttaatttcacttggcaagacgactatagtgatatgagagaaggtggagccctgttgcgggtggagtcaagagagataatttacggggatagcaaggtctctcgttaacggtgagccgggtgaaggttcgtcgggggcggctcaaca

SEQ ID NO: 41371 - DNA, 1501 bp, Oryza sativa
gattgcaggcgagaaaacttctctggacttttgatatctttcatggttgatgtcctcaaatctaaagtccgatggattttccaggagagtcgagtcttcataggagaaccaaatccgagcgtctttctgaaagccatcataaaaactgcagaaccagtccttaagcagttcagctgatagctttgctcctgcatcggctggtgtggcatattctccataagatgtgcatctacgatgggtgcgttcctctccatcatcttctacaatcggctccagtcttgggaattcggcttctgtcacagatggccgattgacgaatttcatgaccatcagattcaaccaggattgtaataaccaccatggtccacctgccccaactactgagccgatggctatcttagccgatgcattattcagcatttggtacaaatagccgaagaggatcttgcctaaggggaattgtctctttgattccaaggcctcggctacaaactgccagttggttgtagggccgcagcttaatccacagaagagaaattcctccagccacatcaacagaaaggctacatgctctcgaggagtgacagaaccttggcccacatatgctgccacataacctgaccagccgtctatgctcttggtcctaaaatcatactgattcttcatgttcagactcatagagttggccgatgaggtgacatctagaccggtaatcatggtgatatctattagagttggggtcatcggcccttggttgaacaagaaagcattgatggtgttggaccaaaaataggaggcgacagccattaaaggttcatccttgtcagaattagctatggtaaggtcaagcgcttggccgattccgatttcgtcccaatgaaccctcttgctagccgacatacgcttgaaccatgtaatccaactcttctcgggtgaagttttctcgagggatggccaagatttaaaggtgttcttctagtgacctagatctgggttggccaatctgaaaggaatcctattggtttcgccgatgataaactcggtaggatcagggttgccgactgggccgaggaagtaataatttccgtgcgataggcttgtaattgcaactaggttggagagatgctacaaatccaaaagaaccgagaaggggaaagcgggataaggagtaggaaaatcaatctgttgcgagaaaaggagatctagccgatgagaacttacctcagcgtactcggctgatggcgcggcaggcgggctggcggaggatgacatcgccgcaggcggagatctggccggagatgagatcgcctagaaatcgcttcgtgcaccgaggggatcgccggggagagagaagacggagcttgcttcggtggtgaaaacggaggaaacggtgtgagatttctcggggacaacggttagtatttaaagcactgactaacggtcagaaaacggcacgagaggatttctctcggagtcgacgtatggcaaatccgaaacatta

SEQ ID NO: 41372 - DNA, 1501 bp, Oryza sativa
ggcatactcagcaagccacgcagcaaatatgcaagtgcaagggatagcaaaggatggcataatatagtctcatttgcataaatagcatttaagaaatatttcagaatttaataaaacaatagagtatttaattaaacaatattaatccaacgctatacaacataccctgttgcataggcccaaccactctgaacaaccaatcgcggctgcacagttctatctccaaaccaggaatataccattccaaaccaggagctaaacaagttattacctattacagcatcattttttatggtgagaggtgtgaaactaatcacgaaagacattgttagacccgcccataaccgcgggcacggctattcgaatagttttactctggccagaggtgtaccactatacccacaagacacaacctcaacatcatgtcaaccatgcgtcgcgatacttaacaagtacccgaatagagattgtgataataccctctgcataacacaattcaaagcagtgcaccgttcccggatcataatcacccccttgtaaacaaggcatggactccccagcgacccccgtgggcttatctccgccacttcacagtctggtgctccgcaatgaaccatactatacaaaaagtaaagccgttgcccacgctggcttgtggttggcacgattaatgtttcacaaccgaaactcgtgagctggtccttaattgtcatgagcacgaccatcaaaaccatgtgctcacaacccaccattatcagattttagttggcacattaattaattaaccaatcacgattaaccatcgtgaactatcattaagccatcattaaataatagggaatcataagtatcccatttatatgagctagtgtctctaagcaaggctaagcatccgattcactttagctaaaaccatataatgttttagctaatccaattgttaaccaagtgacaaagaataggtaatcaataacaaaatggctataacaaggcaataggttatttccacccaatgacattcaaaaataaatacaatagttgaatagaaataatagctttagacgggatcaacatgctcaaagggtcttttgggatctgtgtgacttgccttgctggccttggaactcttcaaaatcttctcctgcaaactcggactctccgggaacgtcggaatctaagcagaaaagaacaaaatcaccaaaacagcacataaacactcatgaacagtacatgtgggtatttttaacatgtagatatcaattttagaaaaatttaaagacttgaaccaactaaatccgagctaagatgaatttttaaagattaaattggtttaaaccatttatatatattttaattgaattatgacgcgataaagaattatttttgaaaaggaaaagagatttattgcgtcagcgggctcgggtttacggtggaccaggtgcacgggacggtctaaggaaacgaacggccgagatcgaatcggtctaccgcggtctatggc

SEQ ID NO: 41373 - DNA, 1501 bp, Oryza sativa; identical to SEQ ID NO: 41111

SEQ ID NO: 41374 - DNA, 1501 bp, Oryza sativa
ttttaagtagattatatgttttaaaaataatttattttaaaatatttatttttaatcaataaggacctatatataaaatttttactcataaattattttttattagctaataagccatatggataagcatagcataccctacactgcgggtggttgcgattgccatcttcctaagctgccgctgacattctcttcaacgccggtttatttgtcgtcccccatgctgtggcagccacgctcaccgtctccactgacgtcactctagatatgcctcctattccaccttctgccgctcctatccaatttatacaacgaggctagactcggacgagtcgctcattgtctccccaaacatgaggaaaggaaggagagtggggaaagcaagagaaaagagagagaggagggtcactaacatgtggtcccacatgttgacttagcggctaaaccaggttaacgtgccacgcaactgaaaatcatcgtcaatactactaggagagttattcttcattggtttaaatagttagagggttgatatgtccggttttacggtttaggaattcaaattagattcctatctgagtgaaattggactctttgcgctctcttcaccatggcttcctgccacacgaagccgagcttgcgacggtgccatgtcgaagagtggggagcttccctctacctcgcggaggacagcgccgatcggcgacctctgcgtgccagttgccggttactgggcgccggcggtgggcaccctcgaaaactgacggggcaacgcgcacgaatgaaggcgatcgagaaaattccttatgtaccctaaaatttaagctaatcccttctatgcccttgaattttgtttacttccttgtatacccaaaaatttaattttgatcccttccccctctcgtcagttgaccgtctaatttctagaaaaattaccattttaccctttggatgtatatacaaatttatgaattatattattggaaatgtaaaagtttgtcgcattagactattatggttatgagtttgatgtgtgatacattatttattaaaaaaactatttttagataatgaaataaaaaataatgtatttattttattttaaaagtcataaaaatgaggagcattcatacaaaaaatactgcgaatgctcaccatattttttttatgaatgatcccgataaagaaaatctattgtcatattaaatttcaaataaaaattttactttattacatttgttttcttttcaaaatttatgtcaaaattttccgcactaattatttagtctcattttctacctaaaatgcatatattgtgcactcaagcaaaattttcaatcatttttcaagcttatattcaaatctaaatcatcaagggcattaaaggcatttgccatcaacttaacagttaaataaaggaaaatgtgatggcaggtcggcaggggcatggaagagataagttaaaatttcagagatatagaaaggatcggataaattttag

SEQ ID NO: 41375 - DNA, 164 bp, Oryza sativa
ccctgctatagttgaacactatgactatgccattgtatgggttgagttaggctagcttagctagcttgcatgcacacaccggataatatgcgtcactattttatatgagcaatatatatgcatgatgctttgcttgcttaatttgcatgcttgcagttggtaga

SEQ ID NO: 41376 - DNA, 1501 bp, Oryza sativa
aattatcacaaaactacagatttaattcggtgtatcataaaactacacatttaacaccaaatttatcacaaaactagatatttaagatgaagtatcacaaaactatatgtttagtaactaaattatcataaaactacaagtttagaactaatttagttacaaaacaataatatttatagctccagtataataatggtgctagggatttaaactctaatgttgtagttttatgataattttaatattaaggggttgtttggttggctcccaaagtttgccaaaggttgccacacctcatgttagtcaagtttgaccaagttagcctattgtttggttcataggcacacttgtggcaagattccttctcatctatttaggcccccacatgtcatcaacttagtaaaatgtgacacaatccaattttgctagctaaggtgtggctcattttttgtaagccacaacttagggcctatttggggagctttagattctgagaagcagctgtttggtagccaacttctgagaatctagaaaagctctgaaacccagcttctccagcttctggcttcttagttcatttttcagaatctgtaactacagattctcaaaagctgtggactgtttggggcagcttctagcagaagcagcttttgagaaaagctgcagttgggacaatctcccccaaacagggccttagacaagtgtggcacaaaagtatggtgaatggtggcaaacttagtatagcatccaaacatgcaattttgtgatacttaacttaaatatatagttttgtgataaatatgatgctaaatatgtagttttgtgatacaacgccttaaattcgtagttttgctatagtttgattaaaaaaaatatctgtagtttcatggaatttacttaaaaaaatcaggagcaatagtgcctcatttagaagacacgatatttaaattaagggaattcgatttcatgtaaaaaaaatcagagataccataattaattaaataaatcctgagaggattaaactattttcatatagaaaaaaaaaatctgctactaacaaattcgtgcgtggcaaggacggaaagagcccaaaacgaccaaaaccggactctcccgttcgcgtttgaggagcacttcaaatttccgaaggactccactgcttatccttgtcttcccccaatcatctcgcccacgctgaattctccaattaattttccgcccacaccgtcgcgcacccagttccgccgccgccgccgccgcccgccggcacagcgcccgcagccagcgatggcggctctaccgaggcgaaagcgtaagcgcgggttaggcaaagccgcgggagcacgaaagagggctcgcgagcagcaccccggtgtcgccaaggtaaaattacacgcaaaaaagcatctaatctgttactgctagttctgaattttgttttatccagtccaataaatcctctgccccttctagttcagtttaaccctgcttttacgcactt

SEQ ID NO: 41377 - DNA, 1501 bp, Oryza sativa
  unsure (1)..(1501): unsure at all n locations
gcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcggcggcgacggaggcaggccggcggtgaagtcgtagacacccaacagcggcggcataataggccagccgtgtaggcggaggcaccactcggcggcgacggaggcgggccggcggtgaagtcatagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcggcggcgacggaggcaggccggcggtgaagtcgtagacgcccaacagcggcggcataataggccagccgtgtaggcggaaacaccagtcgacggtagcgaaggtgagccaacggtgaagatgtggacgcccaacagcggtggtgtgaccgaccaacncgtataggcgnatgacaccggtcgggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgcttgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgcccctagaggggctccctgccctccttatataggttggggggcaaggttataagatagaaaccttaaccaatacggtatcggtttcctaaatctactttacaatcttatcaaaccaggactttaggccgttccataatatacagggaaacgt

SEQ ID NO: 41378 - DNA, 1501 bp, Oryza sativa
tttcttcaccatgaagacgaatttcccccaatcttttcaccaagaagcggagaagccgcagctgcaatgagctcatggtggtcatggcgccgcctcttctccttgttggataatggagggggcagcaaagccgacgcttcctcctgatctggcacctcctcctgccctcccatcccccaagctcaacaagcagcagcaagggcgcgtcactgccgaatcgctcacactcgtggtgtactagtatagcaagaataaacccaccgttgattttggtggccatttgagtcatttatttaattaaggtggaaggataattaagtagttatggttctatgataggttgatgcttgccagccgcctagcccaatatcgttcaatccttagctcacaaaccagaaggatggtcgccgtatcgctcttgcctaccgtccgccatcgactatcgctcttcccttcttccatgaacacggggacgggtacacggtgactccgtccctcccaactccgctgcaaacaatcggcgcccatccttgcgcaaagcggctgttataaaagcagccccaaaatcgacatcggtagctaaacacgaaagaaacgtcgtaggtgatgccaacatgatgatgataccgggtactatatttgctaacggagttcagccgaggcctacatctctggtgcactgactacagacgctcctccatgatccagcatattacagcatatcaaagttacaatgactcatgactggacgccgccggcaaccgctccttctcgctatgctaaatcgccatgtggtcatagcaggtccacccctctatttaagagagatactaggatagagacagactcttactctattcctaacatctaatacaactccaagtcctatactgcaaccgacaacatacacatattcgacacaaactccaacaaactccaccttggcacaaactttgtgtatataaactttagacatataaattttgttgatatatatttgaaacaaattggaaaaagattagagaaataacataacatatatgtgggatgagagacccatacgataaacgggccaagccaatgaaagattggactcatttttgccaaaaaaaaaacgaaaacaacactcttcataggaaaaaggaataaattcactctaggtccattaatttgtcgctgaatctgaaatctatacctaaatcgacataccatgtataccctatgttccaacttgcaataccatgtcaactttcagtctagaagtattgtggccggtttgaactgacgtagcaagtgggccccacatgtccgttccaattcttctgtctcctttctctctcctctcgtatccttcacatggcaatggtgtcgaaacatgaattcggcaataataaaacggggtagcgcacgagacctaaaagtggatggatgtggagacaaaggatttagacaggttcaggccctctcgatgagaggtaataccctactcctgtttggggat

SEQ ID NO: 41379 - DNA, 751 bp, Oryza sativa
acttaggcatttttgctttggcaatttatgctcgcaatggtgtggcccaatgctgataaaatcctttttaatgcggttatataattctttggaattattgcaatgcaaattgaaaggtacccgacagaaaagtgttatactatttttgtaagcttttttaggctgcaaaagctgtctgggttgatttaagatgacttgtttttacaatggtcattctcttggcgtgttatatgcctattttaattatggtgagagtcatagcctaggctattagacttattaattaccataatttttataacatttgatggattatctttagagttttttactcggatgtttgttaaatgtgttcatttgtgaaccttttagagtgttattcactcggatttttttactatggctggaaagcagtcggctgaatgtcttgttggacgccgcatatgcttttgtcatatgatgcatgattatgcaattattttattcttgactacatgtttagtttgttaactaatcatatagtcgggggctactgtggagattatggataccccatatctacacggcggttatatttagactgaatataggataccgaatatagatagaatatctttatttgtatctcgggtttgtttcttaacttgtacgtcaaggaaatatcctgagatttagtcggttacgattgtattttatttgtattctcgtattctgataaggatatgagttataccttgtaatacggactcct

SEQ ID NO: 41380 - DNA, 1501 bp, Oryza sativa
aatgggtggaatcaatgatttgacctatatccttatagtgagcatactccatgtagctttgagcatctatattgtactccctctgtcccacataaaatccaatcctagcatcccaacacaaaattagtggaggatgaaaatgaccaaaacaccccttattattgaataaaatgtaatggtgataggcaggtaaagggtataaaggaataaaacttctcgttttatgttctgagggtaggtatgatgatagaagttggttttctgttggacaaaattcaaactctataagttgagttttttttatggagggagtagacaacatgtgttatataatttgcttaataaaataatgtatttaaacattgtttatagattgaagctagaggatattaggatgtgttcttttcccctctttcctaacttatttcccttgttttccacacgcacacttttcaaattgttaaacgatgcatttttttgcaaaagttttctatatgaaagttgctttaaaaaatcatattaatccatttttcaagttttttaggctaatactaattaatctcactataattgcatactttgttttccgtgttgggaggcaaggttcccaactttgtctcccgaacacagccttagacgatatagacgttgaaggagatggtcatgaagatcctagtccagttgcctgtcaagtctctaatacggttcaaatccgtctgcagagggtagcacgtcatgatctctaagcgctcctggcagtgttatacagaagacatatctaatagttttgggttgggctcgacgggactcaccatataccaaatcttatacgaaatgtgttccggataatgaaggaaaagcaaagttctactcatacactacaaggactgcttagattgtatccatacttgtctcttagttctacttgaataagggaacattcgaggatataaatacaagatcccctaggaaaaggaggcacatgcaactcgctaacacgtctagacagatctagacacgccaacacaagacaagccaatacagatataaacaaactcaacgtaggacccacaaaggccgacatgaaggatccagcgctacctccaatctcgtcgagttcatattcgacaaagaagactacattagctctcgactatatgtgagagctctgtgccgccaaaccgacagagactagattaattaggccatcccaaatattgcacttatgacatattgatatataaaaacaacaccagcttcgaccaataggaatagggctattacatgttagttaaggggctcaaacctgtataaaagtcacagtcgcaattctcttttatcttaatctcgtgtatacccttattccaacgaccgtatatactctacaaataccgtctgtctgtgagtataacccgtcgaaagttcgaaacctccttcatccacgcacatctccattgtgcaacctctcgtcgggagcaggagtcgcccactcgcccttcct

SEQ ID NO: 41381 - DNA, 1501 bp, Oryza sativa
aagtttatagatccaaagtttataagtcaaaagtttacatacctgattcaaatttgaatttgaattcaaattttttacacataaatttttctaactttttgtttttttaaaattttgttgtggtgtgctgatcgatcgccccattaggaacccccctgtttcaggggcattacataagaaagctttagtagttatcgacttcatccgttagagagacatttatgactatttttaacggtgttatcgtattatccggtagaagtggtatgtttagactatttatacatagatgtgaaaataagtgatggacatcgagttaagcagtgtagatgattttttagtgtattaataatatataatttattttagtggtattaatgcagtttcatttattaaaaatgcacatagcatttaaaacaataacaataggggagtttatatatgaccacgacaaaatgatttttatttaaatatgagagatattcttattcttatatttagtagtatattaaaatataccatctattttacagcaaatatatttcttttttattgtaagataatttacattcccttacagtgtatataatgatatatgatttatgttactattctttttcttgaacaacaaataagatgtcaatgcatctatgtgggctttatttccagtttatattttgaaaatgttttttgatttatattccacccatatagtgtttgaaatacaacctacgatacatgcccgcgcgaatgcacgggctaccttccttgttgtccaaaatgtttgaaaaatgatttggatatttgatgtactatttatgcctaaaacggcatgaatttgtgagatgaaggtgcatatgtatttataagtatgaatctgggttggattccacctagcttttggagtggttttgtccgtgcattgtggtttgatattagtactccgtactccctcattcccaaaataagcgcagccctgagttttcgtgtccaactttaatcatccgtcttatttattttttttagaaaatctaaaataatataagtcatgcataaagtaatattcatgttttacaatctaataaaaaaatactaatcataaaaaagtttcaaataagacagatgatctaagttgaagacgaaaacttatggctacgcttatttttggatggagggagttctatattaaaccgaccatcgatgcgcgccattgcgacaaatctaacagtaggaaatcaaaagaattggcacactatggaccttatcctttttggaccacaatttgaaagtgaaacatttttgtctggatttcattcacgcctcaatctcaccatacagtggggtttgcatccttagaatagcaacagagcaagaacccctagggtaacatacatgtaaaagaaagcctactagagatctgagctgtcagcattgtaaactatggtcaaattaatatgtccatgctaaattcccccaaggtcaatatgaatgtcttggcacc

SEQ ID NO: 41382 - DNA, 1501 bp, Oryza sativa
gtgttggtgacttcactggaatgtctagtactcaccaaggccgagcgcgattgtgttcatcggatagtccgatgtccactggaaccgcacgccaatgagaaaaacgagccaatgagattgactcggtttcgacataatttgattacgccgttaaggttttcacatggagaatcgtagatcagatctatgctccccccctcgaccctctgcccgctaaccggctagcgggaccgctgtgtgcattgccccttagatttcgcttggggttttatatctgtcttactttattgttgttatatattttatatgacatggtaggatagattccctcagaaaaattaagtgtaatttatgctcttccaataattgcatctattacggttgtgataataagtgatgggtttgccatagcaaactgtcactttttatcatgataaaataggatagatgttgcacatctatatgcagagattattggtttacttgacaaggttatcaaaacagttttggaccttggggcataggttgggttggacatggagatgtcaccccaatagcacaagagtcacatataatgtgattagcaaggtgttgcttacctattttgatagttgtctagctgtgatgccaaagctcactagacactaacaaaatgaggatcttgactcactatgttactagagggaattttgtttcacaatacatagtgggagtatcttttgttaaattgtttaatgaaaggttaaatgtaaacatggtgcggattttgcatacatatatttctattgtagatcatggcagctcctgcaccatccagttttaacttgcggtctattcttgagaaagagaagttgactggaacaaacttcatagattggtatcgcaacctgagaattgttctcaggcaagagcacaaagagtttgtgcttacacagccttttcgagctgacttgcccaacaatgctcctgctgctcaacatagggagcatgaaaagcgatgcaatgattatcttgatataagctgtctcatgcttgctactatgtcccttgagcttcaaaggcaatatgaggcattggatgttcatacgataattacgggactatgtaacatgcttgaggaccaagcaagagctgagaggtttaataccttaaagtccttttttgcgtgcaggcttgcagaaggtaatccagtgagcccacatgtgatcaaactgattggttacaccgagagtctggataagcttggttttccccttagccgagagttggctactgatttgattctccagtcgctccctcccagctttgagctgttcacaatgaatttcaacatgaacaacctgaacaggaccttggcagaattgcatgggatgctaaagactgccgaggaaagcattaagaaaaactccaaccatgtgatggttatgcataagcgcaagcccaactacaagaagagtggtcaaaagagaaagctaaactctgatgagatattgttgttaga

SEQ ID NO: 41383 - DNA, 628 bp, Oryza sativa
tttttttttaatatttacagaaatattatagcgccgaaaaaatttgcaaaactagaccctgccgcccttcgcaagggcggcaagccgacgtggcacacggcgcgctggacggcgcgggacggccgtcctcctgccccctcctgccctcttgccgccctggcaaagggcggcaggacccccttgccgcccttacagaaggcggcaggcctggccgcctataaagcccagccggctcctttgaggagcccattccctcctaacctctccacatcaaaaaaaaaaaaaaaggagaaggggaggagaagaaaagaagaggcgaagccctgccagtttcaaacttcgatttcaggtaatattcgtagattatatacgtgactaaatatatgataaatgcattgtatgaaatagagttttacctgtggtactatataaatatatattgttagatgtagccatgtaggtaacttagtagatctgtagtatttgtagttattaggtttgtagttttaaatgttgttgagtaacattgcaatagaatatataaaaatttaggtacgttgcaaagaagatattacactgtagtcgtttattatgtaaaataacggcctagtaattaactttgcagata

SEQ ID NO: 41384 - DNA, 1205 bp, Oryza sativa
cggttttaatagttgggggggtcaagatatctagtatcgtggtttaaggatatgaatcagattcaagtactacctaatggagtcgaagtgaacttattcctgcccaaaaccaatctcaatcctcattttttcgggggttttggtagacagtggcatagtgccagcatctccaagagaagattaaaaattagttcccaaaaatcttggactaaaaccgtcccaaaaattattatgctaataaaaagttgagaatttcttatataccactgaaaattagttggttcccttgtatgccactcaaaattggctcttccctttatgccactagatcttcactatttatcatactattgaatatatgaatgtttgcagtcacatgattttgaaccaaaggttattttggtcatttatgcaagaaaaaaaaagacatgtgacttgaccctagtcagtcaacacgcagtcaacagtcgagagtgagagggtgcacaaatttaagccaatcgcatatagaggaagagccaattttaagtggcatataagataacagaccgattttcagtgatatataatttcagtgatatataaaaaataaaaatcctaatattatatgattgttggccacgtaggcatgtgggcctagttcagttgatcgatctttttttcttgccgtggatacgttgccgctacagtacctcgacgcctcgccgatcgctgctgcctctgattttcttttttgccgctatagttcatcgacgtcttgttgcacatgtggagaaacggaaggtcgagacgatccccagccatacgacctcctacctatggcgctgctacgatgcagtagtgcttgataacctggaagatttagaaaaaaaaaatacaacatcttgacagtagtgtattatgtaagggtttacagataattcataccattttatacttcacagtacaaatcatgaacaaaacaatatttctctgcattcagaatacatatcgaacatactcctttcattccacaatgtaagtcattctagcattttccacatttatatcgatgttaatgaatctagacatatatatatatatatatatatatatatatatatatatatatatatatctagattcattaacattaatgtgaatgtggaaaattctagaatgacttacattatgaaacggaggaaatagattttctagggtttcca

SEQ ID NO: 41385 - DNA, 292 bp, Oryza sativa
tgtgtgtgtgtgaatgacatgtcgatcccacaatttttttttactctaatgccacataagcaacacgtgggacgaagactgggtcaacaccgccatgtagacgccacgtcagacaaaacctcttctaaaaccatccagggatatagtttgcatcggttttgatagttggagaagttgatatacacgatttagtggttagaggtcatgaatcatactcaggttatagttgagagagcgaaagtataccttttcccacgctttaatcatgcgatttgggctgcctgatccatga

SEQ ID NO: 41386 - DNA, 1501 bp, Oryza sativa
ctgtagagtatcttcgaagtcagagaaggagagtaactaaaccaaaagttttgtacttttgactgcacttacgataggcacgttgtactatagcatgcaggccctaaacaaaacagagcagtagttggattacattgttaacattgctttgcttgtacgctgtttactgtattattaagacttggggcaattctaggatcacaaatttcagagaagatggaaccaatactgtcatgcatagcaggacaccggtaaattaatgtactgcaaatagcaactcatcagccatttcaactatctccgtacttagatagcaaccaaattatcaaattactagtacatagtaatggtaactatatttggaaacagagacagtaacttttagtgacaatcatggtgatcacctaacccatgacaatgagatcatccctgcatgccaaagaatgcagaagcactagtttacataggcattgatcaaattttgggagtatatggtttcaggactgtgcaactagattcatagtccatgatgtccacaccgcgcagcaatgtcaagaaaagcatagcgtcaactcgacacaagtgccttttgcttgtagtagtagcatactatacaccttgcttttggggctcagcactcatgatgtagcatccgatggtgagggtggatttaaagaagaagggttggggaaagcaaaggtcttcatgctactaagccataaaagcgtgcaagacccatgcaaaggtgtgtgtggtcacgccatggaagcaaaggggggttaaactgaaaatgttttttgcagggaccaaagtgcatttataagggtgccaagacattcatattgaccttgggggaatttagcatggacatattaatttgaccatagtttacaatgctgacagctcagatctctagtaggctttcttttacatgtatgttaccctaggggttcttgctctgttgctattctaaggatgcaaaccccactgtatggtgagattgaggcgtgaatgaaatccagacaaaaatgtttcactttcaaattgtggtccaaaaaggataaggtccatagtgtgccaattcttttgatttcctactgttagatttgtcgcaatggcgcgcatcgatggtcggtttaatatagaactccctccatccaaaaataagcgtagccataagttttcgtcttcaacttagatcatctgtcttatttgaaacttttttatgattagtatttttttattagattgtaaaacatgaatattactttatgcatgacttatattattttagattttctaaaaaaaataaataagacggatgattaaagttggacacgaaaactcagggctgcgcttattttgggaatgagggagtacggagtactaatatcaaaccacaatgcacggacaaaaccactccaaaagctaggtggaatccaacccagattcatacttataaatacatatgcaccttcatctcacaaattcatgccgtttt

SEQ ID NO: 41387 - DNA, 1501 bp, Oryza sativa
agaggtactatctattaagcgattggtcgcactgcacgtggtcggattctaattttcagcttttagttcggttcaggttgtcgggtcttttctctttccttttgggactgatgttttgtgggctcacggtttgtatttttgtcccgtgtggataacgcttgatggggctaggtttcctcttctttttgcctaggaataagttcaatgtgggtcccacaatttatcgtccagtttggaatttatccatgaaccgaagcacatcgtcaaacttaaaataccggattaatcgaggtcccaagcagtattaggtccggtttaaactgatgtggccagctgagtcaaacgtgggacccacgcggggcccacgtgtcagcgaaccatttttactttcttctctccccaactcttcagggcgacgtgtagcgggttggaggcgtggagaggggcgtcggccgccggcaggacgctgcgccgtgggatggcagtcggaccagagtcgcgcggctgtcttgcggcgacctggagtcgttgacggcggagcacctgtacgtgcgtagcgacgtagcaggtccgggaagcgggagctcgtcttggaggatgtggagcttgccaaggtagttgagatggagaccgtgttcgctttagtttgagcgtggatttgtgatttcttttttttttctcttcatgatttgctcgctgtagatgagcatggtgctctgatttgctcgctgcagtacgagtaggaactctgattttctgatttgatattttcatttgctcaatattgatattgaaggatttagtctaaaaaaattaaaatgtccagtgaagaaagagcatgatttatgatttacttacagattgcaatcctatccaatcttctgcacatgttatgcttgtcgacacaccgtatggcgaggtcctcgactttgttggagaggatgagagagcacaggtactcaacacgctcgcgcatgacgtggatgatggcgaggagctcgagacgcctgagctgacgaacgccgtcagcatctccagccctagatagggagctgctgtggagagcttcaacaagctacgccgtggaggaagaggaaggcggaggagctcgaggaaggaggagggaaggtcggcgatgaagaagatggtttttttcctcttctgccagccaccggttgcatcaagggagagagaggagaagggaaggaggccggcaaccacccctctccgccggcggccatttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttataaccttgccccccaacctatataaggagggcagggagcccctctaggggca

SEQ ID NO: 41388 - DNA, 1501 bp, Oryza sativa
agagaaaatataatgatgctagccgagcaatctgcgcgggtcaccatgctagttgctggtaaaactgcagcagatcaacagcctggagttgaccaagtaagtactgacattggacatttaagttacaaaatgaagcaatgtctgcctgtcttctgattgtgtctgtgtacctggagtatgctatcattatctgatacctgaaaactgtacgtgcagatctccctgagacgtctctcccacacatcgctcatgccatttgaggtgcattggatgggatcccactagccctagctgaaaacagtggtttgcccccttttgatacgtcgactgcagtaaatcctcagcaagtgaagttttttttttttttggtaatccttaaactttattctgttgctttagttatagacttatagttgacattaattgactacatttagtctgattaggtcgccccactcctagtatgttttgggctcataaaaaatgcttcatatgccatcaactcaaccagcacatacgcctactatctgttagttaatctggtggatgcaagaaaatatatagaatgctatataatagagaaccctctagttataggatgatatgctaaggaacctatgttctttctattatatagcatcctcgcacatcagttattttgaagcattgtgtaatattgtgggtaacttcccagcctcctgaactacctttgcaagatagcaatcctcatcatggtattgactgcaattgcattcgaacaaacggcatcagagaacaaaacaagcagcagcagatcgtgctgacaactcaggtggtgaaaatgattctcaagattgatgacattatcacacagtctgactgctgaatgctgatgacaacctgcccagctggtgaatccattatttcttccttgcctctttttctcaacataaaatatgaaaaggaaaaagaaagaactggtctcttgttttgtcttgctaccatctgccaaacctttgtttcaggcaagcctgtgcatcgcatgaaaacataacaagtcacatctgaattagtgtaactttttttatggagaaggaccttttgctgtattcttttcatatgatcgatgctagtgggctgcttagtatcatacttttactggtgagctgaagttaggaacacgtttgctctgttttgattgtttgtaatattttctcttctcttagcgaggaagaaagggttatcataatgaggaaggtttggttatctggtgaacatggaaagtgatgtttaaagaaattataattttatactatacagttgtttatgttttacctgtatattaagaactcacatcacatacattgcatgtacaggggtgatgcaacatggtaagaaaagcaaggcaatttttcctggctctaattaatcagcatttggtgtgcttgagctttcgaccggacagcatgctctcgatggaagccttccagaccttgcagtgcatctggttgtccagcagcag

SEQ ID NO: 41389 - DNA, 1501 bp, Oryza sativa
tcatctccaaaattataaatctgtgccacacacaccgcttccattcaagcgtacatgcaacgatttttttctatacagagggcatcaggctaaaaaagacaaatgtcgaggacaatcccaaaataattaaacaaacaatagaataatatatcaataagtggattcacattttgcttcaaaaggactgaaggttaaaggtagtgctggttattgtgcacgtgcaatacacatcacagtcagatgcgtgccgtgggagtaggagggagcttatcagtagataatagaggaatatagtccctccgttccaaaataaatcaacttatagaattcaaactttgtcctaaaataaatcaacttctatcttcttattcactgttgattcgcaaatcaaaaaaatttattccttcaataccccttgcctacatatctaccaatactagctattaatatatgcaggtagttttcagggcaacacattgactccggtcttgggcacaactacaaaagtatgaggaagatagtgagcttttaaaggctgcatgccgtattcttgagacaacagttatgcaactttttgtcaaacataattcaataattgtgtactctttatcttgggttggcagtctttagcttgtttcttcttgatggttggtttcatcctttaagtttctttgaacttcactcattttgagtgtgagattgtaataattggctgtagctctttgagtaaaggccgggatgctctattccattatctaaaaaaaagctattaataattgtattttggtcctttatcctcttcattaatttcgcattgggaagctaggagttatctctttatggcacagagggagtatgcactattagataaaagtacaaatgtgtgccggtgcccataattgccaattacattgtctccgccacaaaagtgaagcagcaatgatagttagtacattcatatataccaccggtatatataacggtttatctatggcgtcggttctaaatttttcacccagcggttttatgtgagcacttttgtagagacattttgcaaattacttttaagatcagaagttttatagtgtagagatattttatagaggcattttaaaaattgcctacaaacttttactctagagacgttttctgctctacttattagattttatcttgtagaggcattctttcggcactgtaaaatagcctgatatgtaaaggcattttcttgagacactttaaactatgtacagacacttgttacaatgataatgtgtactaaaggactatatataattaactaaaggcacaaacatacaagtaatgacatggagttgagttagttagtgcattgaagataaaaatgatttgtccaagtgatctcaagtttaagacttgttaaaagcaaagaaactattttattctcctttttggactggtttcatatatttgtgatataatttaatgtctctagaaaatgcctctaccatattatagatat

SEQ ID NO: 41390 - DNA, 211 bp, Oryza sativa
ttaaattatccaccattcaatggtaaaagatcttcttatgttgtctatttcttttggtcaacttgtacaaagtgaagatgcgtcaggaacaaatgaagccacaagagttcgcttcttgtaggaagaaagtgatacgaaaaggaaagggaactgcaagcaatagcattgcaattataaattatatatttggattatttagtttatccccaaa

SEQ ID NO: 41391 - DNA, 1501 bp, Oryza sativa
agttggtaactgcaaccgagactaaagatcgtaactttagtcccggttggtgatcccggcgatctttagctccggttcataacaccaaccgggactaaagtcccacccctatatatatatcttcttcctcctccagcccgagcaagcttcaaaatttcttcaaaaaggaggggaggtcatgccaaaatttatagtgaatttttttttgtgattatatacaaatcggaggtgcctaaaaggttagcaacttcatcctccaatgtttttttgtcgtatgacatttggagctatgttttgcacacttttttgtctccaaaattttgttgttagttgatgagagagaaaattagtgtggggaagaaaaaatatatagaaatttagtttatttgctaaagaaggttttataaaatagttgagaaggaaaatatagtgaaagttaatcttgaataatagaaaacaaactaaaatgaaaaattaaaataattacaacacattaatattagtttaaaactttataaatagtaaataagaattatttggtgtaatatttcataatttttgtatgaataatgatatgtcattattgtgtgactgttgaaagagtatgtaattattttataattattgtatgactgtcattattgtacaaataattatttatgtacgattttttttcatgtcatgtagatggatcggcaatggatgtacgctgaccggcggtccaaagagtttattgacggcgtgcattattttttgagagtggccaaagctaacaggcaaaacggttttatttgttgtccatgcaataagtgtaagaattagaaggagtattctgcatccaggactattcatttccacttgtttgagtcgaggttcatgtcaagctataattgttggacatcccacggagagcaaggggttgaaatggaagaagatgaagtggaagacgacaatattccggactttgctcagtacgctggatttgaaggaaatcaaacgggcgaggcggaaagggatgctgatggtaacgacgttgcggatgatcttggtcagatgttgcaggacgccaaggaggactgcgaaagtgaaaagggggcccataaattagacaagatgttagaagaccacagaacatcgttgtacccaggttgcgagcaggggcacaaaaagttggataccactctggagttcttgcaatggaaggcaaaaaatggtgttagtgacaaggcatttggcgatttattgaaactcgtcaagaacattcttccggagggaaacaaattgcccgagacaacgtatgaggctaagaagatagtctgccctctaggactggaagttcaaaagattcacgcatgtccgaatgattgtatcctatatcgcggtgactagtacgagaacctagaagcatgccctgtttgcaaagcactacgatacaagattagacgagatgatccaggagaagttgacgggcagctaacgaagaagtgaattcctgctaagg

SEQ ID NO: 41392 - DNA, 1501 bp, Oryza sativa
attgtcggaagttcttccccgtggcgctgagcacggcagcagggacggtgcagctgctgctggacaaccagatgcactgcaaggtctggaaggcttccatcgagagcatgctgtccggtcgaaagctcaagcacaccaaatgctgattaattagagccaggaaaaattgccttgcttttcttaccatgttgcatcacccctgtacatgcaatgtatgtgatgtgagttcttaatatacaggtaaaacataaacaactgtatagtataaaattataatttctttaaacatcactttccatgttcaccagataaccaaaccttcctcattatgataaccctttcttcctcgctaagagaagagaaaatattacaaacaatcaaaacagagcaaacgtgttcctaacttcagctcaccagtaaaagtatgatactaagcagcccactagcatcgatcatatgaaaagaatacagcaaaaggtccttctccataaaaaaagttacactaattcagatgtgacttgttatgttttcatgcgatgcacaggcttgcctgaaacaaaggtttggcagatggtagcaagacaaaacaagagaccagttctttctttttccttttcatattttatgttgagaaaaagaggcaaggaagaaataatggattcaccagctgggcaggttgtcatcagcattcagcagtcagactgtgtgataatgtcatcaatcttgagaatcattttcaccacctgagttgtcagcacgatctgctgctgcttgttttgttctctgatgccgtttgttcgaatgcaattgcagtcaataccatgatgaggattgctatcttgcaaaggtagttcaggaggctgggaagttacccacaatattacacaatgcttcaaaataactgatgtgcgaggatgctatataatagaaagaacataggttccttagcatatcatcctataactagagggttctctattatatagcattctatatattttcttgcatccaccagattaactaacagatagtaggcgtatgtgctggttgagttgatggcatatgaagcattttttatgagcccaaaacatactaggagtggggcgacctaatcagactaaatgtagtcaattaatgtcaactataagtctataactaaagcaacagaataaagtttaaggattaccaaaaaaaaaaaaaacttcacttgctgaggatttactgcagtcgacgtatcaaaagggggcaaaccactgttttcagctagggctagtgggatcccatccaatgcacctcaaatggcatgagcgatgtgtgggagagacgtctcagggagatctgcacgtacagttttcaggtatcagataatgatagcatactccaggtacacagacacaatcagaagacaggcagacattgcttcattttgtaacttaaatgtccaatgtcagtacttacttggtcaactccaggctgttgatctgctgcagttttaccagca

SEQ ID NO: 41393 - DNA, 1501 bp, Oryza sativa; identical to SEQ ID NO: 22588

SEQ ID NO: 41394 - DNA, 1501 bp, Oryza sativa
caagaaatattgctggaaaagtcataaaccaagaaccaaaaaaaatgggatttttctctacttactcagcagcagagggaggccgaccttccactgatccccagtttggggagccatctgaagctgtcaattccgatgttgcttcatcaccctttggttttgaagatgtaaactgacctctattgcgctgcatcctacacatacatagaaaatattttaaactatgaagatttcctgtacataatctaagcagaggtaatttagaaaacatgaataacagcaaaatataaatcctactatctgccacggtaatatcaaaactgaaagtaaccacaagaaagacactgatacttaaaaaggtactacctccgtttcatattataagtcgctttgacactgatactttgatctttaagtttgactaagtttatataaaaatatagcaatattttcaacacaaaacaaacttattatcaaaatattgtaaatgttagttctaacaaaactaatttggtgttgtacatgttgctaaatttgtctataaacttggttaaacttgaagaagtttgactacgaaaaaagtcagaacgacttacaatatgaaacagagggagaatagcttaataaaagcagccagacaactcaaaactaaaacacgcttttggtacaaatacaatgtataagttgccaagtttagattatattattcagttcacttccactatattaagtacattgttagcagagtgtattactcacagatcaaatacagcacgcttgactcttcctaattcaggtcaatcagcattcaaataggaacaaaattctatagcatttcagtacgtataaacatccacagccaatgctaagctagcaccaacctaagtgcaacttccttccgaacagaataccggatcttcttatcaaagttgcgctccttccgcttttctctgaaccgcatcaaagatgccacccggtgtggaaaattcaacctctgaaaccaagggaaaaaaaatacacaatgaactccagagtgcacaatcctgtcaaacataatgaactgatactacaaagaaagacagttcaccatcacccgtgccaaccttactgtatggcgcagatgacgatgctccagagcccaaacctgggttcagctcccttccaccgagtagcaagagcactgcttgaacctgcgagaagtaatcgaacactcagcctttttttttttgcaacatcaatcccagtctataccgaaacacacatgacaaacaaacaaggccaagcgcatgagaggcaaacgaccttgtcaggggagacagagtcgaagacgtagacctcgccctggaacgagagggtgagttggttggacgccatgggctggacagcgccggaggcggcgagcatcccgccgtgcgggtccagctgcgcggcggcctccgcgtccatcgggacagccacctcgccgcccaccccctcatgatgttgcgcgtcctcatcctcc

SEQ ID NO: 41395 - DNA, 1501 bp, Oryza sativa
gggctggacagcgccggaggcggcgagcatcccgccgtgcgggtccagctgcgcggcggcctccgcgtccatcgggacagccacctcgccgcccaccccctcatgatgttgcgcgtcctcatcctcctccatctcctcctcctcctcctccaactcatcctcctcctcctcatactcctcctccgcccccagggcgcggtgctcctcctcgaagcgggccatcgcctcggcctcggcggccaccgcggcgaggtggtcgaccgtgggcgcgacgtgcgccgccgcatcgtccgccggggccggaggaggggggcgctcggggccccggcgtggctggtagggcttgctgccgtcgtggtgggacatggcggaggttgggggtttgggtgggatcggatcggacgatggggatgcggggtgggtagaggtggccaaacgggcggcccggcccggcacggcacgggcacgggtccggcacggcccgtttcggcacggcccgttaggcatggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgctgtgccggcacggcccgttactgtagcaggccgtgccgggccgtgccggctacaggttccgccgtgcctcgggccgcccgttttggcccggcccgtttggccacctctaggggtgggagagaaccctagcccctaggatttcgatctcctgctttccggtttggagggtggaaatggacacgaggagggagacgggtgacggcctgacgggtgaggggagagcgtaggactataggagggtgatgtggcagcatcacagccgtctgatctgctaccccctgtatatctatccctctgttttcaatctccttacactttcagaccaaaagcgaattatgatattgcttctcgtaaatcgttataaatatactaacgttttaagcttgtggtatgaagtagggtttaacttttcaatttcgaagtaaaaatcgattctcaccggtgtaccgaaatccaaccaaaatttggtaaaaaccgacgactttcggttagcgtcatacgaaaaccggctaatatcacccggttttcagcaatcttaaaaatttacaggattaagagtaaattgataaatataactgaca

SEQ ID NO: 41396 - DNA, 1501 bp, Oryza sativa
cgaccaataaataggtggcttgctgggccgatgggccgacggtacgcatcttggaccaggagtacccaaggagcaaccgagacttcccaaattgagtaggcttcaccttggaccgtaaacagtttaaggctatgtttaagagagagcttatactttctatatactattggtacccactaacttctaaaacttaatacgcaagtatgccacatcatcacccactagtaattattatatagagtatcttaaatctcatacaaatatgatatattatttataattttactgttcttttagaactcaacatgtaagcactatcaaataaccatctccacatcatttttacattatttaaacatatacatctatcatttatataatatatcacataaattcattcacatatcccacaacagagcgcggggtatcaactactttctatagaaatctccaaccctttgtccagacttttatatagattttgagaaattatacttatgtaattaaaaactaaattagaatccagaaactataaaattatatttcatattctcgcccgttagcttttcaccacttagaattagaattctaagctcagttaaacagggaataaccgtataaagattttggtttcggtggtaaagattagccattgagtatttagctggtgagaattcgaagaacctagtttctgcatacttagtagtttatttatggattctattgttactaagtctcaaaatctaaagcgataatttagattgttccaaaggacttggacattttaagaattttaagagacattgatttctcaaaaaaaaaacaaagcaatacaaaataacttatgagtaaaaatatagaaatatactatattgtgcatttaagagaaagggaaataagaagattgaaaacatacataaaacaagatgagtcattagcacataattaattaattattaattattttaaattttaaaaacaaattaaaataattttctaaaacaacttttctatagaatatttgtaaaaaaatacaccatcaagccattcgggatcgtgcatgcaaaaaaacgagagatttcttctccatatcctctccaaacgaacactcgcatgaatgaaaacccccaaacatactctaaatttaaggttaaaaaataaattttagctaaggctgatatattaacaggtagacgatgagatgcatgtatccattttagttatctctatatttttttgaaaaagcttgaaataaaatagacaacatacgattttgcatattttaattatctttgaaaagtgacacataataatggttagtagccttaggttggattggagagacatgagaaaacaagaacatcgaacagagccaaaccaaatttccatctctaaaaaaaaaaaactcgaatttaaaaatcaaatttgacaacatcataaattcataaaccaaatttgacaacattgccacgctagcaggtgactcgcctcctctctccga

SEQ ID NO: 41397 - DNA, 219 bp, Oryza sativa
taggaaagaaaaaaaggtagattttcctttctctaattttatcggcactaataaaccgataaatcaacctaacatgtcaacgccacgtctcttctcaactgaggctggcggcgttctcaccacatcacatcattatattaggtaattgagggaaaatgaaatagatacattagttttctattcatgacccatacagtagcagaaaccattagaaggata

SEQ ID NO: 41398 - DNA, 414 bp, Oryza sativa
cttatacatatatattgtattagaactaaatgttgatcggggttatccttaaatggggggccatcatatagttcccaaaccaacatctccatgttttgacacgagtaaaatgtagacaaacacactgttgtatatgtcttaatttcgccgcatggagaactttctgaagcactattgatatctgcttgagtgcacattatagtgtaggaccctttgtgtctcctatatataaatatatatatagtgctcgatcatgcgtgcaagaaatatatattgtaatgtaagtggggccccggagttatgtttgttaaccatacaaatgtacttctttggtggttggttctagtgaaaaagatacaatttcccattgaaaagggttcatctataaaacaagagaatgtataatacaatatt

SEQ ID NO: 41399 - DNA, 1501 bp, Oryza sativa
tcccggttcaagaagttgtcggacgagttaagccccaattatctttaatcccgattggtatgaacaaccggggctaaaaatggttctttagtcccgattgtttataccaaccgggaccaaaattcaccccgagccgcgcgcctcatcatctcaatagtcaatcttatccccttgcccttcctctctctcccctcttattaaattaacataatcctgatcttagcctccattccctcttctctccccttcctccccattccactctctttcccctccccgccttcttcttcttctaccactccaggcggccaagcctgggccgggcctgtagcggctgcggctagcgtggtgtgccgggcggagggcggcaggcggcgaccttgccgtgtggagggcggcagggatcgcgtcaacgggcggatgggagatatgattggggatatgtagggagcaactctatttgggaaggaccaactcgatttgggaaagaaaaaagaaacaatgatgaaaaaagaaaaaaaaatggtgactaaccgggattggcgctggcactaaagatggatttttaatcccgtttcatttcacccgggactaaagatgaaagatacccatctttagtcccggattcgtacttctggttacaaaaccataattatagggagttataaaccgggagcaaaaatgctttctccgtagtggcagatcgacttgtgtctgataccaaactaccacgaagtcgtgacagccaccagcgacacgcataatgttctatcagtgaggattgagaagctgttggaatcggggatcgagagttcagaggaagaagacgagataggtggggatttctgttttttattttgtcatttgatgcccaacaagcagggacggtacatatgcgtatcttatatagagcttacaaatcccttgccgccctctgttggggcgggcggtgacggagggagggtttttttcagtaaagcccttgccgccctctgttggggcggcaaggggcccgaatacaaaaaagccagttggggccggccattttgcaggcggccccttgccgccctctggccgggcggcaggcctcgctgcctataaaaggcctgcctataaaaggcctgtcgcccagcccccagccctcattcctccccctcaaatccagtgaaaaaaaaaagaagaaaggggaggagaagagaagaaggggcgaagccctgtcggattcagacgccgatttcaggtaatattcatagatcctatatgtgactattgagttaaatagtgtgtattttttaaaactttgtttgaataaatgcattatatttttagggttttagttgtactaatctagaagtgcgtattttagatatcggtaactacgtagatctactagtttggaatcaatactttaccgttgcattggcatacacaagaagatattacgttgtagatgtttattgcatgaaagattaatatgatctagttatttcgttgatagata

SEQ ID NO: 41400 - DNA, 272 bp, Oryza sativa
cccaagacgaaaagtctaatttgcctccctcaacagtgtagatcttctacctctagcagccgaactgagaccgatttggctcggtttttctcctccaaatctgacctttccccttgtgtttttctaaaatagttgaggggaaatattcctcttatcctcctctatctttacccccaaaaatcggagctaatcgttgagtatcttatccgaatcgaactcgttttcgagtttatctccaaaaccgagttttgattttccggatcgatttcttg

SEQ ID NO: 41401 - DNA, 1501 bp, Oryza sativa
agtagtatttctatacatctaaagtttatacacctataaattatagatctaaagtttataagtcaaaagtttacatacccgattcaaatttgaatttgaattcaattttttaatatatagtatttctatacataatttttctaacttttgtttttttaaaaaaaattgtggtgtaccgtagtaggaagagaagaaggagagaaggaagggggagaggagggaggagtatagggggaaggcacagcgcggggcgatcacctgcgcattagcatttcccaacaatcagggagacaaaatagatttattccagccatgtagacatggcccaaagaaatgagggactcaaaataaattattccaacaatataagacacggtctaaagagataagaaaagcaaaataaacttattccaagacgaacacgatgggccagtcgtgcttttgggccggtacggcacaacccacgccttattggactgtgcctaagccacaggtacatcctgtggcctagcctggcacgacacaaagagtatgccaagctgccagcccgacataccttaggccgtgccgacccgatatgccttaagctgtgctctagtcgtgtccgagccgtgccatgtcagcagctcatttagccatctatataactagccaagccaagccaagctagctcattattttaacgagccatactgagctaagctagctcgacatccatctctatcaatggtcaagtgcaagatctctcggtgtcagcaaggggaaaggctcatgcgcgcgggtggggccgaaaactgcgtggggagtgagtggagactgattgagagtgacggattgtaaaaaaaaaagaagagagggacccaccacggctgagaaaaaaagtactcccttcgtctaacgttttgactttttatttgcacgtttaaccattcattttatttgaaaaattagtgtaaataaaaaaaagataagtcatatgtaaagtacttttgataataaagcaattgacaaacaaaataaataataatttcaaaattttttgaataagatgaatgatcaaacattaacaaacaaaaacttaaaaagacaagtaatatgggacggaggtagtatgacgattggaaaattcggtatcttttaagttgggatagatgtaacagtgatgtcggtcaagccttcacgatggacctatggaatcgaagtagcaacgacatttctgaagtttggcgccacgcaataatatcttgcttgaaatttgtttactgtccatttctgatcaatttttccatgccagcgcgcaccactggagaagaaggggacccgctagcaagtgccaaattggagccggaaaaagagtgcccattgacccctggtaaacgatagagaagtgagctgcagccgctataaattctgaacccaatatccggtagagaagcagcaacacagcgagagagtgcaataatttcttcagacctaccgacagaaaaaaaaaagagaaaga

SEQ ID NO: 41402 - DNA, 1501 bp, Oryza sativa
tatttatctttaaatagtagataataatatttaaaaaccatcgatctttttaatgatacacatttttttattgtttttattgtaagggattttgaaaatactattttgaaagaccaccgtgtatagattctttttcccgatggacagtaggtaaagtttcatttctttttccaagtcggatgtatgtacgaactacttatgttttttttccttttcaagccttatagttctcccgtatacgtatacagagtaataaggtattagtttttaaaataaaatacatctaatctattattaccactattttaaaagttgagtatctattaatagatggaactgtatatgtcttacttatttccaaatccatatataaatattctaaaaataccacttctaccgattaataggatacaccattaaaattaaaccattaaagttaaacaggaatgcccatttagtgggtgaagtcagtcataatcgtcaagactttcttactctactgccttgaatgataggtctctcattgggatagttgtcctcctccagaacttggagcacaatttaatgtctaatttactatcacacccctatgtagtattgcattggtatactgggatcgccttaactcagcctatatatgtctctgttatacttaggatagcatagcaaactctgttggttatgcttggtgcccctcggggaaggagaaagaaaagataaacgtgaccaagatagtagttttttttaatttttgagtagatttgtgctatagagtagacacaatatgtttaagatattaatcattactactcatatttttatagtacagctagaatactctcattcgaaaaaaagcaaggtccatcaccagatggtacttgaaagaaaattgccaaagagagacataacaccacgataatctccagagcactatattattgttcatattttgacaaatacctatagtttagcacctggtttggtttgaacacctactattgacaacaacacatgttatacctttactaatttaaagaatgtatttattcttccaaacttatttatcaattacgtagtatatttatcaagtgatatttgacatcctaaaatatgatatgaaattatttaaaaattatcattacaataattattatatattagcccaagatgtgatgtatatagaaccgcacgataaattttataagacacaaatattttatttaattaaaggaatataatgggatcacagattggatatataactaaaaataatttaaaagataactgtctatattttatatttatattatagacctagtttatatttgcacatatttgtggagtaatatatattttatatggtaaagtattatattttaaagaccatcgattctgttccatgcacatttgttttttattacatatatttcttattggctttatcattttctacggtaggtacgtgcattttttttctttgtaataatagttatacataagc

SEQ ID NO: 41403 - DNA, 600 bp, Oryza sativa
ctttatagttgttttgctatgtgaactttcaatgatgtagtcagctttaggttgcacgcatcatattttacaaagcagtcggtatatcactcggatcatgttattcagggattcacgccgcatatgctatatattaatattaagtcacttggttgactacaattatcaaaaccactcagttggtgcatctattaggtacatctattcgatgcatctgactttatttttcagccctccacagtcttcatatttggtaaaagtattcggaagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcata

SEQ ID NO: 41404 - DNA, 1501 bp, Oryza sativa
tagttccggttcatttacagtcagatttagtcagggggccggggatctttagtctcggttggtattattatcaaccaggactaaaaatccatatacaatatataatccctaaaacttatcctccaaactcctcgtcttccctctctcagcagatcgttcttatcatctcatctcccctctctctcttatcccttacggcgttcttatcctatcttcttctgccgcagatcaaggagcgagaggctggcgcacggcggcggcgccctgcgcgtgccagagcaggttggattggcggcggaagatgcggcggctgcctctggccgtggttggtggcagtcgggctggggaggcggcggcggtaggcagcggccggcggggccgcgcgatcccggcggcgaccagcggggccagtatggaggggccggccaatggagccggtgcggaggggccggcacgcgggcgtttttccctttttttttcttttttccttgttaatctgtgaatgattgtttgttgagaagagttgtgatgattgtttgttgagaatgattgtttgttgagaatgattttttcattcgatctatgatttgaagatgagaatgttgttgtgatttgagaataaatgttcatctttagtcccggattcgtagtcaggaggttcccaagcgagactacaaagcctttctctagtagttcccatggatatatatcaaaggccaggaggatgagcgatgcatgagtgatgagtcgacattaagatccatccaaacaagagcgaaaaccaaagtaaaatttggattgggaggcaacaggattgtccgacatatgtagctcgagattttaactttgcttcggggcttgcagagaaaaaagcaatgcagtagcacggagatatccccatcacgacgaccggatggttcttctgcctctcaatgcgtgcgattcgcacgttaccgaggactgcatttcgtgtaatggagaagaccgtgcataaccagctttctcgcaaactctctgctactaacattttggatgagcagagattggaggcgcggcagctgaattgctgaaataactgcatcttctttcattctgtcaagatcacaaatatgcagggcagaatgggttattaacatgacaacgacaatgtgcatctcatcttctaaatgcctttctgatcaaccaaatatttttttctctctctttcaaacatgatctctgcgcagcatgtagttctgctcttgttactgtaacttttagcttggcagcgccctacgaacgataattttgcttcttttttagcaccagttatatatacgtcatgtaaaatgttgtagtacactccagatcatcattacattgcgttatacgcttttttagaaaatactcttctcgctggggaaaaacaaggatgtatattcagtgaaagttctttttttaaggttgcaaattgtgtgtgtgtgtatatatatatatatatatatactctctccgtatttta

SEQ ID NO: 41405 - DNA, 1501 bp, Oryza sativa
acatcagaatttgtaaaaatacgaaataattacattagaaataaataaagagaaaaataattgcattgtgatttttttggaaacatagtacaaatgcatgtgtacatgatgcgcgcatacccacttctataaacacaaatacgcacgacttatctgtatgagcacctccggggaaaactggatttgtatatcttgagattgagattgacgaatcatgggcacctcgctgtcgacgggtacgttgcctagcactgaaagaataattagccataaatacaagcactcgtatcaaatctaagatttaaactcgggtgggctgattttattattgtctttttaagttttgtattggtatatgtggcagggggtgaaaataaatttatcttgggatgagacagtacacattctctttgatatggaacatagctttttaaagtctataccgagttcccatgatcgatggtataaaaacatgtttgtttttttttaaagattacaaaacgatgtgcaattgtattcatttgatccttttgatgtacaggtctttcaaaatgtccatacatccatcaatatatggtttgtgttgacacaagcagtaatgctactgggtaactagtacacttgttactgatgcagtagaaacccttctacctcttaggaagaaggaaaaatcaacacatacatttctttgacaaaacttttataaccagctgatgtggcatgtacgtgaacaaaaatctagatttcctataactagctaaaccaaactgttgagactttttgtttgtaaaagttttcgtaagaatttctttaaagtgtagtagcactggtaataaggaagcattaagcattgacctcagttagttcgacaatcacagttcgacaatcacagtaaaccaatataataaatactccctccgtctcatactacaaatcgttttgattttttactggtttaaaaatttaacaatatttttttacacaaaatgaacatattatatgaacggttaatttgaatgaaattcatttcggattgcagatgttgttaattttttttataaatttgatcaaacttaaataagtttgaaaaaaattaaaacgacttataatataaaataattataaaatgaatggaataataacaaactcaatggcaatttccatgcaccagctaatccaagagttatatatgatcagttccttctgcatcaaaccatgcatacctggaagtataaccacacacgtttatgacgtcatcaacagcatcaaaaattaaatttcaatcatcaaatccctctcaaattctctccctcccaaccgcagctagcacgtatatataaacctgcaggaaacggcacgacgcgtctacacatatgccgcctcgccgccgccgccgccgccgccgtagcagcagcatcatcatcatcaacaacagcagcagggaggaggagcgcgcgccgccgtagctagcgcgccatgtggtcgtcgtgggcgtggacgt

SEQ ID NO: 41406 - DNA, 1329 bp, Oryza sativa
acagcttttcaacggccacccgggccaacaactttttaaacggccacccgggccaacaacttttcaaacggtcacccgggcctagctgatcccatcagctacagatttttcaaacatggaacccttttccacaacagcaatttcacaagcagtagtcaaacaaaactacgctaggaatcacctcacatccgcccatgaccgtgggcacggctgttcgaacagtttgttaccctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaattcacatgtctctcggcatcaaggctcccctgataagctagttactcagctaggggtgtcccattccacccatgtggtcgtacttgtcttatgtttagatgaaattccaaggaaacggtccttaagtgcaagagcgggaaaccgtacacccggtacgttccctggtccgcggttttggaaattcatttagttcgcaagcaccgacccaggtgtcgggttttccaagtctcttgtaaaacccaagttttacccaagttgtttttcagattttaagtttgaaggcgtccgtcgatactcgcactgggtacacgaatatcgagacgcaactagatggttgcaagggggcatggtatcacaattaacaaaggaaggatcaaatgcaacaaattaggtagatctgccaatctgccttgcagacgggacaacagattaagtgcggtcctatcaatgcataatattttttaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaggatttaattaaatcttttttttggaaaagaaaagaaaagaaaagaaaagaaaggagggagggaaaatagacttttctcgggcggctagggcgtggcccgagaga

SEQ ID NO: 41407 - DNA, 1445 bp, Oryza sativa
ggggtctcccaggctggccggcgacagatctggccccgccgtcaccggacctacgacggcgacgtcgggaggcacgatgtggaggcgattaggcggcggaggttgttgcggcgcggggcagcgtggtggtggcggcccgcggggtggccggcggtggctggcgctcgcggcaggtcggcgtccggggcggcgcattggcctgcctacagctgcgccggctgtctccgtcagtcggtgggattgggtcctgccggggggtcgcgtcggcgactccgaccgctccagtcgctggcagccaccatgttatctccttccttccctactctttcttcctctttcaaccgtctcggcacaagcagtagggggtggccgccccccattttcttccttcttacagttgctatgttgctcaccccggtgctcctctctctgcgctggtggtgaagttggaggtggttgccacagttgttttggattgtcccacgaagcccgaagatcctcgctggaaacatggatgacaccgatgtctttgttgcccttgctgccagttctcagtttcaccttcagaccggccaggcctcctcccctccttgatgctcctcccttctcttggtcgcctgctcccagaccggccgtggagtcttttggtggttgagtttttttcgtccgtgttggtggtctagtctgttggtagtaagggcgcttgggcctcgccgatgcttcacgtgccctgtggctatgtaaacctgtagttgtgccgagtgtggagcgatgtgcttaccccctacggtgttagagtttttgtgttaaagtggagttggagctgtcatcgggttcagccgatgagctaggcaacgataacactcaacactcttgctctagcttcttagaggtcctgtacttcttgagggagtcttgggcgacagccctgcctggtcttctaggatcggtgacatcgatgcctatgggtgtcgtttcctcattggaggtgttgccttgtggactctctccacttcgggtgaaaacccagtccagttttgggcgggcgttggcagcggcttctgtcattgttcacctccttggaggctacgccttgaaggccttgctcttctctggatcacttctgtgggtctagtcgttttgtcacaggttttttgtgtcttttgtgtaaggttttgccagtttccctttagcaaactgtgcagctgtacggttttcgggccctattttccttataaacagggtcaattctcttctaatatatccggtagatctcctaccgtcttatgtttcaaaaaaaatatatatgcaaatgcatatgtatatgtacaaaatacacatatatgtattagacacgtataatttaaagcacttaacattttatgtgtgtcagggttacggataaggtataccctctatccttggatatacgtcatgtactggta

SEQ ID NO: 41408 - DNA, 376 bp, Oryza sativa
tccaaaatttcattttttgttggagaacggaacgcagccactcaccaaacccaaggaagcatagcttttggtcgtcgagatttgccagcaacactcgtgtccggtttgaaaaagctagctggatgctagtttttgatttttttttttttgccgttctgttacaaacacaattgatcatctcttgtgcctgcaagggctgtttctgtatcttagattacacatgttgtgttactcctgctcagttccaacttcctttacttccccctttccagctccgagcacgctttcccggtgaaatctcgtggctgtggcgagcagatttatgaacctgtctatttgttataattgtgcagccactgtactgcacatttttagt

SEQ ID NO: 41409 - DNA, 1501 bp, Oryza sativa
accccctgcgccgcgaagtgccgctccacccgccgcggccgccaccacagcgcctccgccgccctcgccgccgccgcgtacaccgccacccacgccgccgccgccgccacggccacggccgccgcgccgctccagctccacgtccacgcccacgacgaccacatggcgcgctagctacggcggcgcgcgctcctcctccctgctgctgttgttgatgatgatgatgctgctgctacggcggcggcggcggcggcggcgaggcggcatatgtgtagacgcgtcgtgccgtttcctgcaggtttatatatacgtgctagctgcggttgggagggagagaatttgagagggatttgatgattgaaatttaatttttgatgctgttgatgacgtcataaacgtgtgtggttatacttccaggtatgcatggtttgatgcagaaggaactgatcatatataactcttggattagctggtgcatggaaattgccattgagtttgttattattccattcattttataattattttatattataagtcgttttaatttttttcaaacttatttaagtttgatcaaatttataaaaaaaattaacaacatctgcaatccgaaatgaatttcattcaaattaaccgttcatataatatgttcattttgtgtaaaaaaatattgttaaatttttaaaccagtaaaaaatcaaaacgatttgtagtatgagacggagggagtatttattatattggtttactgtgattgtcgaactgtgattgtcgaactaactgaggtcaatgcttaatgcttccttattaccagtgctactacactttaaagaaattcttacgaaaacttttacaaacaaaaagtctcaacagtttggtttagctagttataggaaatctagatttttgttcacgtacatgccacatcagctggttataaaagttttgtcaaagaaatgtatgtgttgatttttccttcttcctaagaggtagaagggtttctactgcatcagtaacaagtgtactagttacccagtagcattactgcttgtgtcaacacaaaccatatattgatggatgtatggacattttgaaagacctgtacatcaaaaggatcaaatgaatacaattgcacatcgttttgtaatctttaaaaaaaaacaaacatgtttttataccatcgatcatgggaactcggtatagactttaaaaagctatgttccatatcaaagagaatgtgtactgtctcatcccaagataaatttattttcaccccctgccacatataccaatacaaaacttaaaaagacaataataaaatcagcccacccgagtttaaatcttagatttgatacgagtgcttgtatttatggctaattattctttcagtgctaggcaacgtacccgtcgacagcgaggtgcccatgattcgtcaatctcaatctcaagatatacaaatccagttttccccggaggtgctcatacagataagtcgtgcgta

SEQ ID NO: 41410 - DNA, 1025 bp, Oryza sativa
aaacttgaatgggttataaattatgtagtatatgctagctggttactcctaacactaacactatgtatactactacttcacaattaagtatactaccaattcagatcctgtacagtactgcaagctgacatgtgcactgagagtctgtggggcccatatgtcagtgagtggtactacatatagaggaccctcactcgcatactactatttactatactactgctactcctaacactaagctagcctttgcatcacatggtaaattagtgctactttgtttacacaatcacttgtatatttgccattgtcaaaaccttcgaatgtttcccccgcaaaagagagacttgtttaaatgcttgatgaatgtgtggtattttagaggttcttggattgggttttgttgatctttgaggtgaacaaattcttatgatttgaaaggatttcaatattaattatcatgtgcaaaatttcttgcactttgaggtgaaaacattattatggtttggaaggattttaaaattaattatcgtgtgcaaatgatgcctgactcctgataaaatgtttttgtgatttttttttactttgtaagttttaacccatttgtgtttgtgtagaaatgtcatttggcaaattatatgctgaagagagtatactaatgctcacgccaaacagagggattatattctacacagacgctttcgccacaagcacaatttactattctgtcaaggcttgatagctgggtttgtcactctcctcaccaatcaccataaatcgatttggtttcctattaacaccagatcctcgtgaagttttgtttatttttctttcttccgaatgaaagctctacgaaagcagtttagtttatcttgcttcactaattttaagctttctgatttgattctctgtagtataattattttctcaacaaatcccctaacatacgaatacttaaaaaaaacaaatccttaaaccttataaaattcctcctgaatattgttgtcagaaaaagctcacgaatacca

SEQ ID NO: 41411 - DNA, 375 bp, Oryza sativa
gggttccatgtttgaaaaatctgtagctgatgggatcagctaggcccgggtgcccgtttgaaaagttgttggcccgggtggccgtttgaaaagttgttggcccgggtggccgttgaaaagctgttagccgggtgccaaccttgtttcaaaatctaaagactgatacattgcacatactctgaccggacgagacgcactgtctcatccgtgtcgtttgagaagcactcacttagttgtttcagaaaagagttcaaataaaataaattgcaaaaacaccagcctctccttgaagcctgcattaaacacttatttcccctggcttgctgagtactctcgtactcacccttgctctatataaataatttcccccccagt

SEQ ID NO: 41412 - DNA, 423 bp, Oryza sativa
attcctgcagccctctattatctaatactgtaccaagtattatgtttaagttggatagcattaagctacctcttgaaagtccccacatgtgctcgtattcatcctctgactgcttgcaccattaggtgggcatgcccctcttagttttctttagagctttcatgtctacacaatttggagatgttcagaatatgcattgctcataagcacctgaagtataaacttcaaaatgtctacttttcaaagatagttttaatgccttgactaagttattccctgtatttggttggtctctgtttcctattattttgtgcaatgatcatgaatagatggtttagtggttctgaggagcactgcatcctattgtcttgtgcagtactgtatgttcatcgcatgacagtttcttaattgtatttctgtaga

SEQ ID NO: 41413 - DNA, 1501 bp, Oryza sativa
ctcagtagtcaagttgtctagccgtaggtgcatccctaaattcctaccaacctatcgtttgccgtaccggggctttaccgtgaatcgtgtctagctcaccggtttagccgcagacgttgttgagtcgttcgctcgttcgttcaaacgaggtgttccccgtgcttcgttcattcgtccgtgtcgagttgtcctttagttcagagccgccaattccgttcgccggtttcggttgatcatttaggtgatcatgtgtcatgtagaattgactcgttgagttgatatctcgtgaggctcgcttgccagattaatctaagccatccgatcttggtcaactctcggtcaagattaatctcagccgtccaaaattgatataaatccgttctctcttttcagtggcatattatttctttctaatatatgtcatgtaccaaatataatctaatattttccggaggttgctttaatcttttatctcagttataaatcatttgtaaattatttaattaatttgaaatagtcttttctttaataggtttagttggaattaaatcatgtaaaattcataactaattcatatgaagtcagaatgaggccgttcaagtttcataattcatctaaaatcatgatctacatatttgtttacttttatgtactgtttatttggagtttcttagtcttttttctcgttttgcgtgttagcttgtcgtttctgtcgtttcgaaggtccgtgagtgcgtcgggagtattcaagaagattaattgaagaccctttattgcaagacaagtcacatagatcccaaacacaattcctttgagcatgttgatcctatatttaaattctctatttatttcaactgtgcatttattttcgaatgtcaccgggtggcgtgaacctgttcctttgttatggccaatttgcattgattaccctatttcttgattacctcgggttataatttgactagttgagttttatatattggttcagctagatgtattagatataattgcttagtcatgcttagaaacattagcacactattgagataactaatgtttcactattacttaatgatggatatttaattgtagctcacgatggtcaatcgtgattgtgaattaattaattgccaactaaaacttgataatggtgggttgtgagtacatggttttgatggtcgtgctcatgacaattaaggaccggttcacgagtttcggctgtgaaatattaacccgtgccaaccataagccagcatgggcaacggctttatcttttgtatagcatggttcattgcggggcaccagactgagaagtggcggagataagcccacgggggtcgctggggagtccatgccttgttttataagggggtgattataatccaggaacagtgcactactttgagttgtgttgtgcgaagggtactgtcacgatttccccctttgcagtgccgtggtggtactttagggcatagtaacatgtgtggaatcgtgtcttgtg

SEQ ID NO: 41414 - DNA, 1501 bp, Oryza sativa; identical to SEQ ID NO: 25673

SEQ ID NO: 41415 - DNA, 371 bp, Oryza sativa
ccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacaatattaatttctctcatcagctgattgatcgatggttctgaatttcctttttgatcgatcaatattgttaatattttctctcaaagtttttcataactattcgagtgacatacaaacaatgagagaggacatttcttcgaaagtttaaaatattttccctatttcttcagacaaccaaacaggtcgatcgtcctacataaactctcgatcgctagtcgctatgcatttcttcaga

SEQ ID NO: 41416 - DNA, 1053 bp, Oryza sativa
tttgtaattctatgaatctttctacgacttgcagttgagaggttacgtgaagtcttcaatatagtctgtttagaatctcaagttcagatatttcagaatatccactacgctttttacctttatctcttggtaaattaatttcagaatgttgttgtaattcagtttagcatggattatggagatggtgtttaataacatggtagttcaggagggtttttgaagtcaggcatcgtttctatgctaatataaaaccatttgaatgaaccatcaacaatggatgacctaagaataatagtatgttgggccactaccattcaattatttttttaccatgacaaattttagatatgcataatgattttaagaaagtcaaaattcacaaacttgcactcgaggcaattggaaaacacaaggggaagtgtgtgcttgttcaagaaaattaatttcatactccatgtgtgggttctggctttttgtgccgaaaccatcatcagatggaaaaataaaaggcggaaagaagtgaagtataaactgaaatcttgaactttgactcctaactatatgaaaatatacacaataagatgataaagccagagccccaaagatatcaccgaactctggtgaaaataccatactcttctatctccatttctatcccctgaaaatctgcaatgcatggtccttctattcatcttcatatatatatatatatctgagtttagaaatagctccatatcaaatccatatgttaaatttctttcctgggagaacaaattagtgtatgccatctggtgggaaatcttctctcccctcttagaactcacttttgacaaggtcaaattatagacttgagtgtttgtcaatgatgaatcgtaaatttttttaaagagttatattttttccgttgcaacacacgggcacctaactagtcactgattaattagtgattaattatcttaattagtgattaattaaatcaggataattaatcactaattattattaattaatcattaatcattcaattttcaaaacgttctcgcacactcacca

SEQ ID NO: 41417 - DNA, 271 bp, Oryza sativa
gtccttttccatcacatcaacctgtcatatacacacaacttttcagtcacatcatttctaatttcaaccaaaatccaaactaggcgctgaactaaacacagcctaaagttgctcacttgctctcagacgcagacggcagaccacagtccacaggtggccgccaggtcggctaaacgtccgcctcccacgctccccgccacccgcgcctaatccacaccaggtgcccgacatgtgttcgacggtttgcccgtgagacgacgcgcgtcggcca

SEQ ID NO: 41418 - DNA, 525 bp, Oryza sativa
gggctgacaatggggcccacttgccagttgacggaatagaaaagcagctagaaagaaaagtggtgttttgttttgtgaaattaaatgcctctgaaccagtagtttaccattaaaactaaaaatattactatctccgttttttaatagatgacgccttgactttttcttacatgtttgacctttcgtcttattcaaaaattttatgcaaatgtataagatataaatcacacttaaagtaatatgagtgataaaacaacccataacaaaataaattataattacgtaaattttttgaataagacgaacggtcaacagccttatcggatggcctaataagccaaagaaaaagccaaatttaaaattttcaagcttaattttaagattgattttaacatattttcaacgtagttttttttcaacgttggcttttaagtcacaaataacacatttataaaagttttatccataaattcatttttattttctaataagccattttgccttattaggaaataagccaaacga

SEQ ID NO: 41419 - DNA, 496 bp, Oryza sativa
atcaatgagagcgctatttcatgttcaattaagcatgtattcatcacaccgaagcagacccaataaaccatgaaatgcatgtgaattcactcagggataccaaattccaagatataccaagccatataaaaccccacatctagcaaattttaatcaaacaacggaaatcacctagacaccaagcataccatatcatccctaaagcgcggccgagcaaagagttcacgtcaagacacgaaacttgggcgcatcccgcatcagctggatcctagccataaggacgaatccctcgcccaacgtcgcaacacggcatgaatcctcccatccaccgagccacgaatcccgcgaacaatcgagcgcgatacggacgaatccctccccccaagtcaacatggccaccaagggacacgaatccttccatcccatctacccgagccacggattccgagaacaaccgagagaggcgcgcagagggagaggaggggacgacgcgtac

SEQ ID NO: 41420 - DNA, 569 bp, Oryza sativa
aataaatagcatgcctccaaaagtttgtctaacatccactcacagtaaggtgaaaacttaccgaatgcattctctctgtcaatattttacggagagatgatgtgtctccatgtgccatcagtgtgttaacctgaatgagaaagaagggtctcattgtttgccctatggcttataagccgttgccaaattttgaattttaaaacttgtttttgaagttgattttgatgctttttcaacatttgcttttaagccacaaataacacatatataaaaggtttacccataaatctttttttaatcactaatcagccgtgagtaaccgatggggaaaatatgtagtagttggcacttaaatttgcatttgacatatagacagtattctttataaggagaacacaatcaaaattctatgttacatacaaattgcaaggtcgcactacaagtcatgtatgctatgcactgaagaactcggagatcaattcaagccagaagataactcaggaaaagaaaaaaagaatgctgctcagtgactattgctatttctcaagaaaaggaaaagaggtagaaaa

SEQ ID NO: 41421 - DNA, 1501 bp, Oryza sativa
gggcaattctgtgacatggcgtagtgtgttttcaggtttgcaagagattaattataagctatcctttacttgatctacaatattagagcagctacaatagcatactataagccaactataaacatattttaaaaggataaaagaagagagagaagagcagcgggttatagatctgtagccagatacagcacggactcggagacataatacgtgaatgacatgtgggaccagatattaatagtgtagtaattaactattatatgaattggctataaatgatttggagttagtagttggctatactattaaacttgctcttacaagtgtaggattttatggaattttaataatagtcaactttccatagaattaccctaaaacttttgtcttggaagaggccaatgtctgatcggtcgagctatcgctggtaaaccgtagataaatgaacaaagcaacaaaaaaaataattagtgtaaaacttttaaattattgatcacggtctaaaaaccaatgctacagaataaactacaataaaaatactccaaaaccaacttaaaataaagtttcaaaatttaaatttctattgtgattgccaaacaatctctagagtctagagcaagattgtaattatcccgatccatgccctagtatcttataatgctacgatactatcaagccaaaatcacacatagtatcttatttttcatagcatctcgatcttattattcattttcacacgattctatataaaatcttaggtagtatcccaattctacgatctctactatcctacaaaatattatttaaaataagatggattgaaaataatatgaataaatatgctcatgtttacattaaaaaccaattaaatatatcaaaatcaatattatatgttttaatatatataatacagtatattactccctccatcccaaaagtttgacgccgttgacttttttaaaaatgtttgaccgttcgtcttattaaaaaatttaagtaattattaattcttttcctatcatttgatttattgttaaatatacttttatgtatacatatagttttacacatttcataaattttttgaataagacgaacggtcaaacatgttttgaaaaatcaacggcgtcaaacatttagggaatgaggaaatatatattttatataaaaatatgtattttataaaatctgatagtattccgatcatagtattcgatactatgataatacagataaaaaacgattatctcgatagtgattaccgggatgtgcccatcgtttcccttctgatggaaaatgcttaggaaatcctagtcctaaagaccctaacccgaatccagtggtattggatcacagatgtccaagcgacaaagcccaacgagatgaggaatccaattaccggcctgcctccctcccatcccagtcccagtcccactcctacacccacaccaaccagcaaccctaaatccctaatccggttcctaccattcccaaatcccaa

SEQ ID NO: 41422 - DNA, 1501 bp, Oryza sativa
atcataaattaacataataatggacactaaataatgaaaaaaatcacaaaatacaaatagttttgatataactaaaagagtactccttccgtcccgaaataactcaacctaggatgggtaacgaatctggacgattgacccatcctaggttgagttattttgggacggagggaatacacactaatgagcttcatggtttttgtctacccctagtttccaaaactaaaaaaacgggtgctcccctacatgtgccgattctaaattggaactggcaccaatggtcgttaacagtgttgcctgaacagtcattggttgtgaattcgacaccaaggactgattccgaaccgaaatcaaagtgcttttctgtagcagtatgcttcaacgtgatcgaccacactgaaatggagctttgggtggttgccagcttaccgggtagcttcagccttcagctgtgcctttctggacaaataatttcagacccaagtcatccgaatgccgagtgagaacgcacgctgacatatcttagggacaaattcgagttgggttcagacatattattagccaactacctaccataatatacaacttcacacaagtagtcaaaattgtaagactcttggagactaggagttacggggaccgatgatactagattacgtactgttgcaaaaggttgtcaagtcagacatgcctcgtgtcgattcagaccatgatggatcgttttttttggaggtcagggatgaaattaaggtcgtttttagatggggaaaatttttaatgtttggttgttatatgagatatacggacacacatttaaaatattaaacgtagtttaataataaaataaattatagatcctctcgaaaatctgcgagataaatttattaagcctaattaatccatcattagcaaatatttattgtagcaccatattatcaaatcatgacgcaattaggcttaaaagattcgtctctcaatttagacgcaaactgtgtaattgtttttttttcatatttaataatttatgcatatgccaaatatttgatgtgatgggtgaaaattttttgttttggaaactaaatagggcctaagtgtgtgttgagagggaaaatcccaggcgacaatcttttctcccccaagaagtcttctacttctacctgatgcacatcgtcttctctcccttgattgctctctatctttgactgaaactctgaaagaacgttaggtggacaatgatggaagaagaaaccagcgaggcaatctaacaaaccaataattaacgttaccaatatctatagcaaattgcgcattcaaaagtaatttgaaaggagataccgagttaggcaggtatcagcttatacctttcccttgtataaatgctgcgtgtctcactagctagagcaggcaacataggagtattagacaagaagcacacaacatgtgtgacagacaaagaagacctgtgcctcctttgggaactctccgatcctcgtggctccta

SEQ ID NO: 41423 - DNA, 426 bp, Oryza sativa
taaatgcttgtagtagtattattcatgtttaagaaataatgcttgtagatgcttggagtcaagagaactgaaagggttcttccaactggaacttcattgactgttgttggtgaggtaattcatagctttaattcgtctgcaatgccttgtgttggtgccctattttcctttacatggctaagtcttgctttcgtttttgattcttatgttgtatgaataggccattaaagatgatgttggaactattcgaattcagcgaccacacaaaggaccattttatgtatccccgaaaagcatcgatcaacttatcatgaatcttgggaaatgggccaagtatgaagatgcagtagaatattctctctctttttaggcttcttgaggctaatagtgtgttttactacaacaggttataccagcttgcttcca

SEQ ID NO: 41424 - DNA, 1501 bp, Oryza sativa
aatctttgatgggcctacatatgtacccattagtggtattgtctatcaagtgcacatatagatcaattacttacacctataactggccgtgtctcatagccttatcttgaacgggcttcggttgaacccgttatagatgatgtcatctgtgacaaggcacctcagtccgttacagataggctatcatagatgggtagatctagcatagtgggaggaagaccagtggtggcaggagggtacctatgggcggcaaggtgccaccgacagtttcgtagccgcggggatggagaaagggtggtggatcgggttggcggccgatgcaaaggatgtcgtgtgccagcaagggcattggcaatggtccaacggctcgtgtcgctaaagattgtggagaagaggggaagttgaaatctagcagtgagttgatgaagtgaaatgacggcgacaatgtgaaggatgatgtgggagtgcaggaggccgtcgggctctttggtgccgatgctcagagcaaggcggtgtcgcggcgtgatgttatcctgatggcctcatcctctagtctactctggcctatcgacgcaccttcatgacgaattcgccatgactgacttgggtgatcttcgctaatatttacctctcccaatgccattctgtggtcgatctgcacttgtggcaacttattggaatgcatgaatataataggcacatagtgttgtaaccacgttttgtatttgcattttttttcttatttttaattttaatactcattgtaaaattgtacatttgtgttgtaatgcacgggcaatttccagttatggttggtaagtacactttagccagttagctaataacatgtatgcacccaactcgaatttgcccagatatgccaacaaaccttaatttgtggaagtcaaggcaaggcgcgtgcgttctcaatcggatgatttgtgtccaaacttccacgtaagataattttatcatgtcggccacatacagttttttccacgaaggcacagctgaagccacccaccaaccatgcaaaaccacccaaaattccatttcagtattgtggatcttgtattgaagctgactgatacggtgaccggatcgagtacgtaagttgactgtgcttgatttgacatgccacctatggtttggaagattaaagagaaatatccctctgttaccaagtactaataattatcgacaagtagtagatactggatactggtcgtttgcttcacaaattaagtcgttgaggtatttttcgaaagagtgaagtacctgggtagttattaaacttgagcggttttgtcatctagttacatatataaactctcaaattaaattttggtgctcttgaatatatatgtttaaacgggctccaacccgctccgtacgttaacgtgtcatgtttgggtggtgcctacatattcgatgggacccatatatcagttttatataaaagataaattttgaaaatatttttcctcttaggtagaggaga

SEQ ID NO: 41425 - DNA, 158 bp, Oryza sativa
cagatcagtacgggagtttaaatccaattatgatgtttatggctagcaaattcaatagttcaatgattatataaaattgttcatggagattaatattctctctgaggaagtgaggatttgcttgagtgaaattattgtgttgatatgatcaagttgtc

SEQ ID NO: 41426 - DNA, 1501 bp, Oryza sativa
tgctggaacattttgtcctgaaatgtgaatatcaaacttcttccgtagtattgccgctctctgcaaaccaatccaacacatgcaaaccgaacacaccgaaatgttaatttctgccattatttctaatccaagatagttgctggatgataaacatttttttcaaatattttacataagcacaattttgcgaaagagagacacagctagctcaacggatttgcaaaacgccattacctcgatttctctctcgacttccttcctccgccttacaacctccgagtcctcactcttaccagtctcgaccttcttctccgaatcgtcctcatccttctttgctgccaatcccttgaacacactgaacccttccacagcatctgcaaagcgtacaacactcgacagagtagtcagagtcagattacactcccaaaaagcaacaacctcttgagaagaagaactcaccggaagcagagtcggcgccttccgcccgcctcttcttgctcttcttcgccttggccttgctctggcgcttccgcttcttctccggcgacggcgcggcggcggaggccacgtctggggcaggcgggccttgccggaaccgggcgaagtcgccggcgaagcgcttgcggtcgaagtgcgtgccggcgaagagcgccgacgagagcttcgccttctccatggctaacctttgcccgccgccgccgccgacgagaatctcctcctcttaaaaccctaggtgggtcccacttgcagcgttcgaaccaccgaggttgaccaggccccacatgtaagcgagaggagctcgccctacctatgccgaaggttaagattacgagaaacaaccgattagtagatacagtagttttttaaaatcttctaacttttcaattttagtttattttatggatttcacaacaatagttttttagaatcttaagaaaaatatttaagcaagtttttgattataagagtaactgtggctgactaccaaaactaactaaggtcatactccattttggtagcttaaggttctaagaaacagctagcgaaaaactagaaaaactagaagtctcagcttttaaattatagtttattttctgaattctccatatacattctctacatggaaatcggatagtttgggaagctttgttgtagctcctgctgctccctcaaacaggccctagggccaagtcttactaaaagcgcttctgggccagtatctaataggggccgtggcatatccctgcggggcccgcatgtcagggaatgtactcactgacatgtgaggcccacccccaccgaggccggtgcactcctcgtatcctgttctttgcttgcctcccggtccccctccccgccgcctcctcctcttccctcgccgcgaaaaaggggggaaaataaaaataaaatttcacggcttcatctcctcgtcgtcctcctcctcactgatctccccccccccccggattcggtgctcgcctggcgattccttgcgagatgt

SEQ ID NO: 41427 - DNA, 1501 bp, Oryza sativa
cggaagaggtaaaatataccatcatgttattacttattgtcaagtggtgctaaattgccaaagtccatgaaccatgaggagtgatgtgtagtacaagagttacctttttattgtaattgctgccggtttctcagtagaattcgatgcactgaaattcaattgaatttgtttgtttggatgcagagtaaactccaaactccagaggtgttggatttggtgattggtcattggttgcggcggcgccgccggcctaccgggcgtggaacaccgtacggccggagaatgatttcctcgttgcgcggcacgaaatgtactcttccattcctgaagctacgggtacggtttctgcttaaagaatacactgaattctgcatgtataaagcctgaacccgtaggtcttcagctacccggcagtgttcagataagcaacccggatgattgttttggcttctggatttatcaaatgaagtcattttgcctgttgactcagacataggattgcttgacgtacccatgatcaagtaacatgtatatataaaatccgagaaatgttatgtgatctagtctaagagaatggttgaatgaagaggatcctcttaatttggagattaaaaacaagttgattgagatgcaatctgagtgtacgagaagcagttatagagttggcaatggtatgtaaacctctgaaaatgactgttgcgtgaaacggtgaaaggttgtctataaagattttatttactgattattgaaatggattatggactatttgctctatttattatttttattaataaatatttgattatagataattctcaccaataatccttccaacaatcaaaatcaaacatgtcttggctactgcactgtaacatgagaagttcagcaagtctcaacattacatgacacaagatgatgtaacctgcaggttaaacaacttgaaaaccggcaaggtaaacacagcttttgctccattgcattgcgcaggaatgcaataaacaacttgtaatctactcgagcgtgtatctgaacttgatgaaactttgtttcttgcacgttgaagccacacgaatctcatttcatctttctcttctgattgctttcacacaagatccagcaaaattaatttagatgaaaaattagcctcccgcccaatcagctccaaccttataacatcaccatgcaaaaaaccatggaaattaaaccccaagtgcacttgtgcacgcactcgggaatacaaggctaatggccatcgacactacggctgatcatggcggcggcgccggcgccggcggcgtggacattcccatgcaaatactagtgcagccgccgccgttgccgccgccgacggcgacggcgacggcgaggcaccggagaacgcacaccggcgactcgacggcgtcgtcgtacgagccgcagcggcggccggtggagcaccaggtctcgtccatgcacgccgccaccgcctccgacgacggcggcggcgtcgacgacgtggtgc

SEQ ID NO: 41428 - DNA, 1501 bp, Oryza sativa
tgctataatatatcactctgtttttcgtatgcgagtgattcgatcccaatccatactaaagaacacaagtagtcttcttagtcctcaataatactactaggggtgcaaaggcagcgtggaaattcatattttgtatcaccttatagcatccccagcagctcgtccaaatttgatctttcatatggctatatagatggttatccaaaaaagattcctctttcatatttctctccactctaacaaatcatctatattacatcatctatatcacatcctcctatattttaatagtatctttcaactactatcaattaatattatttttctttttttcttttttcatcattatcttctctttcacacgatctctctgtcactccagagagatcgagagacgcgagcgaagggcggaggagcggaggggtggcacgagcggctcgccgccgccgaccgccggtgggagcggagcggagggcgcggcgcgagcggctcgccgacggctgggcagactggcggtgggagcagaagggcggcgcggccgaaggtggtcgacggcgggagcggccgacgaagatttgcctcatcctctctcctcgatctaccttcactgcttcaccctctgcctcgatctcgattcggatgagggcagtagaacggatgggagcggtggttgcaggatggcgtgaggagagagaaacgccaagaatagcgcatgtaccatctatggaggcccagatggcgtatccgttggagccggattttctccccccatacgccattttctggatggaagatgggatgccggaactgctggggatgttcttagtcctctgcatcttcaacagcagtaggactagcttcaaaaagttacgcttttgacagagtttgatagctgactcgtgttctcgagcatacatgagttttcttttatcgacagcaattactatatgtatcaatatcgcatgatgtattttgttgcttaactaggcctttcagagagtcatgacatattgtttgtgtgcctaacggtaagggttgaagaagtttttctataagttagcaagtatcatttttctttctttaataaaactctaaagcaattctccctctgtctccaaatagtctatatactattttttgatcattttgaccttcgaagaaaacatataaaatttgaagtactccattaattaagtatatatcatgatttaactacttaaaatttatcagtgttcaaagtattgtaacatcagtgttcaaagtattgtaattagttacaagtgacaaatatttaaaacaaaaaaaaataggagagtgaatatatgtgcaaatactcattgcaccattacaagtttataaaagacatgctagaaaacaaataaaaaaaattatatagctcattgcgtgcgtggcatatgcaagctcccctatatactagagagctgctgatcgtaattgtatccaacttttaaaatgatcaataaagcattatcttcctcaa

SEQ ID NO: 41429 - DNA, 1501 bp, Oryza sativa
cctacgacatgcaaccttcataagctctcgatcatcttcacacatttgcagctgtgcccaaaatcggagccaatatgttgccctgaaaatcacctgcatatatgagatagatggtgatttgtcaaaaaccatatcattcctagtcaaccgcagagaccaacatatggcagaagctcctacaagtatgagtttactcttcttcttgtctacccccaagagccaaccatcaaacatattagatatggtagtaggaaggtataaaccaagagagaactgtactgctctccaaacaaattttgcataatgacactctataaaaagatgttgcatagtctcatttttcatacaaaaacaaaatcttaaattgccattccaatttcgtcttgccaaattatccttggttagcacaacccctttaaacaagtaccacataaaaatcttaatcttaagtggcatcttaagcttccaaataatcttgtttatctcaatataaccattattagttaaagctagatacatcgacctaatagaaaatattccattctgatgataattctatctaaagctatcagaggattgattcaattgaatatgtacaatataagcacacaattcatgccaatatgcaagattctgaccaactaatgatctcctaaaggaaacattgagtggaacagatctcataacattagcaatagtagaacttttccttcggacaatagagtataaagatggatatttgtctttaaaagccaagtttcctagccatttatctttccagaaccttatttgtttcccattatttataatccaagaacccatatctaggtatctttgaccttcatgagacctgacaaaaatgagaatcgccttgtttcttattaacttgggtcatagactaataaattattccgatattacaaagttactaaagtataagcttgttgttcttcttcctcctcccataaagttcttaacatggaagaacgtagaagtcaaagacaaacatctaagtcatatacaagactttaaatccgtggcatctcactatatcatattttttttaccaccaacaaccaccgccgggtcatcacaacttatccttcacttcacctatccaactattgttgtcgatgttcgtcctaccaatgatttgttgttagttcttaggattgcttagctcatagttttgtgtgggaacagagcacatcatccactaagacaatagtgaaaatgctgatgctcttgtggcaccagtggcaggagaagaggctttagggaagcggccatggccacaatggttattgaggttgtcatataactttatggaaaaactgtcatccataactgactttcctctattacttaaataatgaagttgttctccttcctgttctcccaccatccatgagcggttggatcttgattcgaactcccaacctatcatcagccacatatgagcccatacaacacgcccaaaccaatcgtgcgtgcttattgg

SEQ ID NO: 41430 - DNA, 1501 bp, Oryza sativa
cgttttatttgaaaaatttgtgaaaaatttaaaaatatttaatcacacataaaatactattcatattttatcatctaatagcaataaaaatactaatcataaaaaaattttaaataagacgaatggtcaaacgttgaacgtgaatagtacaaaactgcacttattttaggacggagggagtatcttttagagtaattaatacatttaaatttgttaaaagtgcacagtattacagtcttttcagctttatatctatatgtgtgagattaaaaatgaagtatttttgggagcgagaaagtatatgatcaaagtccttactacccttttaagaggattttgccattctcttcattgagtatagaacctaatttattactactaagagggaagctagctataactttagctacaaccatatagtagctactccattcgttttataatgtaaaattttctaacattgctcacatttatatagatattaatgaaaaaacacacacatatatattaatgaatctaccaatgcaagaaaatcttacattgtaaaacggaggaaatagtatttatttaagttaatcagactggtctaatcttatactactagggctgcgttcgcatgtcctgatgggaactcattccctccgcacggaaaacagagtgatccattagcacgtgattaattaagtattagttattttttttcaaaaattgattaatttgattttttttaaaataactttcgtatagaaacttttttaaaaaaacacacagtttagcagtttgaaaaacgtgcgcgtgaaaaaacgagggagagagggtcgggaacgaggggtgtcgaacacagcctaaaaaagcgttgctggcaaccaaatattcctcactcacttacgccgagcccttctactactatgcatgtttttttttaaatcgaattagcctttttggcgccgtgagaacactgctctggtcggcaccaattgcctggggaccattactgctgttaatttgatcgtgctccgatttggtttggtcgctgttaatttaattgtcacttagtttccggttgaccagatccatctaacatttgggattcaaagcttctgtaggctttcttttaggaaatggaaagggcttatctaggctttgcaccatacataaagatttggctacctattagctgcgagaagtagttgcactggtggtgccttattactagtttactactctttcttttttcatggggtaaagcttttatactgagttcgtttattgactttcccaactccatcctatgttttacgcacgcacatgctttcgaaactacgagggtacattttttttaaaaaataatctatacgaaagttgttttaaaaaatcatatcaatatatttaaaaaatactcaagctaatatttaattaattactccctccgtcccacaatataatggattttgagtttttgcttgtaacgtttgaccattcgtcttattcaaatttattt

SEQ ID NO: 41431 - DNA, 1501 bp, Oryza sativa; identical to SEQ ID NO: 25658

SEQ ID NO: 41432 - DNA, 365 bp, Oryza sativa
gttttcctcatttcttgtccattttatttgctttatccctagaaacaaataatactacaagtggaagtggaagtagattattctaaaataaatatgcattgcaagcatagctaaatctcctttattttagttatatttatggtcgtcattggtatataacgaccatcaacaccgtttcaagaggacgtgttgcaatgccttatcaactttgagatgacctttctactgtcattcttcaatgtaatgacgtatcttctatgtcaccttgtgaaagagatcgatattctcggtcctgtgtacctacacaacatgtttcctttagagaggtacatggctgttctaaagaagtacgtttgtaaccgttc

SEQ ID NO: 41433 - DNA, 541 bp, Oryza sativa
accattgttattattcctgtcgtgagctatatgtttttccaagatcccgtctgttcaaattatttttgtgagaatctatcacaattcacaacaaaggctggaagattgtacttaaatttgtaagtgcttgatgttttcttgcatttacttgtacttaaatttgtaagtgcttgatgttttcttgtatttacttgggagagttaagattagttaggacttatgataacatttggctgtcaagaattgacatccagtaacaacacttcatcaaagtctagcacgatagaagaaaataggtaggaataaaaattcctcaacactgacgtgcagtaacaattgacaaccagtcagtatcaaataggtgggaaaaaaatattccacaacgttgacgtccatacatcacaactgtgagtataactttgagtatttgaaccataatattgtttttcttgttcatcagttgatacctgttttggcagcaaacacaaaaactgcagaacgatcggctaatcttatattattgattcatttccagagtaga

SEQ ID NO: 41434 - DNA, 1501 bp, Oryza sativa
ggagctcgacggcgaaggagacgaggtccatccgcgtggcgtcgaggatgccgccctcgaccgacctcgagaaggcgcggtagaagaaccgcttgatcggcaccacgccggcgtcgccgaggtcgcactcgccgctcaccgcctcgaccaggcgccgatagctgagcacccactcccagtacgcgcgctccaccaggaagatcaccgcctccgacagcgcgagcacgtagaacagcatcagcgcgtagtacgcgttcttgttgccgccgccgccattgtcgccggcgaagcggagcgtggcgaggcgcagcagcgacagcgcgacgcacgccgacgccgagaggagctggagccagtagaggacgtagctcacgttcctcgcctcgacgagccagccgccgagggggaggaggtggatgggcgaggccgccgccgccgccttgtgcggcggcggcgggtcgtcgtcgtcgtctccggcggcggcggcggcggcgtccgggaggtgcatcggctgctcctgcagatcgagctcgttgctccggctgaacaccctcgtcccctcgacgaggaggatggcggtgacgagccagaagtcccgggcgtcgaggtcggcggcgaacccgccgaggatgaccaccgtcgcccacacgaagcagacggcgccgacgtgcgacgcggccttctcgagcaccgcgacgtggagcgcgaacgccgtcaccttgcgctccggcaccacgtcgtcgacgccgccgccgtcgtcggaggcggtggcggcgtgcatggacgagacctggtgctccaccggccgccgctgcggctcgtacgacgacgccgtcgagtcgccggtgtgcgttctccggtgcctcgccgtcgccgtcgccgtcggcggcggcaacggcggcggctgcactagtatttgcatgggaatgtccacgccgccggcgccggcgccgccgccatgatcagccgtagtgtcgatggccattagccttgtattcccgagtgcgtgcacaagtgcacttggggtttaatttccatggttttttgcatggtgatgttataaggttggagctgattgggcgggaggctaatttttcatctaaattaattttgctggatcttgtgtgaaagcaatcagaagagaaagatgaaatgagattcgtgtggcttcaacgtgcaagaaacaaagtttcatcaagttcagatacacgctcgagtagattacaagttgtttattgcattcctgcgcaatgcaatggagcaaaagctgtgtttaccttgccggttttcaagttgtttaacctgcaggttacatcatcttgtgtcatgtaatgttgagacttgctgaacttctcatgttacagtgcagtagccaagacatgtttgattttgattgttggaaggattattggtgagaattatctataatcaaatatttattaataaaaataataaatagagcaaatagtccataatccatttcaataatcagtaaataaaa

SEQ ID NO: 41435 - DNA, 1501 bp, Oryza sativa
ctattgcttgtccaatatcggaagtaatatttgatgaagagtacaacgaacttgctactgtcacaatcactttcttagtatcgattttctgtcaacagaaatgggggtacctaattcaaaccaaacctgtgcaattttatcatcacaataactgaattttgatatgtttttcttcttcattgttgttttcaggcggcagcagcagctagctccttacaagctaaagtgtgataaagaaccacttaataacaagtacgcatatacttcttaccaaagacagttcactcagggagttaagtgggtgtttattaatctagatgttaatctttcagggattgcatttcctttactttctttgcccttcgttttaactttggctgtgctctttgcgtaaaaaaacacatctgtgttgtccaatagcaagttagcaacaaatagtaaaatactacttctttatcctataagatattacttcacttgatcttaggcagtccaactgtacacgatggctcttttgcaggcttggaccacctgattactatcctcaaacaccaaactgtcctgaagagacattgacaaaagaatatgtacaatctgggtataaggagaccgttgaaggaattgaggtgcgtatggagatgaatgttgtatacaatgtattatgagtttgaatccaattagaaattcattaatgtatctatctgtgctatgcttattgagtttggatatagtccaatcttgtatattgactgattcagttttttcttgggattcataggaagccagagagattgtacttagccagatcccgtacttctgcaagacagatattgttgtaaaatgcaaagaggtgaggaaacttggccaatattttctcagtaagctcgtggcatgatcttattttgccattgtgtttcggaagaaatacgaaaaattctttgcaatagcaaatggattgacagttcatggtaacaaagagacaaattgccactggcaccaaccttatattccaatgttctgtatatcaatttggcatctaggcataatttgttgcctggctggtttactacccatgctatttgattaccttgacttactggagattaatctgatatcctttagttataaagtgtcaccgactattaggactaaatctcagaacttattccatcctgcaaggatagttagtctagtgattattaagtctttatcaacaattgattctggcttgcacagttgtaccagctatcatcaggtgcaaacatttaggcaaaaaagttgctgtagattgtgggttgtgtgtttctgttctcttttaggaaatcttgtttctctcgtaatctcaaatatgtatgttgaagatgtagttctttaaatgttgtaagacaccacaactataaatgcatggatacatttaattaacatggttgattggtagcttcatccttttgtttttattttatgatctgttttgatgtatgatatagagtacttagtataa

SEQ ID NO: 41436 - DNA, 611 bp, Oryza sativa
ctcccgacatgggacgcggatctggttccaacttccaaacctcccatcacgtgagcatcatcgaaagagagaactactgtatacagacacacacctgaagtgactaggagctatcacgtatgtttgatgggccaatttgccattcaccattgcaaaaatcagggagttgaaaactactccctctattccaaaatataagaacttaaaactggatggaacattttctagcactacgaaatctagacaagttcttatattggagagagtaccatcggatgtgccattgacgttgagtctaggtctcacatgtcattctcacgtcccaactcatgaatatttacaatgatatttcccaaactttccctatgttggatatgaatggatgctgaagttcaaggtaaacattgtccatgagaagaagcaaccagcatattctgaaggtaattgctgaagcctgaagcatgtaatctgcactaccaattttctcagatgacagcatactccaagtccaggaaacaaagcatggtaaacataccaacaagactagtgaattggttcccaaaaaaacatggcaaatgttcagaatttgaggaccaagctcacaggatata

SEQ ID NO: 41437 - DNA, 322 bp, Oryza sativa
tgttggggattttggtttaggagattaactaccaaagtcaacatgatggtgccattaaggaggattgcagattaagatgacagggtttgttgttgtttcttggtctgtggataggcatgggactagaatagtcctggtaactgtagcaaggaacttggccacatatagccggcagaatcattgtttaaagatggagcaagtgagcagctaccactagcttgtaaatcactatcattttctttttcaagtgtttgctgcatagtttaacctttgcaaatgcatggtcagtgacagtgagagcaaaccttttggcctatcaaaa

SEQ ID NO: 41438 - DNA, 299 bp, Oryza sativa
cctttctgtcgtactccctccatcctataatataagggattttgagtttttgtttgcattgtttgaccactcgtctttgttgaggggtgaccctctctagcgggaggctgtgaaggccctcctttgagagttcggccaggggcagcgggtgagattcgaggatttggtgagcgaaactgtgtgtgatcttgatctcggaggcccctccaagacgatgagacaaaagaggtttatataggttcgggccgctatgaagcgtaataccctactcctgtgtgtatgattcttctgtgcttaga

SEQ ID NO: 41439 - DNA, 252 bp, Oryza sativa
ttgaccactactttctattgcaatatatctttataacctgacgagattataatattatgaaagtatttgacaaaatgaatctaattctaaacacatgattttcttccatccaatctaaatatttaaaagatattgatggtcaaagtttcttaagttcgatttgaaacatgtccaaaaaaacatgttttcaagaccagaggtaatacaaaagaacatgctactttgttgtaaccaaatatacttaattgcagc

SEQ ID NO: 41440 - DNA, 497 bp, Oryza sativa
aaagccaatctttttactttgggccagatatctttacatgatgtttcaatttggactcccttcttcctcctccaactctcttcctcctctctctccttcaatctgtaaagtcttccaaagaattcaaagggtagtttgcattttcaatcatcaactagctagtgcttgttgcttaatttcaaggaaagcagagggtgcacaacaagtattcctactggtagcaagtagcatatgaagaagctggccggcaatgacatacagttgctgctactttctgaactgactataagaactaagccaagtacttcctccatttcataatataagacttcgtagcattacgcacattcaaatggatgttaatgaatctagatatatatgcgtgtctaaattcattaacatccatatgaatgtgggcagtggtagaaagtattatattatgaaacggagggagtagcagacagccacgctaaagctcatgctcgacctccgctagt

SEQ ID NO: 41441 - DNA, 538 bp, Oryza sativa
ctgcagccccggttttagttcaccttcaacttttatttataaaaccagacaagtaacacctcatacctgattccatggtggtttagttgagatgacatggttttcactgatgattagcttctattagctgagattaattgatgtttaaccagctatttgacattcgcaccaacacaagcttgcatattaggagtctgcactagcaaaaactattatgatatcaatggaaaccactgtggagcagtgttgaaggtattaatagtatttgtatggttttgaaagtcaaagggtggaaaacactagcttttcaatttgaagttaaaatggacctagaaaagagtccaagagccaaaaatagactatgccctttgaaaatatgtcgatgcttgtggtcctcacctgttcaaatataatttgaaggtggatattcattcttgcatgtcactactgacaagaacattgaatcaacatttcttttgtggtactgcagatgcttttgctaactatatgctgtgtctgccctctaaatatttgcaga

SEQ ID NO: 41442 - DNA, 727 bp, Oryza sativa
aataacgaaagatacagaaatagattatttcttggtctactaaatttcttatgactgcaaggcagagatggttacaccagaatgccccttgcaagcattcgggaactgcagacagtctactggatagtccataaagttacatgagcaaactgatgcaacggttacacgaaaaatacatgtcacatctaaaatcatatgtaaggctgcagatttgcccaacaatgtgaaaatggtttgtcataagaaactttaaacaaacaagctggactaattacaacggcttcagatgtttgttgtggctcaggacctatacggctataccattccatctccagtcatatcggagcaaattagaagcatatgcctgacagctacgaaaatctagcagtgcaactgctgaagccaaggaaaaatgtttccaggaaagtatgaaatatgatgaacatttacagcaaagtatcattcctctcacaattcacatcatcacagggtcatgtatgaactgtatattccagcaagggtgcaacacaccagagcccaagttccacatgcagttgcctctgcaaataaaagcaccgtaccttaatttcaaaagaaaaggagctgcaagtgagaaacaagcaggttgttggagacggaatacaagtacatacaagctcactggaagctgaagtcactgtgaaatgagaaatgataacagttaaaagctcattgccatgataattgc

SEQ ID NO: 41443 - DNA, 1501 bp, Oryza sativa
attggtagtagcaaacctgcagccttcgctcgcacaaacacacgcaccatggcatggcatgccatgcaaaggcgcacgcacaggcacgcgcgtgcgcacacaaaagtcggtggaacgccaaaagatgagccaaaagctaaccgggttgataaaaagtccaccagttgcatcaacgtggtacccgaccttgtttatttactacctttccccatctagtctaatctaaccttacttagttactccttcagttttaaagtataactatttttatatagcttaaaatcttatattctaaagtagagtaattagtaaacacataataaaatatagacacatatcctctttcatcaaactagttatcgttatctatttttcatgaccgacaccaaatacctagagtttgggttaggccattcacgacggcctctcccttctcaccttagacatcaatgtggcgtccctctctagcacagatcggggagacaggccgatgagcttagcggcgtggagaggagaacgacaagcttgctggctagggttcgagcgggtgcggcaactactctctccaatgatgaccgttgtagcctcgcatggggtgtagagttgaggcgttgcacaaggccatgaaagcgcatggccacgacccccacagcgtggccgcgctattctcactcatgccgcacgatagcttttctgacaaagagcgtgtgcccagtttaggttacaaatctcgttcggccccactccgagccaagctgctagagaatcttctattatcatgggttgatcgaatgccacatatgtgcactgaccttatagtttgcgcaagtgatgatgggaagaaatgtggcattatagattagtagattagtagaaaaaggatgtgccttggatcaatggaggcaacaagaaagttagcaacaaacagttgatgagacaattagaaacagattaacatggtgcagagacgatgataaccgattgatggttattcttccaaggccatcaatacaatgttgcgacatggaaaaaaaggaggggagcatgaaaatcatgcgatttgaagatcaaattataaactgttatggtttgatgtaggagcgttgttgaaaaataagggatagtacctagtgtgcgggtggcgtaatagagattgagagctaggataatgattaaatgatgaataataaggtaaggtggaaattgtaaaaatgtacacatgtttatttaagtgttacaggttcacccaataggatagccacacattaaaaatcaggatattgaatccggtacatcttaaatctacatgagcaacatccaaaagataggagtatgctcataggccttcatagagaagagctaacctcacactcatcattgctcttctcctcgaccattgaggtcagtgagctacgatgtgataatcacgaattgagatcgcatgattaagaaataggataatgtcataatcaggagatcgtcgggagaatgacggtgacac

SEQ ID NO: 41444 - DNA, 1501 bp, Oryza sativa
acggggtttaagataatccaacctcatgtcgataaatatgatttctcatggggaagtgtgccatcttatcgtgaaaggccctcatctcatctcgctgcagcggccctgcggtttttttgcagcagcagcggcagcgcagtgggcagaaaggacaaagaggaacgggacggtggctgctgcagcctcgagaaacgctcccctcacctcgtgtgggtccctcccggtcagcaccccatattacggccgtgtcactcatcaccaaaaagctcaaaatcatgtatctgacgtgggatgtttgatcggacgtcggaagaagttttctacacgaatgaaaaaataatttcataactcttcttaaaaccgtgagatgaatttttttagcctaattaatacgtcattagcatatgtgagttactgtagcacttatggctaattatggactaattagacttaaaagattcgtctcgcaattttcatgtaaactatgtaattactttttatttttatctatatttaatacatatgtttttggaaaaaaaattgataactaaaccagactaattcccctattttgttacctcattattctcgtattccccttttattaccgtacggatcctcctgcagtagactggcgcaattaaatctccatcttcttgctcgtacaacgtaaatactcgtctcgtattccccttttattaccgtacggatcctcctgcagtagactggcgcaattaaatctccatcttcttgctcgtacaacgtaaatactcgtactactactgccagtgtacagtaagaggaagagagtgatggagctagaggctggagtgcactggagcggatcgagccgagctcagctggaggagctggagctggagctcgacatgtataaaaatggggtccacggagatccagatctatccaacgctccacgcacccatcctcctcacatcaggcagcaaaaacaaaagcaaaattacttacagcaaaaacaaaaaatttcaccaaaaacaccctgaaagaaggctcaaaattacaatgcaaaaacattttcgcgaaaaacaccctggagaaattgtggcatcacctgtcactcccccggccccaacaaaagcaaggggcaagccaagtaaagaaaggagtagtatagatcgatagggatgcagcgcactagtacgagtactacttctactacatagccatagcttagcttcttgttctagctcggctgcgagcgagctcttcttcctctgggggaaaatggagctcttcctctgctcttcactgcctcagtggcgccgctcccactgatctctctctcgtcttcttcttctttgagcttgctttgctgcacactctagtggtggtaatagaacacagctcagcagcagcagcggagcaagaagccaagaagccaagaagcaacgagtgttgtggtaaagaaagcggaggaggaggacgaagaagctcgattgcttgcttgctgtggagctcgcca

SEQ ID NO: 41445 - DNA, 1501 bp, Oryza sativa
atatagctcataggctctatattactatcaaaatcattatgttttatttttctaagatagcataaatgcacactagaaataagacaaacccaattctgaaagaatgttttacctgcccaatcaacaaattacacaaacgccaatatgaacattacacggcgatacaacaacccatatatcaaccaaatgcagcattccaatttagatttcatcactggaacgatctaacttgcacatccatagaaatatccacgatagctagcaaacagtggcaccgcacgaaggaagggaacagccacagcaaaattttccccacagggaactaactcaccagatcgacttgccgctgccggtggccatgacgaccaagcaatcccggccttccaggaccttctgtatgatctcccgctggtacgaacggaaccccgagaagccgaaatacgtctgaaaaaaaaaaagcagaaacgccccagttcaagcatccagatagggttttagcccgcgggatcgcggggctagggtttattagggaatgggaacgccattagggcaacgagcacttgccttcagagctgcctccatcgtacgtggtatggggctcgcgcgcgcggtcgcgcccccgcgtcggcttcggcgaggggagttcgattgagcggcttcgggaagaagaaggcgaggcgaggcggctggggtggagtggaaggggaatgggaggacggaacggagcgatcgggaggtggtggcgaaatgggtggtgttttggtgtttttggccgggtagaacggaacggggagcgttgcggcgggtctttttattggacttcccgccatttcttccgtttccttttttttttccgcatggtcgcgattattccttaataataaaaagcctgtgaggcccagttttagcccattaggccttgtattctttttcgtgtggtcggattaagtttacttgtggtccctagttatcattgagttcgaattaaatccttgaaccgcaatagttgaagtgaaacccccatctttcaaaaccaggttaaataaaacaatatacgatgattgggccccacatgtcttttatttaacctgattttgagaaagtaggattcaacattactgatattacggttcaaggatatcatataactttgaacttcggattcaacattactaacaggcccaccgttggcacattaggcttcggcaaagccggccgtatcaatttatgttttggcaattattgttaaaatcttagttgtttgatttggactgatgctaccttggtttaaattttgtcgaaaataagcatatgttgagatacagctaccactgcagttttacagaccacacaaatatactacctacagaaatgtacatagacagatcagaaagttctaactggatacgttgtcgagcaaggcctctgtatgattttgggttcacaatgctaccctgaaaatagcaacgttagcaatgcacccagcaaacaagattagcta

SEQ ID NO: 41446 - DNA, 165 bp, Oryza sativa
tatctacgaactataccagctggacgccctcgacgtctctattatgagttgctggattttgtaagtatcgttcagttagatttcttattacgtttcctttaattaattaggtccttgtatataagtagactatatataatatatacttccttttatcgttgtaga

SEQ ID NO: 41447 - DNA, 380 bp, Oryza sativa
tttttccatggattcttgattatggtgttccttccataagatatcagataagtctggcctttcgtctatttgttctcctccagttcctatacctgtctgaaccaccgattgtacccctctttcggtggttgttctcctttcttcgttagtgttcctatcatttcctatgttccaaatctgaccatacagctcatgttcgttggacaacttgctgattacggttgccatgttattcttgctcttgactcgcgttgtgttcagggatcatagcacgggtctcctggttggtattggccctcgcttccattattcacagcatctttgggagcttgactgactgttttctttccttgcttctgctatagcatccttcactcagt

SEQ ID NO: 41448 - DNA, 262 bp, Oryza sativa
atgatgttaaattttgtcaaaaaattgttcagtttgttaaaatgctgctaaatttttgtagaaattccatcaaattcagaatatgtgccaattgttatgttagtcaatgtgggtcatttaaatgtccttttgccaagaatttaaattttcaaagcatgcataaaatgggggcaaaaccccaattaatgaatatagataggagagggtataaatgtccttttgctaaaaatttaacaccgttaacttttccatccaaaacagg

SEQ ID NO: 41449 - DNA, 226 bp, Oryza sativa
cactgaacctgaacacccacgaagtgacgtggcacacacggacctactaccaccaccattattggagatgccgcgtccccacccacctcccccgggcccacctgtcagccaatggctgccgtcttactaggagaaagcacacggttcgcgaagcgtacacacacttcgtgacttgtttccgtgagcgatcgacaggaggacatggcggagaaaccgccccaggcgt

SEQ ID NO: 41450 - DNA, 405 bp, Oryza sativa
gcagtagttcatcaatggtcgagtatgttcgctcgatcgatcgggatggctgctcgtttccttgttgctctgtaatggttcgaaactcatatatatataacacggaggagtatttcagaaaatttggtgttctctagatctctcgttcttgtattgaatgaggccttcttgcgactctgaacgtcgatctatatcccatatcctacgcctcatcttaactatgagtctagacacatattcttagttgtgaaagttatcttttttacagagagaggagtaatcgttgcgatcgatattgtcatactctgtgatgaagccaaccttactttttgtacattcggcgcttagaggaatattctttctatattttcctatgtgcgaccaatggcttttataatggttgaa

SEQ ID NO: 41451 - DNA, 358 bp, Oryza sativa
gctctcgtctcaccgaggattaaaagaaattgtggcgcgcgtgtggcttcgacgacggcgagaggtgagcggcgcgaggtagacgacgtaatggctcacgcactcttcggttcggtttggttttcttcggttcttcgagattctggttttttttttattcacaggagaaaaatataagccggattaatttctgttggaaaaaacaaagaaaaaccacgcaggcgttgctgcagtgcagagggaaggggatggaagtaaaagatggaagttgggaacggccaaggtgaagtacgacaagtctacaacctgagtttatctagtttttttttcccttgagtactctctcctccatttcata

SEQ ID NO: 41452 - DNA, 262 bp, Oryza sativa
atctatatctatatctatactaatataaaaaagaggagttatccctctccaatcctaccggccaaatcatctggaccaatcattaccgtccatccgcgcgcatgatttaaccaccgcatgatccatccacgtaaaacagcctcttacgcgcgggaggaataggcctctgcaccatgcaaaatttttgacaatttacccctttgcaaaaacttatttcgtaaatgaatcgcgcccaaaacttatttcaaaaataacccggagg

SEQ ID NO: 41453 - DNA, 1375 bp, Oryza sativa
gctctcgtctcaccgaggattaaaagaaattgtggcgcgcgtgtggcttcgacgacggcgagaggtgagcggcgcgaggtagacgacgtaatggctcacgcactcttcggttcggtttggttttcttcggttcttcgagattctggttttttttttattcacaggagaaaaatataagccggattaatttctgttggaaaaaacaaagaaaaaccacgcaggcgttgctgcagtgcagagggaaggggatggaagtaaaagatggaagttgggaacggccaaggtgaagtacgacaagtctacaacctgagtttatctagtttttttttcccttgagtactctctcctccatttcataggctgtgtttgcatccctatgttcccagcccatctccctcgttttccacacgcacgcttttcaaactactaaacgatacgttttttgcaaaaagtttctatacgaaagttgcttaaaaaatcaaattaatctatttttttaaaatagctaatcaaatttgcttaaaaaatcaaatttgcttaaaaaaatagctaatacttaattaatcacgcgctcccatcactagactccgaacacagcgtggagtactatacactttaattttttttctttaattaaattttaggcttgactaaaatttaggtcatcatcatcgattgctcatattctgtaataaatcaaaacggtttactagaaaataaaaataatttattaaaaattattaaaagtcaatacttaaaaagaaactacgttaaaaatatttaacatcttattcgttaaaaaaagttaagtgttttatagtattaattataaacgaagggagcacttaagaaagaaaactaaataaacgaaaaaaaatgttcaattattattccttatagtttttcggtttatttctgaccacctacaggacgcttccgtagattaatgacgttgaaactgtttcttaaacatgtaaaaggacatgcaaacacgtatgccacatgcgccacctacggcgtgctgcgtgcacggtctcacacatatgcttatcaagtgcgtcaaaattgatttgcaaattgcaacattcaaggacacgcacccccatttgtcccgttggcagtgacgtgatttcgcagcgttctatcgtaaatgccagaaaactagtaatttaattttgatctgattaatgtcaacgaaaaaaaatgtgtcttatgataaaaattttcttagcatatgtttggtttcgggactaagtgggatgggatgaaaccatccctgattttggagttgggatgattccactcacatgtttggtttgtaggatgggataattccaattttttgtttggttgaaaggatgaggaagagatggga

SEQ ID NO: 41454 - DNA, 1059 bp, Oryza sativa
ataggtgcttcgttttacgtgccggggaggacccctcctcccgaacacagcctaagtttaattgcttaaatctaatgtttctacttgttcctatttaatattgtaaattaagtacaaaaaaagtggaacagtagtgggaaatagtattatgcaagagttagtttgtaaaaaatctttaaaaaaagaacttaattttgtacttggtcaagaccagtttctgttgctatatttttaatcatttcacactagccgtgctttcatttttagttgtaaatcattttggaagttacctgtcttcacacaagtttctattgtttgatgatttatatacatttgtcataaaccatttatattttctgttaataagtaatgttgttgtttatttgtagtttcaaatcatttactagttacatccttatcttcacattagtttctattactgtattaagtaatttagtcctgatgaatcattttcggagttgcctaaccatgttgtcatgaattgatcccgtgtattcacggaatcaagttgaggggtgtatctccagggaatgacccacttgaaccacccaattatgtttagtgacctatagtgcaatttactcaatatttttaattcaaatggaaactgtgtctgttctttctcttctttcttttgtactcttaacaatatgtgttagtttttttattacaatgaatttcttgtgtgccatcaatcaagccctttttcgttgctttgtgaattacatttctctcagttttgtactgtacagaaaactgtttgtttatatgatactcttgatggatattgcagtttctgaggcttgcttatttgattggttatggagttgagatagaaaaaagtccagtcaacaggtactaatccagctcctctattagatatactaaattcaactttcctattggtcaattaccaattaataggttactttcctctctttttacatgtcactgaacagtgagacattgtatcttgattgtttcatgattcatcatcaatcttgcattcaaaatgatatgttttgttgtgtctgcagt

SEQ ID NO: 41455 - DNA, 408 bp, Oryza sativa
caattaaaaaagagccgcgaacaatgttaacccgacaggtctacgaacggagtgataaattctgattaaaaaagagctgcgaacaagtacttcctctatcccataaaaaaccaagagcggggcggccggtgcagtccacgggggaggtggagcgccacctctcctcctcctcttcctcctcatcgtcctcgtcgcaccacccacacatcagcctctagatctcgagagttggagtgaggcggaggcagagaaggccggaagggccggctcccacctatgagccatcaacgacgccgtctggcctatgcttcgtctccggggccccccactctagcacacgccctcccaaagtttgccactcccatcttcgcgtttagtgctgccacccaccgcgctcccgtatctagc

SEQ ID NO: 41456 - DNA, 942 bp, Oryza sativa
ataataaagaagttgtacattcatgacccccactaactaaaccgggctcggatcttgcaataaataattctagcaatctgttatgagagtttaaagctaaaagtttgacttcgaattgttagcataaattcagcctgtttaaaaaatagacaggagaacttgtactgtgcagacagtacttttctctcactaacaggatttgctttaaacctaccaatatagcacaagcgcacaattgcgtttcttttcaggggaggaaattgtgctccatgtctttctttttttttctcatgggcataattaagtggagtcttgtggtagagagaggcgttggccccccaagctttaccttgtcaaagttagaaagcgagggtttgtttgttggtacggtatggttggtggggaaaactcctcccacttgaattattaacgcagcttgagccttgagatgcatgtgaacgtgatagagctctttgctttacgtggctgtggctaatgtactcgcgatgtgaccgtaaactcaagaaattcatactccagctgtcccaaaagttccctggaaacatctcacttcggactactgacttttataacttgtgcgtatggcttaataactgatcaccacgtcactgaataagaataaccaagtggaaattctgagcagactctgagcttcttcatgtgttgaatagtagtgatactaatccggggtcaaccatgtttgcgactcaggcaacttttttcttcaaactttcaattttttcgtcacatcgaacatcacatcgttctaattcctttaaaccttcaattttaacgtggaactaaacacagtctcacaaaccttcaattttaacgtagaactaaacacagcctcacaatagcaaaagctgaatcatttcacccacaaggcacgaaaatggccaaatgtgttccccggtcaca

SEQ ID NO: 41457 - DNA, 195 bp, Oryza sativa
acagatacagattaaatacagtcgtgaccgactaagtttcaaggtgtttccttgatatacaagttaggaaacaaacccaggatacacataagatattctatctatattcggtatcctatattcagtccaaatatcatcgccgtgtagatatgggatatccataatctccacagtagcccccgagacctttgcagt

SEQ ID NO: 41458 - DNA, 1501 bp, Oryza sativa
aagaagatcttatttgttttgcttaaagatatgatcaacaaaaacaattctaatgatgagaagcacaaaaaagttgttgggatcaaggcagaaaaatcagatgatgagaaacaactaatcaataagctcagagaatacctaacaagtagaaggtgggcacaaaaataattggttctctttcatttactttcctgttaaagtcttcatcttaaatttttcaagtcgtttccatttgttgaggtccctttttcctttgctgtacaatttgatacaagccaattcaaaacccatgtaaatagaatcattactcatatttgtaattaattgttaaacttgataatataagactttgatgcacttgaccaaaatttcttaagaactgtttttgccttgtacatatttcttactaccattagaaattcaaccctcacaatgaaaatgttcatgttgttttggcatcatttggataatatatagtacttttctttgagaggatttgacaggtagctacttatacttttgcacatttagtattgaatttgttctccagaagcagtatactatgtttgcactgtatctcttcagtaaatttcatgttatttttaccaatatctgccttgttaaacttgactaattcactataacatctacataggtacttagtcgctgttgatgatatttgtgtaagatcaaagtgtgttttgattcttattctgtgatgaacaattggcatatgtgattattggttttgatatttggagattatcgtcgaagtggttttggagataatcaattttcaggtgatgattggattcactgttattttatgtgaccggtccgatcgggcggaggttgccggtcagaccggcgctatgtgtgcagtcagaccggctggcccgcggtctgaccggccgacactgtgtcggtttcggtttcgggttgtttatttggatatccgagtttatttcgtgattatgacttctaggtggatactatacgtatgtaatactattgtttgctgctaatgagtcaagttggagatagcttggtctcggaatatggtttctttgtttgttccatgtgtaggtgacttgatgtctcgggagagtatttgcggtgatggaccgggagtcggcttggggataagatgacgtctgtggtggtcagagatcatgcgggatacttaggctagaattgatgcacgtggttgatggagattccatatggcatatgatggaggtattgtgtgcatatgggatgcggagtcgaatttggaaggagtccaaatttggtacgattggttatgtaaagtttgtttcttgtactagagggtttcctaaggtgtttaggactcttagtatgagtttggttcgtggctttaggctgcctaccttatgtataaatagagggggagcgtgaggcttctcggaatcgcttttaagagcgtggagttgatagtttagttagggtttcgagtttagtcgagatttttgtaaggagt

SEQ ID NO: 41459 - DNA, 1501 bp, Oryza sativa
gggtatggggtacccataatatccacagtagcccctgagaccttcgcagtcgaaaagataatcttctctcgaaccagattactccaaagccgagtgcttcaatcatctttgtcatggtctcccgagtacttttatcaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgattggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctc

SEQ ID NO: 41460 - DNA, 265 bp, Oryza sativa
cccccccccccccccaaaaaaaaaaacaccctccctaaaagaacaagaagaaacgcaagtgaaattgtcagccataatcagcggcacaaactcaagtgatgagggtctctaccagactaccaatggcaagcgatcgtataatcgtttctttgcgatttttttttttaaaaaaatatggttgaactgatcgactcgaaggtttcaaaatgatctgaaattttctgcggaattatatgctctttgcaatgtttggtatgattccaga

SEQ ID NO: 41461 - DNA, 864 bp, Oryza sativa
catgtatagagtatttcttgttgaaatagtcccatattgagttgtagaaaggcaagagacctaatatataagtgggagagccctcacctcattgtttagttttttttaagaaaagactatttatgactctataattggtattacagtctgattagttcaatatctctgatccgaaaataaagtgtgtgaagaattgatggaccatcggtggctgccggcctcgtatagtgtatagttgagagagaccgtggggatatacagccaaggtgcggtgaacggcaaagcctaaaatggttgaatgcctgatgattcgacagatgatactctctgacgctatcttgaaatcctgacgtgcatgcctaaccaccaaccactctgataatactcgatctccatttttgctatcgattccattctacgcgacgcctcctccttcttcctcctcgtacacatcaccaccaccacctcggttaatcccttttccggagtgatccaagctttggcattgccgtaccgttaccgtacgtgcaccccacgtcacgtcaccttctctctctccatctcaccaccaccaccaccgtcctcaccgcactacaaccaccacagtcacaccgaaacctttgggcttttggcaggaggatcaaggtgaggtgagcttcttggtcatcaatagttatctcctgggaggtttttctttatttggtctctcctcttttgtattccacgtgtactctattctcatataatctagagcttctgcgcttgcgtaggtgaagcctgccccgtgtaagatcatttggctcaataatatattcaggtagggattctctacccccggtgatttagtaaaaaaaaataaaaagg

SEQ ID NO: 41462 - DNA, 248 bp, Oryza sativa
aaatctgagttgatttcctcatctccttcgcctagaaattcatcagcaaatgaacagggctgtgaaggagacaacattgggaagctaaaagtggaatgtgatgtgagcttgccacagcatgcagggccatcaaatgaagttgagaagtcatctctgagaagagtgaaaaaagtggtgtaggtttggttggaaaggagctgcaccgggaggatgttaatatgctgtcttaaacaacttgttgtcacagg

SEQ ID NO: 41463 - DNA, 170 bp, Oryza sativa
catttgcaagctgcaccagcattttatcagccttcaatatgctatattactgggtctcttgctgagttgataacttcaacgtgttattgacatgcattacagcatttttcctcaaaatagaattttctgtgatagtgtgatggcttaatatgtcctgtttcaattccaga

SEQ ID NO: 41464 - DNA, 193 bp, Oryza sativa
attcctgcagcccctccgggtgattttttttcctttagtgggacccaccttaattacacacattgtggtggtttctaaaactatggactcccatgtgtgggtaccacatctatggactagtttgccaaatacattggtgttgccctaattgaaagaggaaaaaggtagtacaagggcatatataaatatatga

SEQ ID NO: 41465 - DNA, 1501 bp, Oryza sativa
gtagttgactatactattgaacttgctctcatgtggtagtactgtagtagctagtaactgatcaccgattaaattcctattaagtactcccttcatattttaatatatgatatcgttgactttttaaccaacgtttgaccactcgtcttattcaaaaattttatgcaaatataaaaatacttatgtcatgcttaaagaacatttgatgataaatcaagtcacaataaaataaattataattacataaattttttgaataagacgaaaagttaaacgtttgtcaaaaaaattaacagcgtcatatattaaaatacggaggaagtatcaaggactcctctttcgatcagagacaaatggtcatggttttgatatatgtcgctgtcaccagttaaccacttgcaattgcaaagcgagctagcaggtgggggaagtgtggctaattgacaataaatcacgaaaaaaaattaacaagtgacgatcccttgatggtcaagctagcctcgcacaggccgggctatgcatacatgtctcactgatcgatatgggtatggtgtgcatgcgaatgggaggaagaaaaatctatgcgatggggcttgaaaccaaatctccagtcccaaggcctcatcttatattctcgccacctagtataaaaaatcatggtactttgtttaaactattataaaactacaaaatttaaaaccatgtatcacaaaactaaaatgttatcatataattatatatttaagaccaaatatcgtataactaaaattttatcattagcaccactgttatattgaatgttatatttcctggttaaatttacactagatctttagttccgtaatttgtttttactaaatactctctccgtttcacaatgtaagtcattctagtattttatatatatatatatatatatatatatatatatatatatatatatatatatatatatatatatatatatatatatatatatagattcattaacattaatatgaatataggaaatgataaaatgacttatattgtgaaacggagggagtatgttgttttaatttgtgttgaatctatagtttcataacaaatttgatactaaatctatatttttatggtacatcaattttaatacgtaatttttaccatagtttcttcaaagtagatgttgttttataaatcgtgggaagcggaagcgcatgcagcggccgcttgccgttgttatgaacggatacgatacgtgtaccactttgtgtgtgtataaattgatagcagcgtgcctctcttcttcttcactgtggtcacctgcagtttgccccacagccattccaagcacatattccctgcaccctgctagctaccttgagttgcaattcatccttttggcagtaaagttcttagtaatattacccagttgctacgtagcagctcgctgaagaacaaaggaaccaatcccacctatctgaatccacacataaacagtagattcttgttctcgcttgga

SEQ ID NO: 41466 - DNA, 1501 bp, Oryza sativa
ccgcctggcgcccaggctgtacagcgcctggacgtgccgcgtgtagttggacagcaggtcggcgtagaaggacggcacctggctcgccgtccggttgctctgcctcaggaacgcgaacaggtcgttgccgccgtcgctgatgaggaagagagacttggacagcagatcgtcgatcgccgacgccgacgccgacgagctgttgccatcgccgccgccgttcgacatcatctttgacttggtggccgcgaagtacacgatttgctttgtcagcgtgacgacggttgtcccctgatcgatcgacgagtacacgaagataatcagacacacatgtaccaagatcggtcgcattcattcaactatacactcactcaaatactatattaaccaattattgagtacaagaaaaggctaccagtagtaaattccttgcacagtttctacaagaagatgaaattttcttgctgtatccaagcatgtccttacagtggtatcgagaatgccggatcctccagaagcgtaattggcgccgcggtagcctcgcatgagctgacggctcgtctgcggcgtcagcgacaggtaagccggcgggctcctcttgaatcccaccagtttcgctgaaccaattgttcatccatgcacacacatcgtgagttccattattagcagaaattttacattgctccaaacaatttgaggcgaaatatgcacggaccgatgaagtcggcgacgttgtagccattgctgaaccttccggtgggcctcgagtgcgggaagtcgatgccgtaggggagctgcagcggcgagttccccggcaggtactggttgttcccgacgtccaccgtcgagtcgccgaacacgtacaccgccggcaccaggtgcacctcctccctctggccggcggccgccgccgccgccgagatatgcacgccggcgctgagaacaaatgctaccaccagtatcgtcactttcagcctcatcatagcgcctgcagaggtaggctgtagctatccaagcgagaacaagaatctactgtttatgtgtggattcagataggtgggattggttcctttgttcttcagcgagctgctacgtagcaactgggtaatattactaagaactttactgccaaaaggatgaattgcaactcaaggtagctagcagggtgcagggaatatgtgcttggaatggctgtggggcaaactgcaggtgaccacagtgaagaagaagagaggcacgctgctatcaatttatacacacacaaagtggtacacgtatcgtatccgttcataacaacggcaagcggccgctgcatgcgcttccgcttcccacgatttataaaacaacatctactttgaagaaactatggtaaaaattacgtattaaaattgatgtaccataaaaatatagatttagtatcaaatttgttatgaaactatagattcaacacaaattaaaacaacatactccctccgtttcacaatataagtcattttatcatttc

SEQ ID NO: 41467 - DNA, 1501 bp, Oryza sativa
atggctgtggggcaaactgcaggtgaccacagtgaagaagaagagaggcacgctgctatcaatttatacacacacaaagtggtacacgtatcgtatccgttcataacaacggcaagcggccgctgcatgcgcttccgcttcccacgatttataaaacaacatctactttgaagaaactatggtaaaaattacgtattaaaattgatgtaccataaaaatatagatttagtatcaaatttgttatgaaactatagattcaacacaaattaaaacaacatactccctccgtttcacaatataagtcattttatcatttcctatattcatattaatgttaatgaatctatatatatatatatatatatatatatatatatatatatatatatatatatatatatatatatatatatatatatatatataaaatactagaatgacttacattgtgaaacggagagagtatttagtaaaaacaaattacggaactaaagatctagtgtaaatttaaccaggaaatataacattcaatataacagtggtgctaatgataaaattttagttatacgatatttggtcttaaatatataattatatgataacattttagttttgtgatacatggttttaaattttgtagttttataatagtttaaacaaagtaccatgattttttatactaggtggcgagaatataagatgaggccttgggactggagatttggtttcaagccccatcgcatagatttttcttcctcccattcgcatgcacaccatacccatatcgatcagtgagacatgtatgcatagcccggcctgtgcgaggctagcttgaccatcaagggatcgtcacttgttaattttttttcgtgatttattgtcaattagccacacttcccccacctgctagctcgctttgcaattgcaagtggttaactggtgacagcgacatatatcaaaaccatgaccatttgtctctgatcgaaagaggagtccttgatacttcctccgtattttaatatatgacgctgttaatttttttgacaaacgtttaacttttcgtcttattcaaaaaatttatgtaattataatttattttattgtgacttgatttatcatcaaatgttctttaagcatgacataagtatttttatatttgcataaaatttttgaataagacgagtggtcaaacgttggttaaaaagtcaacgatatcatatattaaaatatgaagggagtacttaataggaatttaatcggtgatcagttactagctactacagtactaccacatgagagcaagttcaatagtatagtcaactactagctccaattcatttatagccaatctaatagctcattcatacaatagttacatactactccctccgtttcataatgtaagtcattctagcatttcccacatctatatatctagattcactaatttccatataaatgtgagaaatgttagaatgacttatattatgaaacgaaggaa

SEQ ID NO: 41468 - DNA, 1249 bp, Oryza sativa
atcacatcagcggcagattttccaaacctcgatcccatttcacgacatcaatttcacaaagcagtagtcaaacaaaactacgctaggaatcacctcacatccgcccactaccgtgggcacgactgttcgaacagtttaataacctctgcagagggggtacactttacccacacgacattactaacccggatcacccagcccgtgcagaacggccacgtctggagaccttgaggctttcatgacaaggcatttcgaaagccgacacaggtttaccatatgccaatgagaggggtcccagaccaacaccaggttaggtcccagaccatactgtgccaggaagcccgggggttctccccgacaccaccccgttgaatccacatgtctcttggcatcatggctcccctgattagctaattactcagccaggggcgtcccattacacccatgtggtcgcacttgccttatgttcggatgaaattccaaggaaacggtccttaggtgcaagagcgggaaaccgtacgcccggtatgttccccggtccgcgattttagaaattcatttagttcgcaagcaccgatccatgtgtcgggttttccaagtcttttgtaaaacctcaagttttacccatcgttggatattttaaattcgaggggaggtgttccgatgcccgtgctcgaaggcccgtgcatcgaagcacatcagtcgacaaagggggtttaagtgttcaataattcaaggagggtaattgcagcaattaggattgggaccgacatgctatctcacaagccgcggccgaaatacttgtgttaaacctattcatgcaatacttgcaaaaaagaaatacttagatttaaactataggtgcaagatgatcaaaggtgacttgccttgctcgagatcttgagcttgatcctcgaaatctgcgcactcagggtcttcgggctccgaagctacacacgaatgagacgactcaacaacggcgaaaataaagccctattattgacctctaagcgtgccatttggtagatctcgagatttgagaaattttggaagttgaacggagtcaaacagatgtacggttgagaagatattgaatttctaagattattggatttttggtctaaaggaaaaaagatttaattaaaccattttggaaaaaagaaaagaaagagggaggggaattaaacttccctcgggcggctagggcgcggcccgagagaaaaggggcggctcggccgagctaaatggg

SEQ ID NO: 41469 - DNA, 1501 bp, Oryza sativa
gatcaaccagattcactgtgattagtctcacccctagtttagcttaatgaactggtgtagttcaggtggttggttgggcctgttgcaacgtggtgtagcgttggacagtgattggttaatattgattaattactacagctgttttactgctttcaactactgctttgaaatgactgctttatgcaaaagaacccctagcttcctttggttatatcctgcatcatacctcctcttccggtatgacttgctgagtacagtgggtagttgtcatatcctgattttttgtttcaggatttataaattatttaataaattattattagaatttatattaaatgttcatcaatttacaagtgaagttaaatgtgggaaataaaatttcctaaatataaagcatggatggatttaatttttattaaattctccatgataaagtcaactctctgaaattttctcggatttttcagagctcaattcataaatgatacaaagaacagttcagtaattatttgatcaataatgatctaattataattgttaagagcttttcttgtttaaaaatccttaaattataaattgttgtttaaaaggaataattagaaatgatcttaaaagagaagatctaattttaatttgctaaatctcaatataaaattgggttagataaaattttattaaatactttacttgattctatagttcctagatttttctgggatttatttgagccaaggaagtatttttaatcaatggaatatcatttcatgaataatttaaatagaaaatgtttttaaatcctccttttggctttgggccgaaagccggcccaaaacctctctctttctctctctctccccggcccaagtcggcccagtccgcaaccgagccgccgctctcctctctctctcccgctgacaggtgggccccacctgtcgggcccgtcttcctcctcgcgccgctgccggccgaaaccctagccgccgccgctttccaatccggtcgatcctttctgtttccggtgaaatcgtttgaggggaaataatctcctcgatctcctcttccttttctcttatagaaacttcggtcaatttcgtttggaaatcgacggatttgagctcgattcggatcgacttttctccctccaaccctagctttccttctcgccgccggtcgctgtgggcctccgtcgccgctcgctagcccctttataagcacccccgagctctcctttatccgccgccacctttgccttagcccgccgtcccgtctagcgccgcctccgcgtagccctagccgtcgctgtcgttgccgtcggttcagccgcgccgcgccgccgttgcagccaccgtcgtcggtcgccgtcgccaccatcgggatcgcgaggtcgtcgccgtccccgtccacctcttcgccgccgcagaagaccgccggagcaccgccgtcaccgtcgacccgaagaccgtcgcctcttcttcctcgtcaccggcgccgtccgttgctc

SEQ ID NO: 41470 - DNA, 918 bp, Oryza sativa
cccacgctggcttgtggttggcatggttaatgtttcacaacagtagctcgcgaaccggtctttaattgtcatgagcgcgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagaaaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattgtgacttcatatgaatttattatgaattttacaagattaaatcggattaaaacacttatatggattttaattgaattatgacgcaataatgaattatttttgaaaaggaaaagggaattattgcgtcatcaaaggcggtccgggagcacgggacggtctaaggaaacgaacggccgagatcgattctatccaaaacgggcggccgagatcaacttgatctaccgcggttcacgggacaaggcgacga

SEQ ID NO: 41471 - DNA, 1501 bp, Oryza sativa
atttttccccctcccccaagtgaccgagcgccaactcggtaactgtcgaaactagatttcggcaataataaaagggggtggctatcaagctggaaaagtgtatgggtttggagacaaaggatttatacaggttcaggccttcttataaaagaagtaacaccctactcctgtccggggatgaatccgccgagtgtattattgattgtatgatttgggaaaatcaacatatgcccctagaggcgcccggaccccccttatatatgggaaggagtccaggttacaaaagataatctatatccttaacggaatacacagatacagatcaaatacagtcgtgaccgactaagtctcagggtatttccttgatgcacaagttgagaaacaaacccgagatacacataaaatattctatctatattcggtatcctatattcagcccaaatatcatcgccgtgtagatatgggatatccataatctccacagtagcccccgagacctttgcagtcaaccatcatagcctgctcaaagacaataatccgagtgcttcaaacttttcatgccaaggcctgccgagtagtgaagacgaagactgtaaagggcgaaaagataaagaatatggtgcatcgaatagatgcacctaattaggtatagcccccaactatgtgattagtcaacaaactaaacatatagttgagaacaaaataatagcacaatcatgcatcatatgacaaaagcatacgcggcacccaaagaggcattctagccgactgctttttagtcacaataaaaggaatccgagtggttaacactctaaaaagttcacgaatgaacacacttgacaggcatccgaatataagactctaaagattacccaccaaatatcataaaaatcatggtaatgaataagtctaatagcctaggctatgactatttaccataatgaaaacaggcatataacataccgaggaaatgactatgataaaaacaagtcattccaagttaacccagacagcttttgtagcctaaaaaaggtacaaaaacagcataacgcctttctgtcgggcaccttttaatttgcatcgcaataattccaaagaattatatgaccgcgtaaaaaggattttatcagcattgggcaacactattgtgtacataaattgccaaagcaaagaatgcctaagtccctaaggaacacaatgggccacgctgttaaaagtattgggctgaggtactgttcaggcctaggcccattctcacctccgatacccttaacaagaaaacccgagatccaaacgacgcttcgtcttccccgccggaactctcgccattttccccactccttgctacagtacagagctgcgccggcaaactagggttcaccattccactcaaatccaccttcaaaaagtgatcaaaatccttcccgtgatccaccgcctcaattcctcacctctcccaagccatccctcgaatcaaatcagcgcattcggggaaaatcga

SEQ ID NO: 41472 - DNA, 1317 bp, Oryza sativa
ggacatcactacttgtaggagtgagactggggtgatactttgatcaaattagtcctatcttgatacaattccaatccagaaaaaacccagtacctgatgttttaacttttcagtgagtgaaagatttgtatctgggtttacgttcaaagcttataccatataacaaatttgatactcctgtcttaagctggaactaatgtttctgcattgcgtttatgtgattatggccatggcaactatgatgcaatattcaaataggcacatggaaggaagcatgggacaaccaatctccaggagtggcactatttggagtcgaaaacgaaggtgaaaattaaatccagcaaaacttgagcttacaggactgaacttttttaatggtatgaatgcatgtcagtccccacaccccccccccccccaaaaaaaaaatacaaacaaaaacttagacttctagtagtatcatatggtgaatcatcgctaattctttctctgtttctgccaacaagtcactcaattatgctctcttctaaagtgtagttcatcagatgtggaccaggtacaacaactaccaagacaaataatcaaagtaaaagtagaaggcaaaactactattctttcagaaatgcaaatcaaatttctgctgtgaaaagactcataaatggagaatgtgcattaatttaataataatctgtttaattaaagacagcaaataggctggggaacagcctgaaatttctaacagtgggaacacacctatttcttgcaaaaaagaaataggaatgaacaggaaagtaaatgcaaatgaaaagagttagagcatataaaaaacaagtatcttgtggtattcactggaacatgcaggaaatagtttgctgatatgacaaatttcattaaaaaaaacaaaggcgtggcttcaaacctaagtcataaaaagatcccggaacagggattttgaaaaatatggtatgaagggggaaatacctcttcaaaacgtttgttcaaagtatggaatgcgttccattagtttccgggatgatagtccggaacaatatcagaaattagaagccaagggcttataaatatgagcattccattgttatgcatacaataagcttaaatgaatatatatgaaattttatggcttatatgaaagaaatcaattcaataaagaactgttcataatattcagagtccaagagcaaaaatgaaataagatgaatcccttatccactcacagtcttatcccatcgatggaaagaatccatcccatcgttctcagccactcagcgtgatagcgacgatggagatggcactccccca

SEQ ID NO: 41473 - DNA, 769 bp, Oryza sativa
taaaaaacacgttagaaagaaaaaatcacgaaagggaaccaaatcgtgacttaagaaaccttggttctcataacagttcagctagcacgtattgacaacgatttgcctatagaactagctagatttttctcacggtactaggtgtaagaatgaaagaacatttaggaggcagaacataaatgaaaatagccccttgctagcatcaaaccattgaccgattgtatcacggcggtgatcaacgataacagtaaagaacaaaatgcctacctactcactctcaggatagagcagcagctatattttgtgactttgggtgaaaacaaatgaaaccgatatgcatgggaattaacgtggactattacgcatatatgaattttattgaggcagcaatgcttaatgtttttaacttctaaattgatatttccgcgaccaggccttcaaatatgaaaattttaacttcatgttacgcggagcgtcttgctccggtgacaaggtaagattgaattaacaatgatatggcaaatggtcccatcgatacttacattttgaatagtggatttataaccgctataggttgggcgtgttttatatggtgtaggattacgttatagggtatatactatttgccaaatgcgttttgactttgttctgatcgaaatgaaaagattgacctgcttaacacactccgttcacgtcgagtagccatagtagcttagaactgaatgtaggcacacatcgtaaagttgtaaatgcaaccatagtagacggt

SEQ ID NO: 41474 - DNA, 400 bp, Oryza sativa
acgtgaacggagtgtgttaagaaggtcattcttttcattttggattagaacaaagtcaaaacgcatgtggcaattagtatatacctaccaaggtaatcttacaccatataaaccatgcccaacctatagcggttataatccactattcaaaatgtaaggatcgatggacaatttgtcatatcattgttaattcaatctaaccttgtcacgaaaacaatacgctctgcgtaacatgaagttaaaattttcatatttgaaggccgggtcagggaaatatcaattattaagttaaaaacattaagcattcctgcctcaatgaaattcatatatgcttaatagtccacgttaaatcccagcatatcggtttcatttgttttcacctaaagtcacaaaatatagt

SEQ ID NO: 41475 - DNA, 556 bp, Oryza sativa
tccattagttaagacattccgtgacaaaaatcttattatagcctttaagaacgtcatcgattttatgaccactttggagaaaaatctgaaagattagcttgcatttattttgtcgaggagttaaaaaacacgttagaaagataaaatcacaaaagaaaatgaaatcgtgacttagaagacattgtttctcataacagttcagctaacacgtattggcaacaatttgcctatagaactagctagatttttctcacggtcctagatgtaagaatgaaatgtcatttaggaggcagaacataaatgaaaatagccccttgctagcatcaaaccatggaccgattgtatcacggcggtcatcaacgataccagtaaaaaacgaaatgcctacctattcactctcaggatagagcagcagctatattttgtgactttaggtgaaaacaaatgaaaccgatatgcatgggatttaatgtggactattaagcatatatgaattttatttaggcagcaatgcttaatgtttttaacttataaattgatatttccgcgacccagc

SEQ ID NO: 41476 - DNA, 889 bp, Oryza sativa
tccattagttaagacattccgtgacaaaaatcttattatagcctttaagaacgtcatcgattttatgaccactttggagaaaaatctgaaagattagcttgcatttattttgtcgaggagttaaaaaacacgttagaaagataaaatcacaaaagaaaatgaaatcgtgacttagaagacattgtttctcataacagttcagctaacacgtattggcaacaatttgcctatagaactagctagatttttctcacggtcctagatgtaagaatgaaatgtcatttaggaggcagaacataaatgaaaatagccccttgctagcatcaaaccatggaccgattgtatcacggcggtcatcaacgataccagtaaaaaacgaaatgcctacctattcactctcaggatagagcagcagctatattttgtgactttaggtgaaaacaaatgaaaccgatatgcatgggatttaatgtggactattaagcatatatgaattttatttaggcagcaatgcttaatgtttttaacttataaattgatatttccgcgacccagccttcaaatatgaaaatttaacttcatgttacgcggagcgtcttgtttcggtgacaaggtaagattgaattaacaatgatatggcaaatggtcccatcgatacttacattttgaatagtggatttataaccgctataggttgggcatgttttatatggtgtaggattacgttatagggtatatactatttgccaaatgcgttttgactctgttctgatcgaaatgaaaagattgacctgcttaacacactccgttcacgtcgtgtagccatagtagcttagaaccgaatgtagggacacattgtaaagttgtaaatacaaccatagtagacggt

SEQ ID NO: 41477 - DNA, 838 bp, Oryza sativa
gtcttttggcatttcaactcctcgacttccacgatatgaccaagagtccaacatatcatttgctagcttgaagctataaagcataccatatggaatatcgcttggaatgcctaatttttatctcccttgttggggttaaaacaactagtaccaccagttttttaattatctaatttaacctaaccaccaaaaaaaatcagagggttaaaatagcaccatctaccattacatgttaccaattgaaaatcattcttgagctaagcgagatatcttgttcaacaatccaatatatccagagaaatcattcacttctatgtaaaaaaaaccgtactactattactgaatcttatttataagatcaagtgactattaagtctcgagtgcaattatcgtgaaaagcttacttttaagtaagtcttcaattctattccataaatcaaattaaacttacataaaatacatttatagtcaagatatcacatatagccaaaaaccttaaatatatattggtggccaagcgacaccacccattttagtgatatgtatcatgcgagtatgtgacagacctcttacgtaactattgtcatatgttttgattgcacgatgtcgtcttttggcatttcaactcctcgactttcgcgatatgaccaaaagttcaagatatcatttgctagcttgaagctatatagcataccatatagaatatcgctttgaatgcctatttgtagtatcattattggggttaaaacaactagtacgatcagtattttcgttatctaatttaatcaaaacaaaaaaaatatgtttgagaaggtcaaaatagcaacatctaaatgta

SEQ ID NO: 41478 - DNA, 275 bp, Oryza sativa
ttcgtgccttcgtagacacctgcgaaaagtttggaccaagcagccggtctttctgtcacatcggtacgtgttcaatatgttgcgcatatttgatctgtttatgttacactgaatagtttacatatgtagatctaatgatgcgttcatgctagttttcatctgtaatgtcatgatttatttatggaataaattaaatcattatattaacgtgacataagcatacatgacatcaatcagggaatcccatcttgcgtcacacttccatttcaccttca

SEQ ID NO: 41479 - DNA, 348 bp, Oryza sativa
gagtaggactgcagcgttgagaggtcgctgcagccagcgcttacgctactcatggtgaaattggtgatagcgtgggccttgataacaattagtagcaaagcttgcttcgaccgattaggtgagatagccactcggttgttactttgttgcctgctcaatctagtattctagtttcgatttgacatgctagatatggatggagttctttttctcttatccagatgttttctcccatgtttttgtgttgcttggtcattcctgatcgattaagtgcagctgtgtgacccgtgcaggcattcaaccccagattttcgagcaagagctcacttgaagatagataggtcaata

SEQ ID NO: 41480 - DNA, 413 bp, Oryza sativa
tcatcacatccaataggtaaggaacgtccaggattaattgtctctgctccctccttttagctatttgaacatgaaatgttttctcgttttctttatctcaactttctcaaatttaagagaaatcaaatgtagtttataaacaaaatgcacacatacttcactcaataatattttgcacaattgtacatagcactgacaaatgagctagtgagtttaacttttccctgtgtttgggaataatgcatccactgagtcaaaagaaaaaaactaaactactactccaaaatcttcccgtaaatcagtgtgaagcttctattctttgcatataccaattgaaagtgtagagcatttcattgcagtctggtacaaggatcacttgctcagaacataactgtttcgatgcctcatgtttg

SEQ ID NO: 41481 - DNA, 298 bp, Oryza sativa
ttcaaaagtggattaacacgatttattatgacctggactagactagattttttttagaacaggcagattacaatgcattgttgtttcattgtatcgacctacaaatgaccaatcgtgctgcctgcaacttaattttgtttggtctttcatggaagacagtaacaaaagctaatcttatgaactcatgcaacattactggctgatgcatcaactttactcccaatcatctttttccgttccctacttcatgttattcacctacattggtcttactggcatgcctgaacttccctgcaga

SEQ ID NO: 41482 - DNA, 384 bp, Oryza sativa
tcctgcagccctctgatgatgatggaagatcaatttgtacaatactgatgaatttatgctgtgctagatatttcaaagttagcctctgatttcttaaaagcttttgtcaaaccttattgagtctaaaactcgcaaaagttcttaaaaaactttcagtcctcattgtgtaagccaaaaaatcaagcatggcaatgataaatcaagtaagcaaattgaattgataaaaatcatgttccattattattatagtagccccccgactgaaaacttcaaggaaaaacttgaagttagcagtcaaagaggaaagatacaaacgaaatgcctaagcacaaaattgacgaaggtgttcaatatttcaaagagatgagtgtaaccaccgactgc

SEQ ID NO: 41483 - DNA, 1501 bp, Oryza sativa
tggcatagtggggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaattatagcatcatttaccatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggctggcacggttaatgtttcacaaccgaaactcgtgaaccggtcttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaaaagtgagctaatgtttctaagcagggctaagcaattatatctaatatctagttgaaccaatatataaagctcaactagtcaagttataattacccaaggtatcaagaaataaagtaaacaagaacaaaaggggctataacaaagaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttaaagattaaatcggattaaaacacttatatcgatttaaattgaattatgacgcaataatgaattatttttgaaaaggaaaagaaggtttattgcgtcagcgggctagggtttcggtggaccgggcgcacgggcggcggttcacgcgaacggacggccgagatcgaaccaatccaagatggacggccgagatcgatcgggtccacggcggctcacggcggacgaccccga

SEQ ID NO: 41484 - DNA, 154 bp, Oryza sativa
cactccccacatcggcggccaaataggggccattcccggccgtttccgcccctccttcgaccataaaaacctgcccccgagtcccctctctcgtttcacccatttgccgtcccctcccgtgccttctaccgagcccgggccgctcgccgctagc

SEQ ID NO: 41485 - DNA, 1501 bp, Oryza sativa
gtatcatggtgatactttggagcatggcgacatgtgtgggatcgtgtcttgtgggtacagttgtacacctctggccagagtaaaactattcgaatagccgtgcccgcggttatgggcgatcaaccagattcaccgtgattagtctcacccctagtctagcttaatgaactggtgtagttcaggtggttggttgggcctgttgcaacgtggtgtagcgttggacagtgattggttaatattgattaattactacagctattttactgctttcaactactgctttgaaatgtctgctttatgcaaaagaacccctagcttcctttggttatatcctgcatcatacctcctcttccggtatgacttgctgagtacagtgggtagtactcagtcttgctctcttttcccccacaccagagttgaagtttttctcagttggagatgtcttgaagaggtgggtttcgtcgctgccgtcaagggttgcctatggaatggaatcgcccgctgcaggagtcaagtcttcaggcttagctcgcttttaccttttccgctgcatttgtaatcctttatgtttttgtaagacgtggatctgtatgtcaacaattgtcgtttgtgtaccctggctggtcctggacaggggtttaatacacattcagcttagaaattctggttcgtgaatttctgggcgtgacaaacgtgaatgaacgaacgtgaacgaacgaacgaacgtaaacgagaacgtgaacgtgaacgaacaaacaaacgtgaacgagaatgtgaacgtgaacgaacgaacgaacgtgaacgagaacgtgaacgaacgtgaacgagaacgtgaacgaacgaacgaacgtgaacgaacatgaacatgaacgaacgtgaacttaacgttgtatttgaacgtacataaacgaacgaacgtgcgtgaacgaaaagtgaacttaacaagaacgcgaacattatttaacatacgttaacgtgaacgcacgtgaacgaacgaacgtaggtgaatgaaacgtgaacttaacgagaacgcgaacgtgaacgatcatgaacgaaacatgaacttaacgagaacgcgaacgtgaaatacaatatatgttactttgcgtttatcctaatacatctttttgtatgttgcagaaaagacgttgtcgtcgtcgtccctcaagtcggagtggtagctagccctcgaaggaattcgcgcaggcaagtgatgtaaatatatgattgttagatttttaatgcaattaagactattagatttaatatacgacacttagacttagcatagttgataattacagttttaatacaatattatttgagttttagtataagattattatagttttaatataagattattagatttgtaattagacttagcatatacgacagttagacttagcatatatgacttagcatatatgattgttagcatataagattgttaaagcaaaaatgacctatagacttagcaactatttcttgtatgaacaga

SEQ ID NO: 41486 - DNA, 526 bp, Oryza sativa
ggcgtcggggaggggggtgttagggttaaccctaactgcccccacaatttcaccgccgccgccgccgccttttcgctgcacacgccgccgcccaccgccgtcatttcgtcgctgaccgccgccagttcgccgctatcgacgccgccgtgaggcaccaccgacgccgccgaggtgcgccgttgacgccgttgaggtgcgccgcctattccaccgctggggggcgccgccgacgccgccgcgggggcgctgccgacgccaccgccgccgattccaccgccgtctccaccttcagtgatagcgccgccgctaccccctccatttccgctgccgccttgcttccaccgccacctcccaccgccaccgtccactatccgccgccgccgcgtccctctcgtcggccggcggcatgccggccggctttaggccgacggtcccgactcctcatcggagttggagaccggccagaccctaacaccgttccccccccatgccattgggtaccatgcggctcggggagccatgggga

SEQ ID NO: 41487 - DNA, 831 bp, Oryza sativa
attttatgaccactttggagaaaaatctgaaagattagcttgcatttattttgtcgaggagttaaaaaaacacgttagaaagaaaaaatcacgaagggaatgaaatcgtgacttaggaggcattgcttctcacaacagttcggctagcacgtattggcaacgatttgcctatagaactagctagatttttgtcatggtactagatgtaagaatgaaaggacatttaggaggcagaacataaatgaaaatagccccttgctagcatcaaaccatggtccgattgtatcacggcggtcatcaacgataccagtaaagaacgaaatgcctacctattcactctcaggatagaccagcagctatattttctgactttaggttaaaacaaatgaaaccgatatgcatgggatttaacgtggactattaagcatatatgaattttattgaggcagtaatgcttaatgtttttaaattataaattgatatttccgcgacccagcctccaaatttgaaaattctaacttcatgttacgcggagcgtcttgtttcggtgacaaggtaagattgaattaacaatgatatggcaaatggtcccatcgatacttacattttgaatagtggatttataaccgctataggttgggcatgttttatatggtgtaggattacattgtagggtatatactatttgccacatgcgttttgactttgttctgatcgaaatgaaaagattgacctgcttaacacactccgttcacgtcgagtagccatagtagcttagaaccgaatgtaggcacacatcgtaaagttgtaaatgcaaccatagtagacggt

SEQ ID NO: 41488 - DNA, 206 bp, Oryza sativa
tgattaataacactgtgtaactctaggatcgtctttatataatggctttgggcaactaagtgacttttaaatgctgttttctacaaaacttaacccctatattattaccccttgtaccctcttgcattaatcatgcatctgccggtgtgacttgctgagtactgtggttgtactcattcttgctcaatcttcccccccccttcagt

SEQ ID NO: 41489 - DNA, 218 bp, Oryza sativa
tcattctttaggggacttccttttcttattgccacagagtagacgcatatgacctactaccattttcagcacattaggaaaaccgatgaccttcacattgttgattagtgaagaaacttaatgggtcgactattttgcgcgattgagatcgttaccgaagcacgaaacggttttttgtgtcactgcatgtgctctgctcacttcacctgtcttctagt

SEQ ID NO: 41490 - DNA, 1501 bp, Oryza sativa
agaacacaactatattgtcaattatcggcttgttatagcattagctggacaattcagaaaactacaaaaacagttgatgatgttatcaaaagttgctactttgtcaagaacagggtttagggtatgtttgataggttggacacacctgtcacacacacatatgggatcaagttacaactttcaatgtcaaaaggaagtttacagttttttttatataaaatcatgttgtattgttgaagttcaatgaattgtcctgctaatgttgtagcaaggtgaaaatttacttttacttgaggaatattgttttagtgatgtgcaagattttaaatatcctagtttttgtatacttaaaaatcataaatgagattttgcctcaatctgtagtcatgtaaaggcaaaggctgacccagggtttcaaatctaacataagagaatcagtaccttcccataaaatgatcagtgcaaattaacatatcacaaattagtgagtcatttttttcccataattagatgagacatgcctgagacgaccataacaatttcatgcttgaactcttttaccttttagcatattgcagttatatctaactacaataattgtttaccatcatagtgagttctgagcagagcattgaacttaaaaacaacacaaacaagtgcaaaatagtaatacgaacttctgcccaatagaatgataatgattctagttatttattcttcattctctagttcatagcccatatggccataccaaccaaaccccataataactgaatcagaaaatgaagtgattaacacaaatgtggcatgtggccataatatatcccaaatctccaatcggttactgaaaaacataggatgtgattcatgatttggcaataaacacttacagttgctactttgtcaagaacagggtttagggtaagtctgataggttcgacccacctgtcaggcacatatacaggatgaagttacagctttaaacttcaaaataagttacagtcttttaataatatcatgctgcattatttaagttcaatgaattgtcctgccaatgctatagcatggtgaaaatgtacttgaggaatattgttttagtgatgtgaaggattttaactttcacagttgttgtttaaataaaaatcataaatgagggttttccttaatctgtattcatgtaaaggagaaggctgacttggggtttcaaatctaacataagagaatctgtattgggatattacccataatcagatgagacataccagagacgaccataacaatttcatgcttaaactctttaccttttggtgtattgactacaataattgtttatcatactagtgagttctgagcagagcaccgaacttaaaacaacagagattttaactatcatagtttttgtttaatttaaaaaatcataaaagagggtttgactcaatctgtagtcatgtaaaggcaaaagctgatctggcgtttcaaatctgacataagagaatcagta

SEQ ID NO: 41491 - DNA, 1501 bp, Oryza sativa
gcttcttcttccaactaattaaccatgtcttgatttggtcaattaagtattagaggtggacctttcgaagtctgcttactttgagtggcatccctagctattgcatggggaaggttccacatggaccagtgaaattgtgtaggacttcatcgaggtcaattgcaccacaacttattggaatcattgagcctttttgaaggttgacctggagtccggtggcacccccgaaactgttcaggatcgagattaggctgtccacgtcttggcatgatggcttgatgaagattgccgcgtcgtcagcatacagggagcatctgaagcgcacgctgcggtccgcgaactcgcttaggtggccctcgacggttataatcttgagaaatctgtgtagggggtccattgcaaggatgaaaaggtacggagatagggcgtccccttaccttagacccctaggatggtctatcctttctccctcaattccgtttagtgagacactggaggaggaggttgacagaatcagggccacccagtcgtgccatttggcgctgaacctcatcttgtcaagtagcgttaataggtattcccatgagaccaaattgaaggccttggcgatatcaagcttgaaaaagagggtgggcttcttggatctgtgcatcttctttgccaagttggagacgtagaggaagttgtcctggatgcaactcattttgatgaatgcactctaggcttgcgagatcagtatgttgatttgtctggacaagcagattgccagatttttgtcagcatcttcgccaggagtgaattaagctaattggtctgtaatcacccactgtacatgcgtcattctttttgggaatgagaatcagtgttgccctatttatgcttccaaaactcccccctgataatgagtgtaaattatcaaggagctccatgatgtctaaattgatgatctcccagtagcttctgaaaaaggtgcctgtgaaaccatctggcccaagcgctttttcaataggcttttgtttgatagcagcccaaacttcatcttcggagaaaggagagtctaaatcttccgatgtcacttgggggaggtggagttcttaccaattcagggtacaagagcgttgtaaccaatgccccatcatggtggagaaatgttcatacaaggctcactctttagcttcatgagtctccagaatggcattaccgtgatggagtctgtggatgaaattcttcccatgttgttggttgactcttaggtggaaaaacttggtatttgcattgccctctttcagccatgttagctttgaacattgtcttttcctagccttttcaactacggcaaggccgaggatccgcagttttagatctttcttgagggagagctccaagggtgagagcggtatgttttcctaggcgatgtccaatttgagaataagctcgatgacaaggtgaaattggacacgactgtcacttagaatgcggttactccaggatcttagtgcct

SEQ ID NO: 41492 - DNA, 1501 bp, Oryza sativa
tagagagaatgagagagagatagagagagcgagaaagaatgagagaaagatagagagagccagagagatagagagagcagaggccacgtggaagatagacgaggaaatcgagagagaggcgtgggagataaaataaggaggtggaagagagatatttagtcctggttggtgataccaaccaggacaaaaagtcgttgggggcctgacacgacctaacaactattgaacccggagtgaaattatctttagtcccggtaaaattggttgggctttttaaccaggacaaaacaaagatgtttagtcccgattcctatttgaaccgggactaatgtgctttttggccaaccgacgaaagaccatttttccagtagtgcaaattcaacacctagattcgaattaggaaaatatttccaaaatttggagagtaccggtttccttcacgaagccagtctaaccgccatgtgtgggcttgtttgaccggcgatttgtggctggtcagaccgacagagtccaatcccaagtttgtttttatcggatctcgggatttcttatttgggaggatatgtttcgggtttctattagtttctactcgagttggacgtgaaggaggacctggcagcaagacccgttcaattgaaaagaatctacacacaatccaacctagccaattgaattgcttttttaatattgcatctagttttcacctagtcctagcctaattcgtctatctttatcaatttgcgatgtaaatcgtctgctttcgctacgagagtgtgaaatccctttgtaagtttatcccgtaaaccttatgttcgtccacgagacgggtgtttatcgcttgtttcttctaaatcgggcctgctagcccggttaatctaccaaaacccgtcttgatttagtttttgctagattgaggtggttggcgactccataccactgtaagatgtttaggtgtcccaattattgtcttcatgccaaaaaaaatgctaacaattagtattgctcgagttttggcataacctccctatcaaaatatagcagcctaataccgtatggagcacattttataccacgaatatggacattacgttgtatcctgttctaattagttgctatatattgagatagagggagtggttgggatggtgaagttgctatagagatagttttggtttgccaaattacgctaccaagagacgatagtgttcgccttgcgtgagaatttatccggtttcaaaagttaataacaagaaattattcatttaaatttagggcaaaaattagtagtagtagtagtagtctaagtagtagagtgctacaaattccagttccctcccgaaaacaaaagaaggcccaagctgcagcacaggcgcattcccctacagaaacccaataatgctaaggtcaaccttcccgctcgtctcccacctcccatcccgcaaaccacccccaatccgcccacgcccaccacctgttcggccctatgcctcttccgccgcct

SEQ ID NO: 41493 - DNA, 1011 bp, Oryza sativa
ccacccaatttaccatttaatttttagtttttcatttactttcagcagtaattacattttagtccctatgttttatgtaatttagtggaaacagttcatcagttcttcacattattatgtaatggccctatagaccacttatgttatgtgttaattaacataggtgtttattcaaataccctgtttcactaaatttttttgttgtcttaataacatgccttttgcatattatttcaagacacgctctactttctcgctttattaatttacaaaattctataaattttgtattttgatttagcaaattctcttaattatgtacaacataattaatggaggatttaatgcatgttccacttcacactttgactcggaaattaatcacatgtcaatggagccctatactttggtcatatcgaccataacttaggcagcgagtatcttgcccatcatcaagtggtctacattttgagatgtttacccgatggagtcctacaaattggccgcactagtcataacctaggcagcgagcacctcgcccatctcacagaggtctacatctcacgatgattacccacatgtgttattttccgagaatatgttttgaaaaatgagattatttgaattttggttgagcacaaggtagtggagtcctattcaccagaatatatttgcctggagaccgtgttttaggtagcaagtataacttgcccactattaagagatctactccactgtttaattacttggagattatccacattgtgccacctaatttcgaattctaacttgaattgtcaagtttattaccggcatcttttcgaaacattacaaaatatgaagtcttacatttcgcattgagattacaaccttaatatcatgtttttattaatttacctctgtaaattgataatgttaaccatgattgtagggacatggcaacaaaagagttcaacgaactcgtcctcgatgggactaactattccatctgggcttccgatatcaaaatca

SEQ ID NO: 41494 - DNA, 1501 bp, Oryza sativa
gtcctcgccggctcgtcgtctcgctgcgccgccaccctcgtcgtcatcgtaccggcgtgttccgcgccgtcctcgtctctgtgcagctgctgccgtctgccctcatcacctcctcgccggttcctgtcgtcgtcctctcgtcattcctggttgtcgtggcgttcgtccctccgtcaagccattctcgtctgtcgtccgcgtccgtcaagtgtgcctctgcagccccgtcgtcgtcttcgtccttgcctccgcgtcgccaagcgttgcgccggccgcgtctcgccttcgtccaaggatcgccgccgaagtcgtcccctcgcctttcatctccgtcattcctggccgtctccgccgcgcccgttcgtcgttgtcgttccctcgcctcgtcgcgtggtggtaaggatctctccttcgctgccccgtcctcgtcctttcggtgttgcccgtgcccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgtcggccactcgcctcagttgacacacgggatctgcttctgtcgacccgtggaccgtctctgtgtactcggtctaccgtggtcctttaggttgacatgtggggtccgcatgtcaacggcacagccttcctgtcttttccaggctagcgcttacacatgttttatagttgcaaaacctaattataataatccgcaaatctccatgtaacagcattaaacttcggatgatcatatcttggtcatacgagctccgaatcgatccgttcaagtctcctaatgtttcttataacctaaagaaccctgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgaacatattgaatcccagtttataaaattattttgatttaaattattgcattatcgctttatttaaattcccgcgttatcactgttttatttagccatgcctatttacctttgttatgaccttattattattgctattgttattattagcttgttcaccctaggataaacaaaaccccaactagtgggtactctattcatggttccactagtatgaatttaggtagatgcttcgctgattaattaggcaactttaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgttcctcgggtactataaggattaa

SEQ ID NO: 41495 - DNA, 335 bp, Oryza sativa
aaagaaacttttctaaagataaaaggaaaacataatgtccttattggacactaaacatactttcctaaagattaaaggaaactaacaaatactggctaattaatagataaattgccatgccgcattcttcttgaactcggtcccttatggataagcttccttgaatagattaatttccttaaccggattctccaagaatccgactgctagcaacttgataattcccatcggtcgattccaagactctgaaaccgatactgactctaggccgatgatgacttcgggcttaccaaattttggtgttaacaatatccttatgtttctgaatctgaaga

SEQ ID NO: 41496 - DNA, 154 bp, Oryza sativa
acaggaaaacaaaattattcgtcaggtgcagcagcgctgatcacaattcacaaatgccgcatcaggtgcatccagcgaagcagcctgcatcaatgggagtaggtaatttaaggaggttattacataagtacatggatagttcaaatcttacagg

SEQ ID NO: 41497 - DNA, 206 bp, Oryza sativa
aaaataagaaaaaaagacacattctctttgctggcgctgacgatggaatacagcttggcaatggcgacttgatcaacggctccaccatcgagcctccctcttgctttccgtcctcttctcctccaaccgcccaccatctcatctctcgcacgcacgcacgcacccgccattgctgattgcacctccccccaaccccacctccccga

SEQ ID NO: 41498 - DNA, 305 bp, Oryza sativa
tacggcatatacgccatcattccagccatgacgagaggtgcgtgcaccgcatcgtgcgttgcccacgtggccagggtagcatgaccgccgtcaatgcgcaaataggttgcaatgagaagaacaaaagttatcgttagagctgtgtctgcatcgtggcacatatgtgacggtccatgatttaagagaatataggtgggattgtctgtcagggatacgcagtcccaataaactattccagtatatccgggctagatcggtggtgtgcatatcttcataaaacaatacatggcgcatacatggcagca

SEQ ID NO: 41499 - DNA, 1501 bp, Oryza sativa
caatgtatcactattcactagcacccctccttcctcactgctttgctgttcttgttgctaatggtctgcctctagattcctgcctgatgcttgcttgtttgggctttgcaaaggattaatggctggacgtcgtgcattggatccggcaggagtgcaattacatcccaaataagatgctacttgttagcacaataattaaattcttcatgatgttactttaagatcgatgtagccacctgtagcaaatgttgagtgcatgatcaaaaaattgaagtttactgttatttacttgtgaattgggatttgcttgcatcagtctacaaaatcttccctattgcttagttcgaaactaggcggtgtggattttggttaattttgacatatgcaggatcttagctcgatgatacgtgcgcatctgctgtttaagatgcacttggctctgttcagggatgattaactgtgcattctttagttactgattagtaagctttacagtataataacttagcggctgaaatcgtaaatgttagtactgcatttcctttacttggatgtaaggattcatgcaatcatgtggtctcacttgtgttgaggttttagcaaatataattcagattgccctgattggcagagctgagcatatgcgtgagttttgaatctgtcagtagttgaatactgctttgatatgtctgtagcaccccaaatatgttatgcagaattattggtacttatttgtgtttattgcaccgtcattcatttctgtagctattgcctcatgatgaagcaatatttggatatgtcatcgaagccagggagaccaagagcagtagtcatctgctccacaaggtagctgactgatcaggtcaggttatccttactaccaaaaaaacatgagtttatgatcggatttttttaaatgatactgctgaatgtgatttcgtgcaatgggatgaggcgtatatatgcctgtctaattgtattgctttgaatagaattggtttttagataaacctaatatgtttatttttagacaacaacatggattcatgctggattttagtatgaaaacctttggtctatgctggagtttagactaaaaaactctcctctctcaatattcaaataatgtgttacaaaagatcccatggtggtggtagagactaaccaccacttaatactgttttttatttttgtttatttagatacaacatggacaaagttcataaaattacattagtaatcatcatcaaattcatgcttttcattcaggctgaagagatgggtaggtttttcggaaacacaattatatccaggtattattcagtttcttgttgcttcttatatcatgtaaagagcttatttatctacctcggatgttcattccaagagacagcataaattactccggagatcccaaaacttgagctgtggtgtcttaagttagcaactaacatatctgtaatatttatgtttctcaaagatgtgcccttatcagtaaatt

SEQ ID NO: 41500 - DNA, 1169 bp, Oryza sativa
cattaaatatatttaacacaaagtacaaaaatatgatattgcatggacacaataaatcttgataataattaattatatataatcacttcagtatacaatataaagggaaatatacatttaaaaaatatgttaaaaagtatagatttattccattaatttgttgcgggcataaacaactaaaaaataaagtaggtaaataactatcctaatatttagcatttgcaatacacttaagaaattctcctgcaccgctagtagcatgctcgtactaacactacggtgacatttaataatatacgtgcacgttctatttttgcaagcaacatatatgtaacaaatctctacttatatatatctctcttatctactattataaaaattatatatatatctcttctctactattataaaaattgaatatgtttctaaattttggtatgtcatccgtgtttgaatcggctttaattttatatttcggttttaatctctactattatctttacctattaaaaatgttgcagatgattacatactcaactaaattttcgtccgtgcctctctactgacaacacaactaaaataaaccggactatgatgacttgtgttcactactccagtttccccacgtgcacagtaaacatgaaaaacggagcggtccattagtacgtaattaattaagtatttgctattttttaaaaaaaatagaataatttgatttttttaagcaactttcgtatagaaactttttacagaaaatataccatttagtagtttgaaaggcgtgtgcgtgaaaaacgagcaagatgggttgggaaaaagggtttgcaaacacaccccgttcggactcaaaaaagaaaaggccaatcaagaaaacactaatgactctactaatgaaccgtgactaattaacctatcaacactgtaattgaaccaacatatcttataactacctcaaaaatttgtaactttcagttcttcacatcaatttttcgtccgtgagtccaatcgaacgatggcctccgtttccatacacacgagtaactcatcacgtaagatggataaaacacaaattcaaaaatagatacaaaattcaatcagataatccaaaaaaagagaaaaagaacaggaaaaataataaaaaaaagcacaaacctatcttaatttattct

SEQ ID NO: 41501 - DNA, 624 bp, Oryza sativa
gccccatcgtttggcctaaacagccaaagaataagctaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttggccaaatgggcaaccgatgggagccatgagttagtaacccatttgctcaaccatgcgtcttgattttttttctttaaattgttccgatcaattgatgtgcatgttaaattttccactggaaagtccgtaatctcttggggtattacatgcagagatcataagagtctttaaaccaatagctgaatagcaatatggatgtattttcctttgtggtctagcagtaccagtaagtcagtaacccatttgttcaaccatgtgtcttgaatttttttttttttttagaaattgtgctgtttgattgatgtgcctattaaattatacacttgaaagtctgtagtcagtattgcttgttattcctgactgacttattaccagcattaatctatatttgcactctgttatggttctgcaggttagcatttgacagcca

SEQ ID NO: 41502 - DNA, 289 bp, Oryza sativa
ctcgggcagctggaggaggaagaagacatatatacatgccctgacagcattcgaaccgggactaaagatgatctttagtcccggttggtgttaccaaccaggactaaagatcaaatatgtccgttacccttttaaaccgggactaaagatcatctttagccccggtttttattgtatgcgggactattgtggaaatcggccggccgacgaaagatagtttctccaccagtgagaggaggtaattaatactatacctttgccatggctgcctgcacctcctcgctcgtct

SEQ ID NO: 41503 - DNA, 257 bp, Oryza sativa
tggtttatattagccctaatcaatccccacgtgcttgatgaatagtctgaattccagataatatccgtggtgattctctggcagatgtaatctgacatgacctcctcctactaatagatagattgaattctttactaagcagagcattgtgcaccaagcataattatatccgggccttcatcagcaatacgcagtgagctcgaaactgattgaattttcagtgagcagtaaacgtctctctcttttctatctctagc

SEQ ID NO: 41504 - DNA, 243 bp, Oryza sativa
tgttgcaatgatggcaaaaatcgcagcaacaggtgtccatcttaggaatataggttggcacttggcagtgggcatgcctgggtgaatgggtgtgcattgtcgctgttgctgagagtaatgccatgtgtgggtgggactagtggccgataatgtttgtgtgtctctagagtgttgatttattctaaagtatacctgtgtgtctgtgatccaggggtacttgaatttgataccacaagcatgaga

SEQ ID NO: 41505 - DNA, 195 bp, Oryza sativa
aagttcctccagttaaacaaattgccaagtatccagtgtgaatgatttcagtccccaaaaaccatagtacaaagaagaaaatccacgacagcatgaaattcatgcttcacattagtatgattcaagaaaagacagatagtgaattgtacaacatgctcagctggacgaaagaaaaatgtgatcatataacctttt

SEQ ID NO: 41506 - DNA, 1112 bp, Oryza sativa
  unsure (1)..(1112): unsure at all n locations
ttggataatgttcaaaagaaatttagcatgaatgtacttaaatatgatgaattattggaggtacactacaattagaaatagagcattgcctcgaggttaactaaaaaggtattcagatatgatcttcagtatcccatccagcttgaatcccatcctatactaactcgttgactcaaaaaagaaatattaactaaaacaacataataaataaataaaatatactactaacatggactctagccaccatgatttgaatcctgacaccaacatatattacacagatatagatgcacatttaatagaattttagagagctagggattttgctgctggtctttatcttttaaccatatgttgagagtacattcaggtgtatccgtgaaaaaaaagaacatccatgnaattgcattacgttatcaatatattaggtgattncgccgtgctttgcttgcggaaattactaagtaattttcaatatatattttctcgttacaatcaagataggggtaaagaaaacaaatgaaatatcagagcttatcagtatttatcatgaaacaaacaaataaaacccgctttaatgtggaacatattgataagtttattttaaatattatacaaatgatagatagatttgtaaaaatattgtggaaatgatgcgaggggtgatgattggatatgtttgcatgttgatttgtagaattaaataaattgtagatgatgttgcatgcttgcatgaggttgaatatataattattgctagtgggtgatgatttggcatggctgtatgttaagctttagagttagtgggttataactttatagaaagtatagattcattcatttgcacgcatgtggatggctgggtaccatgattattgccattcaccctctgtcttctttcgcataagaacatgttgtggaggaaaaaaaataaggtcaaaatttaaaaaactctatgaagctgttgatgcgaaaaacacgaggcctggaagatctgcttaactttagtgcaggtccaaaaattttgcttttaggttcgtgagcgtgccagttgatttgatcctgcaatcaacaagaaataaagacaaagaaacagcggttaaatccataaa

SEQ ID NO: 41507 - DNA, 903 bp, Oryza sativa
agcttcaggagtaaaacttcctttttttgccggtggaactgttgagccatacctttgacaaatatgaaattttcatgtatggatctgcctttgatgaatgccgtttgtgtgtggggtaccagatcatccaaccttgttgccagccgccgtgccattacttttgttgccaatttggagaagctatgaatgagactaattggcccatagtccttcaacatggttggcgcttctttcttcggaatgagtgtgatttgtgctgaattcaacaattcaagattttggctatttccagtgcagaatttccccatggccgccaaaaggtcatccttgattacagcccagcatttttggtagaagagcgaagtatatccatcagggcctggcgacttctcagttggcagattttttattgctgcccagacctcttcttcagtgaagttttcatcaaaggatgccaagtttcctttagccatctgaatggactgcaagttaaattgctttgaatcaccttctgcctgccccatgattgtttcaaagtattcgcaagctaactgttgcatgtcaatttgtgtcgtggccactttgccattgtgctcaagccttggtattaaagccttccttcttcttgccctcaacttcatgtaaaagtaggcagtgccagcatcaccctccttgaggtttcgaattcttgctctttgtctcactcttattctttcaagagaggccaaggcgagacatttccccttcaaggcagccctcagtcggcgttcaaggtcggtcagcaacctgctttcttgtgccacatctaacctcagaatatcttcatttgcaatttgaatttgtagcctgaagtagctgattttcttttgcccccattgagaaagcttgagtcctctagtaagc

SEQ ID NO: 41508 - DNA, 1501 bp, Oryza sativa; identical to SEQ ID NO: 29103

SEQ ID NO: 41509 - DNA, 1220 bp, Oryza sativa
acatatgtatgttcagattcatagtactagaatgtgtcacatccggtactagattgatttttaataagacggagggagtacttggagagtcacgcacgcaaacgaaagaatgagttttaaactatcgggaggttatcgccttgtcgtttgcatttcacttaaataattttaaaaatacttttgagaatatatatttacaggtgatatatatcattccacaaacatacaagttataatttaaacttatcaagttgtaaaaaaacaaattaaactataactaattaacatatacatttaaatttgtttttttagttgtgacatatggaaattaattttgatattgcacgtttgtagggtgatatatcacattttaatatacataatttttttaaaaaattcataactatttaaatcacgtgtaaataacgatagaatattttatcgagtttatagtttgcccgcaaatgctactagtacgattcttggaggtacatccgggtacatgcgccacagcagccacgacaagccatctacattgtatgggggctactagctggcgcgtgcgcaccagcagcgagcactccctctcccctttagtctactcttaactaactaaattagttaatatacttaacactaataatagtaattagaaaaattctggagatttttttactaacagattgaaaattttttaagttagatttgaaaactttcgatttaagttttaaattttaaagtcaaaatttaaaaactttcaacttaaatttgaaaactttcaacttgagatttgaaaactttcaacttaagatttgaaaactttcaactcagattcgaaaactttcaagtccagattgaaaattttgaaaactttcaatttaagatttgaaaactttccactcgagatttgaaaactttcaactcgagattcgaaaaccttcaaatcaagatttgaaaattttgaaaattttcaaaatcgagatttgaaactttcaactcgagatttgaaaactttcaagttcagatttgaaatttttcaactcaaaaattaaaaactttcaaactcaaaacatgctaaagataaaaaaataaaaaaaatggaaaaaaaggaaagaaaatggaaagaaaacgaaaaaaaaagtggagacgcgcgcacgtcggcgcagcggcgctaggcgttctgggtccgaaacgcgcgccggcggcgcgcgcgtattagg

SEQ ID NO: 41510 - DNA, 983 bp, Oryza sativa
taataataaaccttactttctgagttgacttagtctctatccccacaacaaaaagagcactaggtaagtagatataatggggtagtataaactagatacaagtcgctgcaatgatgcatgcaaaatatcaacgccatatcatgttgacctagcataaacaaaactcaaatccggcgaagtacgcttgtttgctatcaataatgcgagcaaacaaatgaatcttaatagcatcacactaaggaagaatggataatacatctcatccacgtctgttaaataatttatattcagccaggaggagaaatcacagccaagacctcgtctcattcactgatcatcaatcaggtccctgaccagtaatttttttttagaaaatagattttcattaatccggtctctatatccacgaaggatatacacatccaaatcatgaccagtaattgatctattcaaatattgatcgcggcaaattaaccattctaatcaattctaagcaaatttcgattggtttggacgttcatattgcaagatctctcaggtaaatcagccactggccggcctgaaccaatttcctttcactatgaacataagatgcccatttttccaggaaaaaaaaagttaacacaagatatcaagggttacttaatttcagggccttatctgcaacacagccagtgcttagcttagcatgctacatactccaaagttcaaaatctgcagaccaaagcattccatctgacagagaccgcaattccaccagacacaccatttttttacgctcatcatgtatgccttctacgtaatgcagcaccaatcatcaatcatttccttcaaaaaagcaaaaccacacacacaatgccaatcaaacactaagtaattctctctttctgagaaagaagcactatataattcagggacagcaagatcgcattcttagcaagggagaagactgaacaaacagagagagagagagagagcggcca

SEQ ID NO: 41511 - DNA, 166 bp, Oryza sativa
ccgggcatagcgttggcaagggaataaagacgccgaggaagggattcgtttccttcctctcgccattcttccccttgccttcgccacttgcgctctaactcttcgtttcctgtgccctacccttgccatactcgctcgctctcaagctcctcctccaccggcgtca

SEQ ID NO: 41512 - DNA, 189 bp, Oryza sativa
aaatgggcgtccacggaaaaagcgggcgagcggagcagaaggcgcgtgctctgcttgtcagaagtcacttccggctgtagactagccctcattgtaaaaagcatgtttcctttcttaggcagctagaggcccatgtggtgacccctgatcagataaaaaggaggcccaggcctaagagagaagggggag

SEQ ID NO: 41513 - DNA, 1501 bp, Oryza sativa; identical to SEQ ID NO: 29116

SEQ ID NO: 41514 - DNA, 506 bp, Oryza sativa
tggtaagacaagtaacaacaaaataaataatatatatagttttttaataagatagatggttaaacactatgtgaaaaaatcaacggtgtcatacattttgaaatggagggagtatatccactaatgtatttggggataccatgtcattgatcattgttctcgaatgacaactgcttcacgtcgaaagacgtggtaaactcggtgagtggttggaatagtaaagcaatgtattaattgataaaaatttttgggatctccccattacatggctctaggagactatttataatcctagtacaggcttgtaccctttaggatttggttagtacatgtgaatttgcatagttacccttaccgtagggacattacaatgtgtatacagtgtcttttgcatttatgggccttgaggcaacccccttgggccggcccattagttgtcgaagggcctctataggccgctgggcctcctatgtccttagccgaaggtatctactacttcggggcga

SEQ ID NO: 41515 - DNA, 1301 bp, Oryza sativa
gtcttatagcacgtaaaataggtcttctgtataggtactctgttggaggctgaaataatactatcggaaacccattttagatttaggtgcccttatgggtcacttgttggagacaagtcttacccattatttagaagcccaatcattatcacttttgtctataactaccttaaaaaaactatgcaaaaatataagaaatgaaatgttcgttcaagaaaaaaaaagataaggaggagtaaagtctagagtgagtaacggccttcccaagattaataagtcaattttatctgtttagacaaaacgaatttgtatataaaactgaagatctaatcaaacatttgttaagtaaatcaccaggacccatcggcatatttgtaaatggaaaaaatttgtgaataaaacttttatatacgtattcttagtgatctaacggcttgtttggtaactcgagggaaggagattgggagtttacacgagggaattgataatgagattaagatgggaatttgatttttaatctcaatatcttgtttggtagaggtaatggaaattgatagggagtttagttggagattaagtcattaataaaaacagatggctcagatttgcttagaaaaagtaaaggaggaattccctcccaattacctgcccctacccaggtattgaaaaggagggagttccttcctcaattcaccatccctatcccactaaattttccatgtctcccaaccaaacaaatcacttagagcatgcccaacaatcacccaatatttgattcccaaaaaatctgaattaggaataccaaaataaaaattgggcccaacaatgaccccctcctccaagagaagcccaaaaatcaattccctatcatttgttagtttgccacataagcaaggtggggcccagttcggtacttgcgcacgtcttctccctcccgcaccagcgccgatcgacttcttcctccccacacttgcgccgccgtgacctagcgccatcatcaccagccagccaaccagtgtcctgactgctgcgatttgttaaaaaacggaacaccaaggagatgtcgtagcaattcgtgtcatcaaggaggtaatccttagcaaatcccattaatctcttgtgccgtagtcaatctctatgtcagtattttgatgtggatatatattgttggaaaatattaagtttgatctgataattaattttgcagattgattattgttctattcctgccatcagttccctccattgcacttcatccctgtggtaaacgctccaacaccgtggcaaacaaaaagaggaga

SEQ ID NO: 41516 - DNA, 640 bp, Oryza sativa
ttagtccctgtctttagacactaatttagagtattaaatataaactacttacaaaactaattacataaataaaagctaattcacgagacaaattttttaagcctaattaatctataattagagaatatttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggctcagaatagaaatcagaatagaaaggatgaatggagagactattggagtaaataacaaatttgaattgctaattaaatggagatttggctaaatagacggttggagagtgatttggagaggctgtctggagatgctcttaagctcgaagaggcgctgcccctcgtgcatcgccgacccccgaccataagtatcacgagcaggcggccgccgccgagacatgtgctgctcagtcgctcagagcctcagatcacccacccgcttgctgaagcgctagtactagtgtactaccagtagtagtgtaggcggagaaaagcagttggcaaagctcgcgcaa

SEQ ID NO: 41517 - DNA, 206 bp, Oryza sativa
aacggcattgattgattaggaattaaagttcacaatgagcggttaatttgcaaataaattactctcttcttccccgtgaacctcgatgctctcgtctgttacgctgtaaattccagaatgcagcaggcaaaacgagacttcgacttcagagttcagacgcaggccactgcacactgcaactactgcaaaaatggcttctgaaacaa

SEQ ID NO: 41518 - DNA, 217 bp, Oryza sativa
catttcgaaacggagggagtacgtcattaacttgacaatacaaccgaccattcccgatgacacatattgagcaataaaaatgtggaaccaccagctgttacaaagtactccatctagagcattagcatgtagattaatttaatcactaacgagaacgatcaaacaacaatacacatgcgtgcaacaattagaatcacaggctcgcagctactacata

SEQ ID NO: 41519 - DNA, 316 bp, Oryza sativa
gtcaaacatgtgctaaaaagtcaacggtgtcaaacatttcgaaacggagggagtataatagtatttgtagcactgacattacctactgttttcctgttctattgagtggttttagcaacgtttgcagctacaaattcccaataaactgatgttgagtgatctaataacttacgaaggcaaaatgaagtcatataatcgcatcaatttgtaatgttatgggggagttgatttgttttttctttctgtagtgattggtagactgataaacatctacaagatagcatggtcttatcggtaattgttctctctgtgtagg

SEQ ID NO: 41520 - DNA, 685 bp, Oryza sativa
gaccccccctcgggggaaatcaggaggagggcggacacctcaccctcgggcccgacgtccccgaaggtgccaggccacgtgggcgattgcgtctgcctcaagcctctggtcatgatactcctggtcccatatcaccgacaccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggcgagcagattcgtctcgcccggagatacggcaacgccgcttcggtcggcgagcgtaattaacgcgcgcacgatacaatccgtttcgatcgcctcaaccgcatatccacttcatgcgccgtaagcgggcgaatgggattagtggaagcgtggggacgggaaacgagggagcgagatagcgagatacgaaggagcgaggtagtgggcgcgagaaacgaggagccaggcccagcgatggcaagggtataaaagcatcgagaaaaggatttgcttccttcctttcgccattgctcctcttgccttcgccgcctgagctctaactctttctctgctacgccctactttcgccacacgcgctcgttctcaatcatctcttcctccaccgcca

SEQ ID NO: 41521 - DNA, 1501 bp, Oryza sativa; identical to SEQ ID NO: 29125

SEQ ID NO: 41522 - DNA, 865 bp, Oryza sativa
ttcctgcagccttcgttgcattcaaagacagtgctcactgatgtcttcctcggtgcgaggcggactgctcaccgacgtcatcctatgctggtttgaggccaagatgatcagattacagagcaaacaagtagccaacgttgtagtaccttgttgtccatgaaggcatgaagtcattttggccatatggtcacgctaattttgtggagcacctgtattcgtcttaaaaaaaatgtagtttaccccttttcctagtataatcatcatctaacaaagtactaatcaaaattattttttattggtttcaagccatgcaacagtgaattattttttgttggactgaatcaacggagcattgttttgttgtccttgttcttggtgtggatcattaaattaggatggagccatagtgggagggatttcagcatgaagtttctgtttaaagtaggaattttggtgcatggattaacaaatgtgttaaaatttgtgacatgcacatactatttcgaggggatatcccctcatgtcgtgtatgttatctaatgtcacaccctgaaaatcattaatatataaattgttgtttaattggaattattagaatttatttttaaaagcctagaagagaagatctaattttttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccgttctctctctcctcggcccagt

SEQ ID NO: 41523 - DNA, 1501 bp, Oryza sativa
ccgaccatgtcgccggcagtgagcagcttggtgaccccggcgagcgggacagcgaggagggagaggaggaagtcgacgacgtccttgctgccctccgcgtacagcacgcgctgcgccttggtgtcgacgagcagcttcatggttagagtggcagctttagatgtttttccggccatctcacggtcacacactcttgcgtacgagagatcagaagcaccaaactagaatggagaaggtttggattgcagcgagatttgaagcaacctcgaaatttaaatggtctttttttatagtggagctgtacgatgcaggcacatcaatgcgaatgacaccgtgcacgtcgcttcgtttcccggccgtgacatggaccggcgcacgaagtcacgaaccgccggaagagggggagagagagagaaacgagaggagactagaaagcagacgatgggacgagaaaagtcgatgatgcatgggtcctacctccatccatatcccttctttctataatataaagttaaggccaaaaactcaaaccacatgcttctacatcatcatcaaatagtgaaccgttggataaatgcattagatcgcttctcagatgttggatagaatgtagcatagagctcaacccattagtcaccgggtgagtctcttcgcctcttcagtgccaaatgtaacccacatgaacacattggcccatctccacacacatctatatgtatctagcccgtcaatctgtataaaagagctttatgactgaatgccccttcagttgacatgtgctacctaaattatctacaaattttggatagagctgctaaaaagaatttattcaagaaagctatttgtttcttctgtttctttttgagattgtacctcatatctaacaatttgatgttaaccaagtctcgcagcaacacgcggggcatcctctagttggtactatggctgtgttcgggaggaggggtcttcctccccggcacgcaaaatgaaacccctcctccatctcatattactcgctttaagtttctgtttgtaacgaaaatgtttgatcattcgttattcactctattatttattttgtttgtgacttactttattattaaaagtgctttaattgaattatctatttttatatttatactaatttttcaaataaaacaaatgattaaacgtcgaagaaaaagtcaaagcgatttttattatcgaagaagatagtacgtcaatagaaatatttttttcaaaccatcaaaagcgtttatttgcattggtttttaaggtgcgggagatgttattggctttgaagatgccggagatgttatttccggttgtgtggtttagaaagacaattcaatgaggaagagtcaaaatagactttttccctccgataacgtgggcattcgtggtgggccgttatgtaaatgggccgagaggagtggtccgatttactacaggctataaaggaagcaaacctactgctcgtgctcatcgtcctcgccgtcga

SEQ ID NO: 41524 - DNA, 1501 bp, Oryza sativa
acggatgtcccgtattgatagcagaccggagatctagcaatgcaaacgaaatgattatttgtagttgaatattctagtataatggagtttcctagcatgatccaactgtgaattctagcccaaaatataaaggactacccaatttgaatggaagaaataaaaagtaatataagcctgatctttggtatttttagtttgtgtctaacactatgttccactaatctttgtatgtccttacctgcttatgcaacgctgcaagcctgcaacctatgagtttgcctgtaagaacatttataagattgtggtttatccgtttttcctgcttttccaaatgacatgttcagaaaagcagactactgcactgaattcatttttctttcgcgaacgtgtaaaaggattgcatggcatcccatttagacgaaagcaagttgaacccatttttccatatcactatttggaaaatattaacaaactgctctattattaatacttatatgaaatttggaaattatgttatatatgcatgaattgttaccttactccgcaggagaatttgtatgtaggaggtcattttttccccttactttagagcagctatcaaccaatataatctagatgtttcaaactttcaatggaatacaatctggaacatgtttttgctttatctgctttaaattataacgctttctctgaacatttggacgataactgtagttaattgaaaacccatttaattttcttttgctggtgattgcagaagcaatcaatcaactcccaagaaatttaaagaacttcgaataaaaaggatcatggctgccgctgaattgtcgatcaagctcgtgattgataccaaagctcacaaagtctgctttgccgaagctggcagtgacttcgtcgagttcctctccagcctcctttgtctccctgtaagcaatatcatcaacctgcttaccaaggaacatatggttggaagcattgcaaatgtgtttgacagcgtggagaagctggacgccgatcatgtaatctcaaacgaaagcaaggagccttaccttaagccaatggttgcccctggagcgctctgtcctttgcagcagctgatagatgcacagctagacaccgataccagcttcttcacatgtgaagggaaattgaaccattaccacggcattcgtgttgcttgtggatattttacggttatgaaaggcagcatttgccctaagtgcggctacgcaatggagaaggcaatggcacatgtcaaagccactgggtttgtggttgggacagccaggtacactgtcaaggatgatctctcaattgttccagcatccagcgtgtcaaccatcagcttgcttgcacaatgcggtgtcaaggacttgagcacgctgcaggaaaggaccgtgaagattggcaaggaagaggtttgtacatatctatcagaatcactttgagtgaagagaacagtcgtagtcgtttttcttaattggtgtggttgatgattttc

SEQ ID NO: 41525 - DNA, 208 bp, Oryza sativa
tacaatggtgtgattgagtgatgttgtattttgtgacacttagacgccatgcttgttatgcatattagaatcttggagttcttgatcttaaatattaatggctctgatcaatatcatcgtcacataagagtgacaaagcaattgaattaggttgatctttattgaagtatgtagacagttgaagctggttataattccctgtttctgt

SEQ ID NO: 41526 - DNA, 209 bp, Oryza sativa
tatgtgttgcccccaaaactagtcaccaaattactcgcttggtagaccatgaatttcagatgcaattttattataagatgataaacaacaattcttctttttgaaatgacagtagttaaacaacaactctgcttcttgaaatgacggtagttattgaagttgttgccttagtcgaacatagattatgatttttttttcttcatttcaga

SEQ ID NO: 41527 - DNA, 868 bp, Oryza sativa
acttggacacaggagtgtgctaacccaacccaaacaaaaattgatcgtgctttctgttgtcctgattgggatgtcctctttgactctgcgcacatgtctgcactctcttcgtcctgctctaaccatgcccctttattcataactggctgtatggaaagagaacaaaataattccttccgctttgaatcttattggctcaagctcccagatttccggcaagtaactgcagagtcctggaataggccactacagactaccaatcctttcgtgcgactccatttaaaattaaaaaggcttgcaagagatcttagaagatggaaatcaaccagaataggagatataagattgcaattggcaattgcaaatgaagtagtctttcaactggatgttgctcaagacgatagagtattatcggaggaagaacagtgcctccggaaactcttaaaatcaacggtgcttggactggcagctttagagagaatacgactaaggcaaagagccaggatcacttggttaaagcatggagacgttaactctaaattcttccaaatcaaagcaaatggtagaaagagaaaaaatcacatacagatccttcgaactccagatggctttgctgtaactaaagatcaaaagcaggaagaattgaagcgttacttcacacaaaaattaggagcctttgctctcagaaatcagagattaaactggctgctctcaatctccctacgcttgatctctcagatctcgatgataacttcactgaagaagaactcaaaaatgcaatctctgacttgccttcggaaaaatctcctggaccagatggatttattggagcctttttcaaacaagcatgggacataataaaaacaga

SEQ ID NO: 41528 - DNA, 378 bp, Oryza sativa
tacaccggattaccgggttagaaccatactaggttttacagatttatcgtcagattcgtaatatccgcgtgcacagcaattgcctatcatatctaccgtcgaattcgctatggttatcatatcgttttccttaaaataatgcagaatacaactatacatagagataatggaaaattacaaaatcaaatatacggaaagatcgcggttgttggcaatcgtgcaccaatcggtttcacgctccatatattccgtgaaaatttgctcgacttaacaactatacaaagcgatctgatcctgcgagggttttacgtacgcggcgcttggttgaagcaggcaacaacatgggcaacgccgccgccgtgccgtcgtcgtgcgctt

SEQ ID NO: 41529 - DNA, 477 bp, Oryza sativa
acacgattagccgcgttttttggcgtttcaacgcgagacactcttagtgggaaatttggagttcactgatcttcaggtgttccatcttgcgcaaagtgtgatgtcgggtatgtttagctcggttcagacttcagagtctgaaacttttatgaggtgcatgcgtgtattatccagtgtctagaatttgtctctgacgtgaattatcaagtgtctagaatttaagtcagatcaaggagccaacacccggagatttattaatcaaatggtgcatattagcttttgtcaatcgtgatttctagctttgaactgttgttaacttacacaagaaacgcgtcatgcacttggagaacggtagtggtattgatgcttcttgtcgaatttctcgtatgcatatatgctgagaaatgcgaaagaaaagcacgggtattttgtgtgatttcaatgtcgtagtgtggtctgtatcaatcttcaaatatt

SEQ ID NO: 41530 - DNA, 1501 bp, Oryza sativa
aggagttggaactctaccaaacagaccctaacttaggatacgatattacagtacctattagaatgaatctgaaccctgaacggttgggtctatcacatcctattctatattcgtttattttaggatgaagggagtgtcgattggcattggtattcttatgctttgggcccatttaccagttaaaggctttaagtgctattcgactatgtagagtagttttctttggagcattcttacacatacttaaaatagctttgccaagaaaacttataggactcgcacaaacaaagtttctcatcatttaatttaatctactgggagaagaattggatgtacatatagctttgtccattttcattttgtcaaaattatgcgcaacatagcagtgacaaagcattgacaaaaataaggtgtagttgacagtatcattttgtcaagaattaggttatatgttctcgagtcgataatgttgtcgtattctattagtcaatgttatagtagcaaaacagataatattgttgtgttctatttctatgtcaaaacaaacataaatatatggttatttttctgttgatatatataatgtgagcagaatatgagaaaaaaatgctttcttatcttttgctgaaataagtgttattttgtcgaaatgatggaagcatatcgtggactttctgcccattttcaatataagcaacttatggcctgtagatatgtgttaaaaatcgccataaccatcttaagatacgttgtgcgagtgaaaatgatctgaatgaattatcatacatccggtggtggaaaaaggcaaccatccgacttattttagtgatacgagcgattctgttggggtacttaattacttactgtcaattcacaaatgtactttcttagcttagaaaaaaaggaaggtagtaaaaacactcatacaacgtataaatgttaatgatgtcgataaaaatggcatatcttgtcgatgtaaatgaataaatggtacacaaaacaaattaaatggagggaaacagtgtcagagacccatgttctcaaaatttcggtaaattattttgaatttcagataacctcacgtcctctccaactgaatatagtttcgtttattcacaagtatcaaatccttggctccaaaaaaagaagatgttgacttcttcatccagaaaggaaaaggagagagagatcaaagagagaaatattcagatgttgctttcaaagtttgtactactggtttggaggatttatgagaagaagaagaagcagagaccaagcttccgaaaaccggttcttgacttgtttatcctgaccatgacaatttttgattaaggttgtgtgtagattcaaaatttagatccaaacttaagtcatttctcatcacatcaacctgtcatacatacataacttttcagtcacaccatctccaattttaaccaaaatccaaactttggattcaactaaacacagcctaagaaataacaagaccatcgggtcagta

SEQ ID NO: 41531 - DNA, 1501 bp, Oryza sativa
cggcgagcaccgcggctgccacgcccccgccgcagtctgagccgacgatggcgacgtcgcactccacgacgggagggacgcgtccgtgaggttgatgatctcgaccacgccgtcgtcgagtggccgcttcgtcgcctccgtgtgctcctccgccagcggttcatcagtcgacaggctgtacccgtcgctcgccagttgtgccagtgccacgctagtctatgggatagtagttttggagactgacaagtgggccccgctgatttaaaaaaaaaagaattgctgactagactgccacgtataccaaaaccgcttgcaaagctgctaggggggtttttcatccggtattgatagttgagggtgaaaaatatccggttttcgggtttatggggtaattcgtactcacccaatagttcagggggtaattcgtactttttccttatatataaggggtacaaggggaagttacatctttaccctagctaaaaacagatgtggagtgactggccagtgagccagtcgtagggctactggtaaaatccctagccattaaggaggtggtgacgctttccgagggtgtgggctattatttgggcaaaggcatgcttccggataatagcggatgcctcttgccactgtcaggatgtcagaggtggttgacagatgcgtagtgcgtattaatggcgcccctctacacccgtggaccattcctccatgcttgatgagcactctagttccccgggcactccggagcctttgattggctccgaagccattggttagctgcgggcccgtgactcgctccggagtcgttggcccactccggtacccgtggtcggctccgagatgattcgtgagctcctaattgattctgaagccccttatcggagtcaaccatcatggtagctacagccttcgatcattctctcgtggtggatggcttcgagctgagtcttcctactgacggagggtggctccgtcatccggagccatccccccaacagcaattatctattcttttcctatcatttcattcattattaaatatacttttatgtataatatagttttacatatttcataaaagtttttgaataagaaaaaagtcaacagcatcaaatatttagggacggagggattacatgccaagtcaaactactttaaatttatagacaaatatagtaatatttatgataccaaattagtttcgtcaaaattaataattgaatatatttctataataaatttgtctttgagttaaaaatgttacgtattacttttgttgattaaacttgaagcagctttgattttgaccaaagtcaaaacgacttaacggatggagtactactctacaacgctaacgggtagtattattgttgggcgtttagggaaagaaatactggattataatgtcattttgtagataaattagcgtgttcaatgtcacttgttgaaatgaggccttatcaacggcgttaatttgtttgaatttctcatttcaatg

SEQ ID NO: 41532 - DNA, 667 bp, Oryza sativa
agaggggaggggaggaggaagaggattggatctgagaagagcaagagaggggatgttccaatcttatctaaatatctgtctgggatttaaccgatgggatgtgggagataaatatttactcccggttgataactccaactgggactaaagatcaatctttagtcccggttggtaataccaaccgggagtaaagatcactcgatctttagtcccggttggtgataccaatcgggactaaagtggtaatctttagtcccggttggtagtatcaaccgggactaaagatcctcgaccccctgacatacatctgacaggggatgaaccgggactacaaatcatctttagtcccggttggtgtagatcaaaattttttaaaccgggactacaaatcgtttttagtcccggtttttaatggaaccgggactattgtgaaatttggtcgaccgaccaaagatggtttctccaccagtgttacggcaccgggagcagcagagggggttggccatgctaggctccgccggaggctttggacaacctggagcggaggatcctcgacgacatgaagcaggctcatgaaaaatatcctcggtgtggagcctgccattgcagagagcaaacctcggtcgttttggaggtctctatttctcttcatctgtcgctgtgcagt

SEQ ID NO: 41533 - DNA, 1501 bp, Oryza sativa
cgttaaaggatcgaatgttaatactatatcgtatgaaagcaacaatcagcagcgcatatcgcccatcagctgaaaagaacattattgcagagacaagcgacgggaagctgagatagcatcggtcgtcagtcttaacaaaaactagtgactaccccgcgcgttgccgcgacacttttatatgataaaagaaaacttttagatgcaacatatatctagcctgatgtattcctacgttggcactattctaaatttatacattacttcaagcgtagggtacacttgattgttgtgattaaaatacaccttgcaactattaaaaaacttacaaaaattcaacaattaatagcaagatagagttatgcattttctgatgcttgcttcaactgagtcaaggtcgttggaaaggaagattgttcattcatccatgctaacgaacttaggctgacatgcatcattccgatactaacagagatataggcctcctatgaaatagcaagtgaactttaattagtacccgagaataaacttaaagaaccattgccgtatgaatgaatatcatagaaaaaatagtggtctgatagggagcttagttgatcattgccatgaagcaacatcatcaggatcaatgtccatagaagcagtagaaaaactgaagaacttcagatcgcggtgagcaaaaacagataaacaaagaacacatgagaaagaaaatagtaacatacgagtaaaataaaaataataatttaaattgtaggccgaggaaagaaacacaccacaaaccatgaaggaatgactgtagcatggcaatgacagcatgacatcaaaaaaaccatcaataatttaaagagatcacagccattgcatccactggtttcacaaagaatctgttttgatcctatacgatggctaagacatgccattgtggagaggcatataaatagtgaggtgagaggataggtgaaaggaaaggtcgagtcaagaaaaatgcaatcgatgaatatatgcatgtaactgtttagtttattgatggtagtaattaagatagaaaattaagcgatatgcatgcaacacaattatcatgggagttgggccggtctcctcgatcgatcccgcataggtttaatccaccatcagctgcgcgcaattagccccgctcgctcgcttcctggcctcaggatctgtttcgattcatctcgcgctctccccacccgacccagattagagagcacaatttggggaaaaagtttcaatcgaagtttctcttttctctactcaattgcttcatggcctgcctgatgttaacttaccttgtctctgcatgcatgcatataatattgtctattatactcccttcgtttcataacgtaagtcattctaacatttccccacgttcatatggatgttagtgaatctagacatatatacatccatatgaatgtgggaaatgctagaattacttacattatgaaacggagggagtaaattgctggcttggtaagct

SEQ ID NO: 41534 - DNA, 1501 bp, Oryza sativa
gccattccataggaatttcatggaatttggaaagcttcaatcctttgaatcaaagggccaaataggaaaatttcatataggatttgaatcctatgaaattcctacataaatcctttgattcaaaggggcccttacattatgaaatggaggtagtagttgctactaaaaaaaccgtcaatgtaacctcggaccatcccatcgcagatgatcaatatgacatcctgccctactacacttgtagacgtgcccattcagtggctgctgctgtccgatttgtcatacaccgggccggccgggcgtactgtgtaggcagctagctacacagtacaacaatccgcggatccgccggcaggggtggctgcctggatgcggctgcctggatgcggtttgtgacagcgacgcaacttggttgtggttggttgccgagagttgcggcggacactgttcgtagctaataaaagttcctgagggtaaactgaagccttgcatgtctgaaactcagatcgcaccaacctagctgttaggactgatgaactgtcaagctcaggtttaggtcacgatctatgtggccaggaaactatgggtgtgtttggctgctcgagtgtcctcagcctggcttgtatgtctcatcatccaggttgagtttggcctggttagtaagatgcaatagagagtgtttggttgtatgtattagatagacctggtttctgtaagatgttgtttggttggttggataagaaaacttgtatgcaagagattgtgtttagttgctcgcatatactttgaatccaattatttttttctattgtaagagtataatcctaccaattatatagaaataataatgtcttaagttcatgcactttaaattgtagtaaaaaaatatgatcaaatataattggttagatcaaatgtaatatcaaaacgtgacgttactgcgatgtgagtactaattgtcaagagaaaaaaaaatggaaacaaactgtgcgaaacagtagcacggagtattacacggactttttttactgtcggtctaatcagggagaaacaaatcagcaacgattttgctatacatctcacgggtgatttttttttactgatatttcacgtttttctatccataggattcctcgctaggatttatgcaataattggtggaggctgcatacgtggataataccatgcgtcggatggtaggcctggttcttttcactttacaaatttttgaaactataaaataaaaaataaaatacaaaattacagtcctatataactaaaattacatgtgtatattaggttgatatgatatgtaagcacattgtaattttgtaattttgataaaaatattgtgtaagtagatatgtattgattattttctttaaaatataaaattatagtaatatataactaaaattacatttgtaaatttagttgatatgacatgtaagtacactgtaattttgataattctttaaaatataaaattataatcctatataac

SEQ ID NO: 41535 - DNA, 1501 bp, Oryza sativa; identical to SEQ ID NO: 27910

SEQ ID NO: 41536 - DNA, 1501 bp, Oryza sativa
ataatcaacaaaaaaaaaagagcaaagaaaacaccatctaaaataccgcgagatccacacccatgttctaggcttcagcgagagctgcgagaccaagcagctaccagctacacatatcacactgcaggccagcagacactagatcgaaccgcgagtagtcggaaggggggaaaagcgcaagcgatcgcgtcaggtccgccggatctggacgagctggagcgaaagcgagaggagtagatcgagggagaggggtggagcgtacaggaaggagggagttggtcgtctccgggaagagccggagaggaggaggaggaggagatcgcggccggcggagtcgccggagcccggaagtttcgagagcccaccgccgtttcgtcctcttcacttctcttcttttcctcttaagtacggagtaatactgaatttacttgtactgaattgcagtagaagcctaatcaccccacattagcccatcaaaagctacagcccagatattttcggcccagggccggatagatcccttttacaccgttctcgaggcacacactcctcctttactccttagcaaaacttccccttcacgttctcaataaataagtaaataaataaatagcagctttcacttcacaaatttcgcaaacggcccaataacccgaatggcatatttggaaacaaaaagtaatttgtgaataaaacttttatatacgtgttcttagctatctaaaagtaaaggttgaaaaataaacttcgatgaaaaaccccaaaattagctcaaaatttaaagttcaaaaattcaagttttggctgaaaagtatgagcataagcgaaatatgaagtcggaagtcccgaccgccatctcatcccgtcgtggtgtaaacacgttatctaaattaggaatctttacggtcatttggaatcataagaaacctaggggtgttggcttagaggctaaaggcttctttctagatacttgtttggtgaggtaaagggttaatactacagtcccaactctctaaagcttctcaatagagagtagaatccttgtgatctgaacttcgcataaaaatctttatctccctttgtcttgtcccgtgtgccctcttcctatttttacttgttttttttgtattttgtttctgctagccacctactatattattatgtgtttacaggggtgcttcatgcttggaacaacaactcacaactgcttcgaaattcttaaggaagaaccctaaaagttccgattagctttctctgcttggctaaaattgttaccaggaagttttgggccattgaatttgatcgttgtaatttgaagtaattttcaagaacgtttgttcatcccctcccctctctacgacatcctactagctttcggcgatgtctctatgtcgtgtgcacttagagagagagcgatctaagaagaaagaggaggatgacaagctgcacgagcaccgtcaacggttgccttgccatggttgtcatcaccaccgtctttggt

SEQ ID NO: 41537 - DNA, 1501 bp, Oryza sativa
tcactttaatgtcaaaaaaaacttatcaaattttgtcattgctaaaaatttgatatagttgtcaaaattttagtatgatttcttatatagttactaaaatttgacagcgaattaaatatagctattctttttagcaacattaccaaaaattagtaagattgaaaatagcttcaaagtgaacaagcccttgctgtctacgctgggcggcttctggtccggtctggtggttggcgtttcccttgccgccattacttgctgatcgatcgccgaggccttcttcttgggttcttcctcctccgtcacacatgctctgcgcccaaggatatgatcgctccgatccaccgcgcgcgccgcggcggccacggcccacggaccacgtgtgcttccgggcacgcggggcgcgtgtcgtttggatcagaattagctgctgcgttattgtaagctcaagatactgaaagaagctatatagccgctagaagttcttcgagcagggccacagctaaaagagagatagagaggagagtgtctggtcaacatcacattttactactccctccgtctcataataggtgacgtttttgactttttatttgcaacgtttgaccattcgttttatttgaaaaattagtacaaatataaaaaaagataagtcatatgtaaagtacttttaataataaagcaaatgacaaacaaaataaataataattttaaaattttttgcataagacgaatgatcaaacattgacaaacaaaaactcaaaaagacaattaatatgggacggaggtagtactaaactactgctccctccatcttaaaatatactcccgccgtccctaaatatttaacgtcgtttactttttttaaacatgtttgaccgttcgttttatttaaaaacttttatgaaatatataaaactatatgtatagataaaagtatatttaacaatgaattgaaaagaattaataattacttaaattttttgaataagacgaatggttaaacatgtttaaaaaggtcaacagtgtcaagtatttagggacggagggagtaatggattttggttgtatctgatatatatactttcttatattttgggttggagtgggaaacccacacttcataaggctattgtttgttttgttatcatatttgtgatgtgcaatagttttttaagccttaggatccacatgttacgcgcttattattttaatcaaatatatttctaagaagtgtggccatcaatttgttaactacacttttacttaggcttacaaaatatgtccaaaagagcgcatacgtttctacgtaaaggccatgagcttagaaaattttctaagatgcacctaagtttgatggtattccacatgagacgaaataggaggagcaaacccctatatagtttgaaaaaagtacgaattaccccccacccctcaactatcgccgtcgactgaattatccccctgaatcacaaaactggacattattcactcccacgcaaac

SEQ ID NO: 41538 - DNA, 1501 bp, Oryza sativa
caaatatgccattcgggttattgggccgtttgcgaaatttgtgaagtgaaagctgctatttatttatttacttatttattgagaacgtgaaggggaagttttgctaaggagtaaaggaggagtgtgtgcctcgagaacggtgtaaaagggatctatccggccctgggccgaaaatatctgggctgtagcttttgatgggctaatgtggggtgattaggcttctactgcaattcagtacaagtaaattcagtattactccgtacttaagaggaaaagaagagaagtgaagaggacgaaacggcggtgggctctcgaaacttccgggctccggcgactccgccggccgcgatctcctcctcctcctcctctccggctcttcccggagacgaccaactccctccttcctgtacgctccacccctctccctcgatctactcctctcgctttcgctccagctcgtccagatccggcggacctgacgcgatcgcttgcgcttttccccccttccgactactcgcggttcgatctagtgtctgctggcctgcagtgtgatatgtgtagctggtagctgcttggtctcgcagctctcgctgaagcctagaacatgggtgtggatctcgcggtattttagatggtgttttctttgctcttttttttttgttgattattttttttacgtgggttgattggttcgatcgtgatttcagctatttttggcctcgtagtttgctccggaggatcggatcgtgctaattgccaaattgattcaatggatttggattgtcctgtttgcagggttcggggtgctgattgacgcatttagtgttgtgtgcttgagtaatggcaataggggagtggagttagatgcatttggtcatgtggtgtctaagtcatgtctcatgcatgatgacgcagatgttgtagtacgagcacccgttagtattggaaaaattaggtttcgttcatctaggggagttattaatgtagtatataaatcatggaattgactgttctgggtactaggtgaattaaaaataggatttgaatgttttgcccctgcatttatgaattttcccagtggtaggttatgtttgcgagctgctatgtgacgtgtttaatggtggcattcttattaaaatttgtttagattgaaacaatatatttcgtataaatgaattagggtccaattttttacttgctgttgatacggatttgtgcaatggattagtcatccttagtcaccggaaaatatgtgattctaaaattgccctaagaaatgtgataccgcaaaaatgcaaaatgacatgaaatgcttgggcggtggtgatggtttctttcctggattgcttatttatatgttgactagaaaactaagtatgtactcttatgaagtataaataacacttgaagttggaactacacctgaagcacctttttttcctggcaggttcatttggtattctggtgcagtttgcagtggtttctggccttcttgacaaaa

SEQ ID NO: 41539 - DNA, 492 bp, Oryza sativa
cttagaatttctgaaagaggcaaaggtatgttcaagaatctttttttctttagctttatattctgttttgtctttctgttaccatgtaattaggtagtctgtagtccattatagttgcggttggctgaagatattttcttctttagctctttcactctgcacactgcatatcacttctgtatgtacaaccagtttgaaacggcagtatgtatatttggatatccaattttatttagacatttgccttttgcagttttgctgcacatacaggcaataactttaatttcttagaacttagtaatccttttggtgcctgacatcacattattgatgctttctcttaaaaattattatatcagtacagttatttttccattcccatgatggatgccatttattttgccacttggatctcatgttttaaatattttgtaccaatctatattgccgatgataaccttattttcttttgttgatttggaacattctaga

SEQ ID NO: 41540 - DNA, 195 bp, Oryza sativa
tttgttcctcaagtcttgcacattactttttcaactctaacaatatttatgcggttttcataaatattacctataaacaaatgctatttgtttaagatactctatgcttgaatattaaacatgagcaggtgcatatacttatttgaaattctgaaggtagtgctatcaaacattcataacagaaaataatattta

SEQ ID NO: 41541 - DNA, 326 bp, Oryza sativa
tggagcaattaggcttaaaagattcgtctcgcaaattagtcacaatatgtgcaattagttattttttagcctatattttatactttatgcaggtgttcaaacatttgatgtgacactgtgaaaaatcaaccaacaccaacatcaaatactccgaactaccgatgcagatttggcgctcgacgcgccgggtcatcacaacaaacgagaaaatagtgggctactcagtaaaccatttctagatttttgagtgattttattttgatactacaaagtgcatgtttctttcctattgcggataccttttttttcttttttctttttgcagg

SEQ ID NO: 41542 - DNA, 591 bp, Oryza sativa
aaggggaggggaggggagaggagaggagagtgagggggagaggaaaggacttagaaaaaaattcgggccatctgccatgtatatatatcacgctaattttcgcaggcgttgcttaagtggtccgcctgattttcgcaggcgccgcttaagtggtccgcttgcggacatcaaatttcaccctgacttatatttttgtagccggtcatttggctctaaacgtcatgtccgcctgcgaaaataagacccttacgttgggaaaaatgctttttctagtagtgcatgtttcatagtttttctgttaatatttaaattaaaaaatgttagccataccttcacaagaaaaaaaaagtcctagcatactttttaattattgacgcgtcaaaattaactttttaagaaggttacattgttatagcggttttgctattttacttacaatagatttttcagctcttttttttatttttcacataggatcttatatcaagattcaggttctctcgccgtctagcgcgtctcctgtcctgcacccgcgcgcgcgggctgtggccacaggaggaggtagaggtcggttgatcgagatggggtcag

SEQ ID NO: 41543 - DNA, 177 bp, Oryza sativa
aatatggattttttaaagcaactcctctataaaaattttttacaaaaaaatgcaccgtttagtagtttggaaagcgtgtgtgcgaaaaacgaagtgctttctccctcaatgtcctccgaacgaacgctgccttagagtagttataggtcatggacgcctgacggatgacgactgaca

SEQ ID NO: 41544 - DNA, 872 bp, Oryza sativa
ctccatttcataatgtaagggcccctttgaatcaaaggatttatgtaggaatttcataggattcaaatcctatatgaaattttcctatttggccctttgattcaaaggattgaagctttccaaattccatgaaattcctatggaatggcacattgtatgtggattttggaggaaatttagcaagagctccaacctcttggaaaatttcctttgagtctatcactctcatccgattcctgcgtttttcctgcgctccaatcaaacgaccattcatgtgtttttcctgtgttttgcaatcctctgttttacacttcaattcctgtcagaatcctgtgtttttcctattcctccgttttttttaccctgcgattcaaaggggcccttaagtcattctagcatttcccacattcatattaatgttaatgaatctagacatatatatcgatctagattcattaacatcaatattaatgtagaaaatattagaatgacttacattatagaccggagggagtagcaagcacatactacacgagaatagaatagaatccttatttacagtatttacattaggtagaaactagtagaatatatacttgtaactataaaaagttatttcttgaggacctcattattttgtataacttcgtttacgtatgcctttggagaaaataaattttgaagcaacacaaccgtattataggtttgttaaaaatttaaaaaaggggttttttggggaaaccggaaacctcataccacgtggcacgatgcggtttgaggatgctcctcatgtccaaaaggatttaaatataaaattaaagcttaagagggagttcagtgtaaaagagatccatgtccagcttgtttggagc

SEQ ID NO: 41545 - DNA, 386 bp, Oryza sativa
aattatcaatggggtttacttttttttactttctagaagtcgcagaaaccgccttgcccgttagctccatggcctgcttgtcgttccttctttaatcgtcattaggattctatttggtgttttattaaaagtttttatatgtcgtatcatccgccaccactatactcctttataaacctgttatttaatttatctcgtcatatattttagatgatcttttttttttcaatagtctttattttttatcaccaattttaattatttataatttgtatttctaattgaaatctttttttctttttctaattttagaatttattttttatttttgaatttaagttgtttcaaaattgtattcctacctgaactctcttttattttttcta

SEQ ID NO: 41546 - DNA, 302 bp, Oryza sativa
tctaaaaaatcgtggattatttcgtgactggatgaaaatgaatcatcacgaggcatttgtttggtagaaaaatatgtaaagatgtgccaaaactgggaagttaatgttatataataccggagaagtctagaaatatattttatatttaaaagcaatttttatataaaaagttttttttaccgaacgcaccgtgtgtaagtttgaaaaacatgcgaacgaaaaccaagacaaaatctaaatcttaactagagtttaaatcacatcatgaagcaaccaccaaacccggcccatagacacgagaa

SEQ ID NO: 41547 - DNA, 852 bp, Oryza sativa
ttccacgctcatcagcacttcgccggcgtcccaaccaccgcgctccaagaagcgacggcgggcgacggccaccaccaccacttcttggtgctccacttcggcaagagctgggccgggctccgggacgccatgtcgctccccggccgcttccccggcgccgggaggagggagtggcggcgtcgacggcgaggtgagggcgccaccgccggcgccgtgtacgggtggctcgcaggggaggatgccacctccggcgcggtgtacggctggcccgccggggaggacgacctgcacgacggcgacggcttggtcgggaggttcctggggatgccggcggcgcggcgaggagcgcggaggacgtcgagagggacgaagggagggtggcggcgaagctcgcggccatcgccggcgagcacgagaggcgggccgtgttcttgtagcgcaagtgcgaggagatggccggggcggtgcagaatgcggaggcgggcaacacctcgctgcacgacgagctcaaaggtttgtgagaaatttcatggcgaaatcgttgatatctctgtccgaatttgtgaacggtttgcacgaaattcatgtcgaattcgtcaatatcttcgtcagaaattgatttgttcagagattgtttggtgttgataataagcagagctaagaaaaatcgctgaaattatcatcccggagatgaatcgtgatgtccatgctcaaatgctgcataaaattcataaggtttcttctcttatcttcaacactagaacaattattagcaaggttcatctgtaccaattgcgatcatcattagacacttcttgcctaaacttatttgtatatgtttattattgtagc

SEQ ID NO: 41548 - DNA, 995 bp, Oryza sativa
gcttaatattgagtcactaggctccttgtgacttaacatctagatgcccttggattaatttttcaaggcagattttgcctcttgagaaccatgataacttttagattttcctgccagaatttcaaattgttgatgttatgcaatatttaatctatcgttgcgattccttatttccgagtgtaatacttaggaataattgaataattattatcttggaaacatcattaggatgatactttgctaatcttcatgatatttgagtttgcctgcctacctctctgtttcagagatttatctttggatgatgtgtgggaatatcaattcaagtttgacaatatattctactagccttggacaaaaaaaacactctcctaacattttgttttcatgtaacaggatgaccaagaaggtgtcagaaccttagatgatgataacttcattgatgatactggggttgatccagctgaccgttatggcagcgataatgatggccactcacctcggcattaccctcaggtatccatcctaacatccttaacttctcagatgcttttcaggttattattgcatttcaagtttacatgaaaattatatggagaaggaaaagaaaggaaatgggctctatgacaaaaatatttgacactaagttatatgctgtggctgcttatatttatgtcacataccaatgattgattatagtgactaatgcccatatcatagtaggtaaggttatggactttctcaactagtatttagttacacacatgctgatatttgcatcttccagaagttttacatagcataattaccctgcaggaatcatagggtataatatccttgttgatgaagctctaatgccttgctgtctcatagatttccaattcaaaatagtcggtttacactagaattgcataatattttgtctgtcctgctttattttttgtcttgtggctaccattctacattgcaaactaattctctttatcataggcaga

SEQ ID NO: 41549 - DNA, 671 bp, Oryza sativa
tattaatttcgtgcgatggctgttaacaggatgccttgtcctcgtcctaggggaaacagccacatcatctcgcgggtgaatctatacatcgatagtgtagttttgtgaaacttaaacaacaaaatatatttactcaagtgccaagtgtcaaagtgcgtgtggttttctgcaatttggaccagatgttacatgtagttttgtgaaatttactcttaaaaaaaactccctccattccataatataaatcgattgactattttcttatcaaactttttatttttaataaagtttatagtaaaatatattaacatttacagtataaaaaacatattatcaaaatataattaatgttcattaatttaatgaaactgatatagtgatgtagatgttgctaagttttttctataaatttgatcaaacataaataacttttttaaaaaataaacatataatatgaaacgaagggagtagcagccaaaattgacccgattgatagttattcttttgtttgccccctagcatatttttctctatccctggctttgatttttcatgccatgcttatctttgctgctggggttagaattggatgaaaacatgtgatcatgtggaagaacaattatctattatattaataaattagtatactacttttttttctaaaaatatat

SEQ ID NO: 41550 - DNA, 1501 bp, Oryza sativa
tatagtcttctataacttcatataatttgcataacaaatatttaaaaaacttacagcaagacactggtacaaggtatagacttattcagtgctttcactccatcatcagtacatactacatagttcatcaattatcacagaacaacaacacatatcaatccatcaatatttcagtacttagttcaatctcataacacatcactccatcagtattcatcagtcatcacaaaacaaagttcaaatcacaaatctgtatgataaaagaaatcaaatcaacggtttaggctcaagaacaccgtctgtctttagctggacatactagcagtctgtctttattggagtgcttggtgaatggcaatagaacatattaataatacagttctcttctacaaaattaacagaacataatataagcagaagcaggaacacctgctgccactgggctactggctgctgctgcctgcaaggcgaggcgtcgtcggcatcggcggtgtggccagtggccggcgtcatccgcgtcggcggcggcgtcgtcggtcctgtggctgtggccggcatcggcagtgtggtgttgtggccggcgtcggcggtgtggccagtggccggcgtcgtcggcgtcatccgcgtcgacggcgtcatcgtcggtggtggcggcggcgaaaatgagcgagagaggaagggcgacgagacggcgggggcgaggtcgcgactcgcgaggagtcgactagccaaggacggcggccagcggtggcgtgctcgactcaaccccctggttgcgctgcctctctcctagggttagcctctctcctcggttagtagggacttgggttgggctgggaacttgggaaggaattatggactatttggatgggcctttttaacttcggaaattccgacaaactttccggaatttttccgaccgattccgagttccgacggaaactgctattatcatattcgattccgtttccgaaaaaatatttccgttttcgattccgtttccgagaaattccgaaaaaattccgaccggctgattccgtttccgaaaacaggtccggaatccggaaaaattccgaaccgttttcacccctactcacactagctagggcaccacatgcatgcacttctttaatttattttcgaaacgagacctatgttatgtgcatataataataaaaaatgacaagagaacaaatttaaagcataatagctaacccaaaaggaaatatatcttatttcggtagaaattttattattaaagtggatgcaagccatgaacccagggcatgtttagattactaccaaaatcaatcttaccaaaatttgtcaatgccaaacttttaacttttagcaagttggcagaattgccaaattttaattttcctaaccatatatttgtcaatttcaccaaataatggtacgatttaaaatgacacgaatctaaacacgcgcccccacttataaactaattagtaagtaaaccgtatatcaatccacgatt

SEQ ID NO: 41551 - DNA, 1501 bp, Oryza sativa
tagatcagtagatggcgataccaccggcactggctcggcgagaatcggagcacgacggtgctgcgtcgtccaacatcccggcggtgctgttggtgctcggcgtcgccaccgtctccgtggctattaataacaccgccgcggctgccaccaactaccactgctccctcgccttcgccatctctctcgctgggggcattcctctccggcatggccatgatcggcgcttccgtctgggtgtccggcgacccacggggccgcactgccgctggtaagaagatcatctacgcgtccatggcaccgctcgtgctggccgccgccggcctagcggtggtgatggcgcactcttctgcaggtaactagctctaatatgtactccctccgtcattaaaaaaaagacaatcaattttcttatagtgcaatgaatctggatatatggttgtctagattcgttgtatttttgagggatcatatcctttttagattgttctttttttagaatggagggagtatggtcttgacgctgacgacgcactagctaggtttacgtatgtcgcctctgccgtcgggccggccaaccgcgagcgccgatgaaataaatgaataaacagatcatgtagtacgcacctagatctagctgcgcgcgtgtgtgtatatatatatatatatatatatatatataacattgtaaattaatggatatttgtactttttattggagatctccatttacaagtctattgcttgtaattaatctttcatggcgcaatttggaaaaggaaaagaaaagatacgaaaagggaagcttgacgggatggggagaagtgcgtgtaggcgtggcgctgctgccgacctgcggcgagcgtactgaccatcgtgagctgcggcactgcggctgcgccccccaccggctgtccggtgaccgaaatgatgatactggtttgattggggctaactcatgcatgcaccgtatgctcgatcgggacaactacagagttagtgaattttctaaagttaagagagatttcattaatgactaaacattagattacattcttggttcagaagttcaaggatttctgcacgagcacataatctccactccgtatcaattcgtgaacccattaccatttgagacaaagcatgagctatctcatttgaatctctccttatcttatgtagtgtcaaacactacatggccgctttaatttctgaaattatgccaccccattctgctcttgaggccgagttatattagtgatatttgatatgcgttcattagtactctcttaccgtgttctcaaattttaactgtgcacttgtttactgtgtactccgtataatatactccaatgcgtatcggtcgccagctaggcaaatcgagtagcacctagctagcgcgtggggctagaaagactctgtgctttttataacgtcagtgctcccgtctaccgctggtccgctgcgtagcctgcggttatcagctaaagcgatgacgtggaga

SEQ ID NO: 41552 - DNA, 1501 bp, Oryza sativa
tattcatttactttccagtagtaaatagtaagccacacatctgcatctggtgttacctttgctgttgccatttcataaaatattgtcaatccattccaaatattatccatcggagtatgaaatagggtcttcgtctattggatattactaatgaagtttttgacacatgaaaatatttttttagtgaattggttgtttatagttataggattgattaggtctcacatgtccattttagtaaaacgttttctcccaaatgatggattgattctgttcaaatttcatcaggtgcttatattggcaatatttccattcggtgcattgatcttcagttcaagataaataatggtctgcgtatgttctatttttcttaccgttgtcattgtcaaatgtttgttggggatgttactgatacacgagcttttgatctacacaaatgccatggtggttgttacctctaaccatattatattaccattgcatttatatcttaagatttaaattgcatttcgacataaagggattatgatattttaaaatttttctaatttacgtttggtataccatgacaataatatagcagtttaggtttttagttaattgtattggttgagaatgagttggagttgttttgttggatttctatcgttacaattgttgctttcaattgtgtacgagaaaatatttcaaacttaacttgacaggccatatatattctgcagtatattttacacacccattggcttggaaactaagtctaactagcatattttatttgattcaaccactcttttgttgattaaataatggttagtttgtcccagattatttgaatttctacatatataattgatcgccttttttcatgactttcttttagtagagtttatggtttgatgcatgtggtttactatctgctacgtatgttaacttaaaaaggaatctgagcttgtaatagttgtgtgctactattgtcattttaacatgggtctatattgtaactgggatctacctgaagttgagttggtggttctactattttgtaatcacgatgaagttgacttggttctgccattatgtaatctcaagcgatatgctgatttttttttcttatgtctatacatattacgagttggtgaattctgtacatataatcatatgattatatgctcaaacagtgttttccagcttcccgcggcaatgcgcgaggtcctttctagttaaacctctagttttcctgcgaacggtgcaaggctcacgagaggcctccacatagctacagtgcaacagttctctctccccttgcgtcagccctccgatctgacagccccagccgatcggagccgttcgtgtgtccgccacctctcctagagccctcgtctctcaccctaatcccaatactagaaagaaacgtgcggcgccgcgcacagctggacatgatttactcttcgccttgttcggttgggccgggaacggccgggattgggctggaaccccatga

SEQ ID NO: 41553 - DNA, 1037 bp, Oryza sativa
actggtttgatgctttggtagatgctagttaggaggtggtcttttgcaagggctgttcctttttcctttaggccttgttcacttaattcagggaggagatttattccgtacctcgatattgtagtatagaattattccccctcaatctcctccaaaccgaaaaaagcctcagaggtattcctcgaaatgacgtgtccacgtgtgtgtaactgtgtatgtctaaactctaaagcttgttcggcagcaacagaaaatttcctagggagattcaccccagaggggggtttgggtttctcccgccacccaatccccttccagttcccctccaccatgggatgtttgtttggatcaaggggattggtgggataattcctaactaaacattaaaatttgaacacttcacacaaggcttaaagatacgctacaggaaatttcatgatattgtacagaattttcaaaatccatttttcttgagaaatcaaaatccaaaggccttgtccgtttccttgggtttcaatccccaaggggaatctatccagggagggagtgagtgaatccctcccatatcactcaatcccattggggtttgaatcccttgcatgatcctaatccctctcctaaatcccatgttcgttttgactgggatttcatacaaaacaaagcagcagtatactagttgcgtttgagctatttgtatgcatcagatcatgaaaaacattaagaaaaagaaagcctgttctgtacactgcaagtaagcactgctgaatcaaaagagctcaaaaacatggttgtcaccgtagcataaacggcaagtgatgtcacatgtgtccactcactacaatcagtaaatcacataaacaatgatgaattcatcaattttactcatgtcttcaggccatcttcatgccatcacctcagcataagaaatcttgctggggctttgcatgatggcagattgccagactccctgcaacacataatgaattcgaagacaaattagaagggtgaaagccccctaccaaatatatgcagaagat

SEQ ID NO: 41554 - DNA, 1501 bp, Oryza sativa
gcttaaaaaattaaaattaatccatttttgaaaaaaatagctaatacttaattaatcacacactaatggaccgctccattttccgtgcggggagatgggttcccaaccccagtaaccgaacacagcctgaaaaagaaaggaaagttcttgatttcagcgggtaaattttatgttcaaagagaatcaatagcatacaggaaaaacaatagctcgtattactaaagatgcatgctaactactcaagagtaacccccccccccccccccccccccgcggaggcagtgacaaaagtatgaaatatagtggttaaatatagccaagggataaacattaaattgagcatataaacatcacatatcatatacttgttgcccttagctgagctgacggctctaatgaacttcaaaaatccatatttgactttggttgtactgcgtatacttgcatatgtcactataattacaagttgatacatgtatgcattccttgtcagactctgctatctagcttgatcaatcagcatgcctagcttgtgcatagaatagaaaagttggattcatcaacactctattcagcaatagatgcataatgaataaaatccgttcaaaatgacagtccaaccgagtctgacaaacgagtgattgtagcttgcaactgtattctggaatcaactacaagtgaaaatcaaaatatctgaacgacagtagttgtgcgcgcttgtgcaacaaaaggagtatcacggaccaaccttttcccttctaagtttattggccatgagtaaaattaaagcaagaaaatctacaaacgaaacttatgtgcatcgtactatgctaaataccgaatatcgcgaattcagagttcagagaagaacacaagaaacatagtgtgtatagtgaatgcagcttgacagagatgtcaatatgactgaatgaaagcaatcttttatgttcttgtgttgcggttacaaactgtttatgctctgaggccaataaaattgtagcagtaaatctttttgctacgttttacaacatttttgctccttccatggttacttcagtagttcaattcatggattgctgatgatccatagctcatctgacacacaactataccactttagtttttaggaatgctacgatgggctcataaagtccaggaatcatccgaatatgacacacaattatgacactactatgctagatactggaatttcagagttcaaatttctgaccaagaacacaagaagaagaagaaaaaaaacagcaccaagaactgcaactcaggcctcccactcctccaattcattgcaagctatacctccttatcctttccgctcactcctcctcctgtttggtgctcgccaccgaccgccgccgccacgcgtgaggtggggatttaatggcatcaaggaaccctaaccataggacgaaggagagatgaggggagtagagatttaccggcgagaacgtggtcaccaaaggggactgccgccggagggggg

SEQ ID NO: 41555 - DNA, 1501 bp, Oryza sativa
cggatgacggaaagaaaataattacttacttaaaattattgatttttgaattatccgttattgttcgtatattgtctgcattatgcaccacacacaatatccgtggatccacatagttgcctcgtgttgcaatagataaaaactaaattaaatttatgttgacgtaaaaattaaactatatatcataattatgaaagctaatggcatagccaaattatgaaaatcagtgttattattttttcaatgggagtattgttttccatttataaatcacattgtcaaatatcgaaaaaaataagaagcagattagacgtagagaaaaaaaacagaaataaaaactatggaagcagagtgacagggaagggataagaaagcagcagcagagcagtctcggacctctcggttcttccattctcaatttatctctatacacgatactctgttcttatcctcccatctcactctcttagacactggcagggacatgtaaaaaaaccgctccccatcactttccccatttctcctcctgctcagctgctctcgatgaatccgccgtcttcctttttctgctctttcctcttggttttctctcctctcatctgctgctctccctcctcgaccacccaccgacggcgccactccctctccgccgctccccctccttgtccctccaccgagcccaccggcgatggatccaactcccccgaactcgctggcgatggatcggccttctctgagcttgccgacgacagatccacctcccctgagctcggtccagccgtcgtcggcgttgggtggcgaatcagtcgacgccgatagcagatcgagctccccaacggtggattgagctgccacaacggtgcagttcggtgccgagcggattggggcggctttggcctttaggcggagggagtggtcgaagacggggggaggctgagcgagtcgtggatgccggatccggtgggtttttcttgtctcgtgatgtcctccatgatcactatttggtctgattggtgtttgttttgttggatttctcaggatctggtacagtggacgaatgtctggctcgacgtcccgttggtgcttcttctggtcgtccagtcggctctcaaggcctggctgcggcccgccgagtttgagagctcgcctgccccgtgcctgccagtgactgatgtccttgattcgccgtcagttccagccactgacgcctatggtaattttcatttttaagataatatatcatgttattcatgtgaaatcttgggatcatcttgcattggagcaattctgtttttgaaatgggggaattgcggaacaccagtgtatttccatgctgattaatttggaacatagcatagtgaacaaggtgacaggtggttatcttgatcttaaactgtctccaactcttcattgaatgtttctcagatgaattgattcatttaattcattaaagccacaggcatatgctgaccactgcatttcttgtacaatgttgaacagg

SEQ ID NO: 41556 - DNA, 1501 bp, Oryza sativa
tggcggtcgccgcgtcgtcgtgggcggcgggaaggcggtgctcgggggcgaggcggtagtcggcggagaggacgacggcgggaagctcgtgggcgaggcggaggcagcacgcgtggaagttatccatctcgaagctgccgatgaagtacccgccgccgtggaagtagacgagcaccgggagcttctcgccggcgacggtagccgccggtggcctgtacacccgcagcttgaggccgcggccggcgtcgtagacgacgtccttccactggacggtggacagcgcgggaggcaagaccggcggagggaggatgttgtagtcctcgaagcggatcaccgtgccgtcgctgaagagctggaggttagggccgcagtcctcgacgacgtacggcgccggcgtggtggacgccatggccggcgagctctcgcttggcgaagtggactcaggcagctcagtttgactcatgctgtaatcgactcctcggctccactacagctgggaatgagctttccggtactatttgtagcaggagtagctagtagtagtaatcgattagaactttgatgcaagtgtgagacgattgggtggcgaagcacgtggatttcgttgaatagttgccgagggctaatttcgacagattcatgataattgcttggcacctacggatgcgaagttgcttgttgaccactgcaattttgatttggtgatttgacttttcatcgtcatgcgatgtgagtagtgtacgactgtactcctaccgagtagcagtggcggatcacgcataatctatctgctgactccacagcttgtttaaacgctcttataaaacttgatttttatgtataaattcagaaaaaacagagaaataattacactagaatacaaactagaagtaatcgaccctatatagttaaatttttggctccgccactacggagtagcccactattttctcgtctgttgtgatgaaccggcgtgtcgagcaccagatctgtatgaatgcgtcaagtgcagcacatgccgtcgttgccactaagatctgcgcctgattagtgttgcaagatctttttgcattgcccattttggatggtcgttgacgcaagttcgctacgaacaactgttacttagaaggcacaggctcagaataaattttaaactctcgttcttcgttatgtatacgtcacttaaatagttataaacttacttttaaaatattaaaaaaatatactaacatgtgatagatcactctacaaaatatgcaagttaaattttgattcttacaagttaaaaaaaatgaaattacagctagttaaaatatatttacaattttttttcgttctaacatgtaaaacttaaattttaacttccatgtttatgaagtgatcaatcatatattaatttattttattaattttttttaaaaaatacctatttaagtgtcatataaacaatgaaaagatattccctcaaaattttagaataatctttcaacataatactctg

SEQ ID NO: 41557 - DNA, 1501 bp, Oryza sativa
gaggacgaatcgaatcgattaccctgcagcttggagaaatcatcacttcgggtgctaatatacaatgagctgattaattaggcacgacaataatatgcggggcgctgtcgcagcacgttgatatactaatatggagtagtttgtatattaatcgaagctaagctctagaaattaattgcttgcgcctatacgaatgtgaagttgcttgatagccactgcatttttcgttctgtgatctgacctctcctgtaatatgttgactattgagctttcactaaagggaggagtcgtcaaccatgtagcctaccctctccgttccaaaaataaaccaatcctagctatgtatctgaactgaacatgtgtgtccagtttcgtagctagggtttgtttttattggaacagagtattatgttgaaagattattctaaaattttgagggaatatcttttcattgtttatatgacacttaaataggtattttttaaaaaaaattaataaaataaattaatatatgattgatcacttcataaacatggaagttaaaatttaagttttacatgttagaacgaaaaaaaattgtaaatatattttaactagctgtaatttcattttttttaacttgtaagaatcaaaatttaacttgcatattttgtagagtgatctatcacatgttagtatatttttttaatattttaaaagtaagtttataactatttaagtgacgtatacataacgaagaacgagagtttaaaatttattctgagcctgtgccttctaagtaacagttgttcgtagcgaacttgcgtcaacgaccatccaaaatgggcaatgcaaaaagatcttgcaacactaatcaggcgcagatcttagtggcaacgacggcatgtgctgcacttgacgcattcatacagatctggtgctcgacacgccggttcatcacaacagacgagaaaatagtgggctactccgtagtggcggagccaaaaatttaactatatagggtcgattacttctagtttgtattctagtgtaattatttctctgttttttctgaatttatacataaaaatcaagttttataagagcgtttaaacaagctgtggagtcagcagatagattatgcgtgatccgccactgctactcggtaggagtacagtcgtacactactcacatcgcatgacgatgaaaagtcaaatcaccaaatcaaaattgcagtggtcaacaagcaacttcgcatccgtaggtgccaagcaattatcatgaatctgtcgaaattagccctcggcaactattcaacgaaatccacgtgcttcgccacccaatcgtctcacacttgcatcaaagttctaatcgattactactactagctactcctgctacaaatagtaccggaaagctcattcccagctgtagtggagccgaggagtcgattacagcatgagtcaaactgagctgcctgagtccacttcgccaagcgagagctcgccggccatggcgtcca

SEQ ID NO: 41558 - DNA, 1501 bp, Oryza sativa
agctccatctaaaatgggagcggagctgggtggaattctgtcacaaaatgaactagagagatggaaatgggtttcggcagctccacaactccactccagacccaactcctgaagctaaatttaggagttgaagctttaccaaacaggcccgtagtagtacggtagcatcacgcaggcgttggactttgggggataggggctgttagttcccatccatacatggtcaccatttgttaataaaaatattaattaaaatgaaattattagccataccttaacaggaaaaagaaaatactagcacactttttaaatcattgacgcgtgaaaactaacttgttaaaaaggctatattgtcgtaatggttttgctatttcacttacaatagattttttgggctcctgcttttttacctttcatccatatataggatcttgcacatcaagattcatgttcctgaagacccaatttacagttacagtgcacttaaatataactgtttttttaatttatgatttttgatatattgtctttttttatttcattcaaaacaaatatatcccttgatggaaaattctgtaagatttaaactacaaatctactattgaaagatcaataccttgttataattgtggttagtttcaaccaataactattcaaattaatcgaacttatctaacactagtatacactccgtccgtttcaggttacaagatgttttgacaaattgctttaactttgatcaagtttgtagagaaaaatagtaatgtttttaactcaagtcaaatttattatgaaaatatattcaattattgatttgataaaactaatttagtattataaatattattattttttctataaacttagttaaaatttaaacagtttgactttaatcaaagttaaaatggtcttataacctaaaacgggggaacaatatagacgtgtatagacgtagtagagtttaaaaaaacatagacgtagggtgtgttcgaggagaagaggattaaaaagattagaaagatacacaaaacgaggtgagccattagctcatgattaattgagtattaactattttaaatttcaaaaatagattaatatgatttttttaaagtaactttcctataatttttttttgaaaaaacgtactgtttagtagtttaaaaagcgtacgcgtggaaaacgagactcaatctccccagtctacccgaacgaacgatgccgtagttaaccgtggtaaagtttgacttagtagtgtattaaccaaacgctaataataagtacagcggcgtcagcgagtacgcacgcacgcgcatgctgcgcccccactccagtggaggagtactccactaggcggccactcctgttgacgccgagtataaacaaaacccaaaagcggcgagagcaaccaaagcccaagtttgtggggggcaatagctcccgtcgtctctcgccgtctcgtcacacgaggaggaagaggtcgatcgatcgatcgagatggggt

SEQ ID NO: 41559 - DNA, 1125 bp, Oryza sativa
tttcgcacttaggatcacgatacaaccagccactttaaaaaaatttaaactcgaacgaaatatggcataccacttagcctactttgcaccttcatcaaaattagaccataactctttagtaaaaccctttgatcaacatgttaaacataatgcactctaccactatatgaaattacttaatctctaattcaaaatataaccacatgaaatgatagccataagttaaacagtacacagagatgcagttttttttatttttatttttttgatattttattttcacacttaggagaatacaagaaccaaccatagaaaaaataaactcaaacagacaaaatatgtgacttgtagaattttccaaagctctatcgaaaaatcattcgggtgtcatttattaaaataggcgtaactttctcatacggactcgaaatcaggaaaataatatatccacggacatttacagaaaaagttacatccaattttcccccgctttgctgggttcggcgatattaaaacctccaaattccgcttgcaagattgtgttttcgaggagagaagtttttcggtagagctttgaaaaattccacaagccacatatttcgtccgtttgagtttattttttatatggttggttcttgtgagttcctaagtgtgaaaaaaatatcaaaaaaataaaataaaaataaaaaagttgcacatctctctcctatgcatagttcggagagagaggagaggagaggaaaaattctacaggtcacatattacgtccatttgagttcaatttttctatggtatgttcttgtgtgtccttaagcgtgaaaaaaatatcaaacaaataaaacaaaaataaaaaatttcgggggtgggggggcgccagccactctagtgcgctccccctagccacctcagcatcgcaccgccacgtcgacagggggacggcgccagccactctggcgccccaaaaaggattatttctaggataagttttttcaggggtttatttgctaaataagttttttaaaaggaccaaaatgtgaaaaatccagtaaaattaatagtgtgtgataaggactccacgtcagattgttttttaatgagctggaggagagaggggatgagacagaa

SEQ ID NO: 41560 - DNA, 1501 bp, Oryza sativa
gcctggttccacttggaattgcttctgtaaatggcactccagtatcttcgttcgatagacaagatgtggatcggcttcttttcttttgcacaaaccaagatgaagatgaagctattgcaaatggtctatatcaccatccgccaagatggtctgcatcccttgcgaaggacagagtgaagggaaatatggtgtcaaaaccaggtaattcttaatgcaaacggagttggagtggactagaaacatcttatgaaagggattaacctattatttttcacgttcttttcagctaggtgaaggatacaagggcaatggcaatttgtagttgtgcaaaggtggtgtcgatgctgaatgttgagagaatgggcagctcacttgcaccgtcatagcaagggcaaggttctatgttgagctaatccaaacttatagttttgatgaacatgtcttgtttttttgtgtgaatctcattgtacggttgttggtttattaacagcggccaaaatttgaatcttgaaacttgattttagattttttttttgtttcattgtagtgtattttctagcctaggcttctaaatcgcttaacatgttttttttttatggttgcttcattcagttctctacagcttgtcaacggtagtccaactgattagaatcgaaatgttgagaatcctgtaacagataactactctcctgctagtactacgacggcatcatcagatcgtagaaaatctgttatgggcagtaggattatttaaactgaaagtttccgtaaattctatgagaaatttatgcgttcaaaacaaatactagattgaatagaaaacgatcttacgctgtgctgcaactacgattaatgacggccgattgccctccacatccgtagcagaactcagaagccaaacctgcaaaattttgggaagatcattgtcaactattttttatatacaatactagctaaatacctgtgcgttacaacaaactattttaaatagttaaagaaatattatgtacttgttaaaaaatcagtttttccttggttaaaacaaaattagtctatcagagcaagagcggttagggactacaaaactactacacacaagtaagaaaaaaaaagctagcaaagtactttgacatcatggcccacatgttattggtggtggtggtgactcttcatcaccactctgaaaataaataaataaataaaacatgatatgtaagggcatcaacaatgtacatagcccataaagattataatgtgggattcatctagtttcttatgctttattgaaatctttcacaatgcttgataccatcaagtcttattgttaagtattctattgaatgatgtactatattagaagaaaggtattagtttaaatcagaactatgtcatgcctcataccccgagcaatgcttggtgtgtccctcctacatctaagtagtcaaccccaacgctcctaccctcaaatagggtatgttttaagttatcttgttcgcataat

SEQ ID NO: 41561 - DNA, 1501 bp, Oryza sativa
cctacctgagcataggaattttaccagccggatcgagagaatatgagcctaaatcgaccacgaacgacctgaatctgataccactgtaatattcgcagcgatgatttcagaaatagatggggattttgggaagaacagaaggggataggaagaacagaggagagaacagagaaagtttgggggaggattagttttcttccttttcattcatgatgtcttccccaccgagtggtcccttgtcttatagaccttacagctaagcaacagcatgagctcgcaggcccaacaacccaacacaactcatgtgagcgcgcaggcccatttcactctattcctggcacgctactatagctgtccatcacgactactgtggcgcgtcacactgaataccatcagctgtgacagcctgctgttccacttcaaagcaagcatagatatagtacgttttctagcttagtaagctagttcccttctctgcctaacaagcatcttgcaagaacaaatccatctggttcattgctctatcagttgatcagataacagattaggtaaggagctttccttgacctggaattgtacttggataagtatatgaaaccatggcactaccttgaaaccgaaaaatgtgcagtacactcttgaagcctgcttcttgttggaaaccagtgcaaaagacaaaactcatagagttattttaccatccttaagaagtactgggagtgtcgagatactaattttgcactaaaatttttggtatttcaagataaacctatgtggaggagatataacccagtggcgaatcttgaatgaaaatcgagggtgtgctcatatacatgtaaattattttagcagccaagtaaatatgcatatgcctgtcattttctaactcagttaattaatttataaataaaacaaagaaaacatgcattgtctaaccaaattataattcaaaattgttggtgcagcccatggccaagtcaatagtttaaccgtataaccaaattcccaaattatctatgactttatagtttttggaacattaaaaaaaccaaaattaataaactggaattctccacgttgactagttggcacatgaggtaaaatctcagaatctgctcatctattatgtgataggattaacaagctaacaagcaatctggccaattaatgctcgcaggtttttaagttttcgccattcttattggctctcagtactgcgttgcagcttgtagtggctgataggttcggcagctagagctggggattgagccccgacaagccccccagccccagcgatggatatgcccctgagataaccaggaaaataataagtttgagctcttatgcaaaagctagctatacatatgctctaagataaatgaattaattatataaatgagagaaagtgagagaagaaatttagaggcaaccttataaccaatttattagacatgtgagctctaatgctacttttagattggcttatagctagtagttagct

SEQ ID NO: 41562 - DNA, 580 bp, Oryza sativa
ctttagttaattaggaaaggaaaactaatgtaccatgactgtttcctgccaacacgaacacgtgcttgtatcatattttgaattgtaaagggttccaaatcaaaacttttatatagatttgtattaaatctcaatcgtcataatttggacccatcacaatctaatggtgtagatttttttttctttgattaacatgggaatttctagcccccacagcgaacgtagtgtctcctctcaaagctgtcttaataatataatagatagataattgacaagattgaaccatatgtgatgtattatttcacaaaaaatgcatgttcaaattcaatattcgtagtcgaatatgttatttttgtttctatttgtgtaagtccatttgaaactttgcatctttatggaatgacatacctaataatgatatattatgttaatttattttaaactttttgatgataatttaaatggcatacaaaaatgaggggatttttcccaatattgcatatcattgcaaaagtgaatgtaaatactaaatatttttttgttggacaggtaatactaaatatgtataaactgaatgttg

SEQ ID NO: 41563 - DNA, 1501 bp, Oryza sativa
tctgatagtgttcacatgactagcaccagacagggaattgagtgaaatatgacaattctcatcctggtcagagtcttcttcagcagtcactgcattcaaaagatcatccggaatcacttcagtaacttgcatagctttaatctgaccacccagcgcacactggtgctcaggagaatatttatccccacatttgaaacaaagaccattggctcttcgataatcccttaactgtcgagccttccatagttctgctcgttcaggcttaatagcaggagtatcagtaccaccctgaggcaactcccctttggtaggcaatggtttatacatcaatcgcttagattgcttagtactcaattcaagtagaacactctcttgcatcaatgccacagcagcagcttgctgaactgtggtaggcaactgaaccatcactgctgcacgaatgtcctccttaagccccaacataaaaacgatacaccagcatcaaacctcccactgatggatcaaatacacggatctgatagacaagagaatcaaattgatgcttatattcagccacagaacctgcctgtcttaaagtttgcagagcctgaatcttctcacgttgcgaggtgctctcaaactcacaaacaacagcatgtcgaaactgagaccaattagcaacttcctccacgagcttaaacgattgataccactgggcagcattccccgacatgtgaagaacagctgctgaaacttgaaatacaggaggaatctggtacatctcaaaatgtctcacacatatcaatccagactctcacatcagccccatcaaaacgtggaaaatccatcttcggaagacaactcttagcgcgcaaccccccatcacaacccgcactagattcaccattcccccaacgagatattgacttagaaaaaaccagcggtggaggaggaggaggtggtggtggtggtggtgttgttgtgcccagacttgccactgatagagaagacggggaacccaaaatactcaccggttctgaagccatggcttgcttgtgcagctgcgccgcctgcacttgctccttctgcaaagcggccacagcatccatggcgagatccaccttggtagcgacttgatcaattcggccgctctgcttggttaacttgtcgtccaaagcctccatacacagcgtgagggagtccagcttctcgagaagcttagcctccatggcgtcgagagattggcgcaagggagcggagagtttgatcggcgccgtggtgaaagactcctccaaatccagccgaaccagaaccggatttacagcagccgcacccaagggtagccgcctacctgagcataggaattttaccagccggatcgagagaatatgagcctaaatcgaccacgaacgacctgaatctgataccactgtaatattcgcagcgatgatttcagaaatagatggggattttgggaagaacagaaggggataggaagaacagaggagagaacagagaaagt

SEQ ID NO: 41564 - DNA, 1501 bp, Oryza sativa
gtttccccctcatttttggctctattaaatgctcgaagagaggattgtgctagggttcatagcattgttgcccctcacaacccagctctaccccttcctcctcctccgccgccgccgccgccgccgccaccaaatcgagcgcgccttgcacctccgccggcgtcctagcgtctcggaagtccccggtttcgtgttgtggtagtcgattgatttcgggcttgtgttagaggttcgatttgctagatccagatctggtgtgttgtttgattttctcttttcgttttagttcttgttagttttgggttgacatgtttttgtggaggtttgatctgttgttgtgcttggtgtggcaggcctttgcagggttcagcggttgcggatctgtggtgttctttgttcaaccatgcctcatttcccgagcggctcaagggtgaagtgcacgatgctcgcagtgctgtgcggtaaggtaggcaagcagcggatgccacctgatccagtgcccgagtcccagcggccgcggccgtcattcccattcccggagttgatctcatccgggaggttggacgtaagtatccttttgctatttattttttttagagcaagtttaatattatctccatcttattttattttattttattttattttaagtgcagttatgaaattttcatgtccaatatttgactgtccgtcttattttaaaaaacataaaaaatagtcacatataaagtaatattcatgttttatcatctaataacaacaaaaatactaatcataaaaattttttaaataagacggacaatcaaacagtagatataaatagtgcaaaactgcagtctttctgagacggaggtagtagtaggctaaggggcagatcgaggatgttggggcactggtgtcaccactcacttatacttaatagacgtgcccaggcggcgacacgccgcgcgcaggcaaatactcgtttcacttcagttttattaattcggcctaaaataataccaaaagtgttttatacacatgacgacaacccacacatggctaatgaagttaaaataggatcgcagcacaggttaatatcatctatcatataatattacttatagaaactcgtaaacatgcatgtgtgccttgattaactaaagaaatcactcttgcaagtttcaactatcctattcatggccagcaaagcaatccatttcgcaatattaccccaatagccaattgatcgagccaaatcttgttagcacagatggaaggatgaatataaatcatgttgcaaacagatctttacacttttacagttgtgtattaaattaagtggctcactttgttgtcaaaacccctaaaatctaaacctactttccatttgctctcttgtggttccatattagcctgtgtaatattcgcagcgatgatttcagaaatagatggggattttgggaagaacagaaggggataggaagaacagaggaagaacagaggagataacagagaaagt

SEQ ID NO: 41565 - DNA, 1501 bp, Oryza sativa
ctctcgtcctgtaggttccgttttcgtaaacagatcttcaattcggcacatgaattttttttccaccaagatgtatttttatcatggtatatattgaaacggagaggagctgtgcggatctcggactcaggatttttatttacgggagtacaatacaggaatcggattgtttttgtacggaaagttttttttcctttttatagggatgtagggaatcggactctactttttttttctcccggtttttttctctttttttttggatcggactctttttttcgtccggttttttcgcacggtttttttacggacgatggaagtacttcttattttttaaagtagtagagacttgtaaaagtcgaatttgaacttgcatgtttgtggagtgatatattgcatatgaatctatcttgtcaaattttttgaattttttcatacccatttagttgacatataataaatgggtggatctccacctaggtgattaaaagtgtttcccgagcctgattcatcattcatgcatggttgctttttatttgagagtgagctagccattctgacgtgactgagagtatgacaccaacaccagctagtgggtgacggcgacggcgagcttcatgccggactggcagtgtccgtcgaagctgcagatgaagagccaccgccctgcctggttcagcgccaccgtgtcgtcgccggagctcagcgtcggcgcgttcgccggcgccacgcacgcctcgaagctcccctcgtcctccaccaccaccacgttgtgcgcgccctccgcgtacaagaactctacatctcacatcgatcacgccattgatgagctcgtacatatgtctgcctgaattatttgagctagaaatttaggagaaactgatgctcaatttgattattacctagcgtgtcgccgaccttgaacctcttgccgtgagcccaagcgtcgtagtcgacgccgttgtcccagccggagtcgtcgccgacccggtacgccgtcgccgacgcggtcgtcgccgggagtgaaccggccacggcggcggcgacgacgaccacgacggccgccaactcgagcgtgatcctacgagaagccattggccgcaacggatcagcttggggatcgatgcttcactgagaatcagtgaacaaaccacgctgttcgatcgatcgtgttcatgtctacatatatatagcatcactggctcaggttgtgattgagaaaagacgcgcggcttgcggtgccatcgatgtgagcgacgccgcgacgacggagttggcttggcttgggattttgacgagttcatgcaagaatccaccaagtttttttccttgttttttgagacgaaaatcacagtagttttcggttgatcgagtgaagcccagcccatctatctcccggcttttccaaggtgatgggcctactgctgccagttggcgtgggctttgggccggcaatcattttttcattggaaaaagtatactttgactccctcaactattg

SEQ ID NO: 41566 - DNA, 1501 bp, Oryza sativa
tttggttatacggttaaactattgacttggccatgggctgcaccaacaattttgaattataatttggttagacaatgcatgttttctttgttttatttataaattaattaactgagttagaaaatgacaggcatatgcatatttacttggctgctaaaataatttacatgtatatgagcacaccctcgattttcattcaagattcgccactgggttatatctcctccacataggtttatcttgaaataccaaaaattttagtgcaaaattagtatctcgacactcccagtacttcttaaggatggtaaaataactctatgagttttgtcttttgcactggtttccaacaagaagcaggcttcaagagtgtactgcacatttttcggtttcaaggtagtgccatggtttcatatacttatccaagtacaattccaggtcaaggaaagctccttacctaatctgttatctgatcaactgatagagcaatgaaccagatggatttgttcttgcaagatgcttgttaggcagagaagggaactagcttactaagctagaaaacgtactatatctatgcttgctttgaagtggaacagcaggctgtcacagctgatggtattcagtgtgacgcgccacagtagtcgtgatggacagctatagtagcgtgccaggaatagagtgaaatgggcctgcgcgctcacatgagttgtgttgggttgttgggcctgcgagctcatgctgttgcttagctgtaaggtctataagacaagggaccactcggtggggaagacatcatgaatgaaaaggaagaaaactaatcctcccccaaactttctctgttctctcctctgttcttcctatccccttctgttcttcccaaaatccccatctatttctgaaatcatcgctgcgaatattacagtggtatcagattcaggtcgttcgtggtcgatttaggctcatattctctcgatccggctggtaaaattcctatgctcaggtaggcggctacccttgggtgcggctgctgtaaatccggttctggttcggctggatttggaggagtctttcaccacggcgccgatcaaactctccgctcccttgcgccaatctctcgacgccatggaggctaagcttctcgagaagctggactccctcacgctgtgtatggaggctttggacgacaagttaaccaagcagagcggccgaattgatcaagtcgctaccaaggtggatctcgccatggatgctgtggccgctttgcagaaggagcaagtgcaggcggcgcagctgcacaagcaagccatggcttcagaaccggtgagtattttgggttccccgtcttctctatcagtggcaagtctgggcacaacaacaccaccaccaccaccacctcctcctcctccaccgctggttttttctaagtcaatatctcgttgggggaatggtgaatctagtgcgggttgtgatggggggttgcgcgctaagagttgtcttccgaaga

SEQ ID NO: 41567 - DNA, 1501 bp, Oryza sativa
tttacacagaaaaatagtgggacccaccgacatgtgggcgccacaagtcatctcgtgtgccgacaggacaagccaacggagacggaaggccagcgaaggccatcggtgccccggtggccaataagagatgacttattgcctcgaccgccagcgaaggccatcgatatacccggtttcgtggttggagaatataaatcatactcggccaatagttgagggagtcaaagtatactttttccaatgaaaaaatgattgccggcccaaagcccacgccaactggcagcagtaggcccatcaccttggaaaagccgggagatagatgggctgggcttcactcgatcaaccgaaaactactgtgattttcgtctcaaaaaacaaggaaaaaaacttggtggattcttgcatgaactcgtcaaaatcccaagccaagccaactccgtcgtcgcggcgtcgctcacatcgatggcaccgcaagccgcgcgtcttttctcaatcacaacctgagccagtgatgctatatatatgtagacatgaacacgatcgatcgaacagcgtggtttgttcactgattctcagtgaagcatcgatccccaagctgatccgttgcggccaatggcttctcgtaggatcacgctcgagttggcggccgtcgtggtcgtcgtcgccgccgccgtggccggttcactcccggcgacgaccgcgtcggcgacggcgtaccgggtcggcgacgactccggctgggacaacggcgtcgactacgacgcttgggctcacggcaagaggttcaaggtcggcgacacgctaggtaataatcaaattgagcatcagtttctcctaaatttctagctcaaataattcaggcagacatatgtacgagctcatcaatggcgtgatcgatgtgagatgtagagttcttgtacgcggagggcgcgcacaacgtggtggtggtggaggacgaggggagcttcgaggcgtgcgtggcgccggcgaacgcgccgacgctgagctccggcgacgacacggtggcgctgaaccaggcagggcggtggctcttcatctgcagcttcgacggacactgccagtccggcatgaagctcgccgtcgccgtcacccactagctggtgttggtgtcatactctcagtcacgtcagaatggctagctcactctcaaataaaaagcaaccatgcatgaatgatgaatcaggctcgggaaacacttttaatcacctaggtggagatccacccatttattatatgtcaactaaatgggtatgaaaaaattcaaaaaatttgacaagatagattcatatgcaatatatcactccacaaacatgcaagttcaaattcgacttttacaagtctctactactttaaaaaataagaagtacttccatcgtccgtaaaaaaaccgtgcgaaaaaaccggacgaaaaaaagagtccgatccaaaaaaaaagagaaaaaaaccgggagaaaaaaaaagtagagtccgattccctaca

SEQ ID NO: 41568 - DNA, 261 bp, Oryza sativa
aaaacaaaatttggcgcgcgtgcgcctcctattcccgcttctttttccctccattattattccctggttaagcacgccgaaagacaagatcaatcacagccatccatacctcaccaacggcatcagatccaccgaacggcacatggtccagtctgccgtcctctacacattctcgccttctcggaccctagttccccattccaccaaaacccccaaatccctcgtctcgtttgccgccggcgatggcggcggcggcgccgc

SEQ ID NO: 41569 - DNA, 1501 bp, Oryza sativa
atgtatatttcatttatgacggcactcatacaatttccaataactaaattgcattattacttggttcttgtttgatcaagcttagttttatttttgacagtatacgaccttacttgaataggatcaagcttagttatatggctatgtttttatttacaaagttgcatgcaggattgcaaaaagtttgatgtcgctaatttgtagtattgctagttcttccccgttacctaatttcaagtgtagttaccgagtttatctcagcagttagttggaaacaaccgttgccttctaatgtgatatcaggtacaaaattacctatataaccctccacccaatttttacttaataccttggcccacatttgtaataccttcctatatctaccttttgttacagattgtcagattagaagccatcaacggatataatgcctcccaagcaccttagaaaatctgttatcttataaaatagtaaaaactaaaagtaagaaataatcttgcacgtatggatattaccttcatgttgtgcttacggagtatatgaaattagatacatcaactagaggccaatcaatggtaaataaaagaacaaaatctcctctgaccaacatcctggatagatatggagacatgttgatcatctatattaaggagttcatgtggtcctgctcctctgcctctgtctgaagtttgggtagcctgaaacaatggaattgttaaaactaaacacaagacagtataattagttgaccaacagttgtcgtactgattagttcgccaattccccttgacctttgtcaaatgcaccttcatatgcacaacaatttactcacatagaaattccattgaatatcttgcaaatgaatgaaattgtgaatctaacactacagctaatgatttctagaggaaaagcataatcactgaataaaatgaacccttttttttttcctgagagcaagcataatgtaccttgtttgtgtggatatgttgtttaaccaaaaggagctccaagacaccattgtctagagcctccatattatctagagcactataaacaaaatatgctgtgtactgtttagcagtcccaagtcacataaaccaagctgctaggaataaatcataattgagcttaatcattgattttctacttttgtggagtatggaacaaaactacaaataaacaacaaaaccattacttgatatgtctatatgtacatatcacgaaacataatgtatatacattaatattcaccaaatgaagtcatatccacggtgttttgtgtagtgagcttaatcaagtagctcttggggattagcaccggatcaatagggcatgttgaactgttagtcgatgcagtagttagatgcacacaaaccaccacatgaccactcacgggtgaaacataataaagaaccttagggttatacctgaccgtttaggttcctattctgcttgacctggcgaagaaatatttcagctcctgcacttttctattgcagca

SEQ ID NO: 41570 - DNA, 1501 bp, Oryza sativa
gcagctctgtgccgtcgcccgtggccaaccgaacggagcccggccgggggacaccgatcactcgatacggaccctcccacattggtgagagcttgctcaatccagcacgcgtttggacgcggcgtaggacgaggtcgtcgacgcagagtgatcgggcccggacatggcgctgatggtagcgccgcaggctctgctggtagcgcgcggctcggagggccgcgcgccgccttcgctcttccaagtagccgaggtcagggagcgtcggcttccttctttttgtcgctcgcaggcctcccctttcgggtggccagcgaaatgccatcgacggcgaggacatgaccctcgtcgtcggaatgggccgacctcttcttcctcctcctgtcccgccgccctgaccgagcggcggacccgggggcggccgaagttgccacaccggaaccggaggggttccaagtccaggcctcctccttgcgagccactcggtccgcgagctgaaaaagctccgcggtagtctggggctctttggaggcgatcttttcgagcatgcggttgtgccgcacaccccccctgaacaagtagatcaccgcgtgtgcagggatgcatggtatggtgttgcggacttgatagaaccgctgaatgtacgagcgaagtgactcatcatcccttcgctatactgcgtgcaggtccgcttcttcacctgggcgcggatatgtgccttgaaagttcatggtgaactgttggcacaaatcctcccaggagtggaccgacgcgggtggcaagttcgttagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctcctttgcgtgggcagcacgtcggccattacgccggcgctcgataccgatgcgggcatccggccccccacgcagatcttcctgggtcggaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgactaagttggccacgtcgtccagccaacgttgggctggagactccgggtcagggacaatgggcgggtgacgtaggagcgcgcccgcagcttggagcgcgccctggggcgtgctgccgtcgccgtagacgaggaggtgacgctccccatctcgccgcccttccccatcacccgtggatgtcgaagtcgcgg

SEQ ID NO: 41571 - DNA, 536 bp, Oryza sativa
ctctgaattaacatgacaaattctataataatttatatgcagatatcaatttgatttacctccgtacatgctgcaatagaaaagtgcaggagctgaaatatttcttcgccaggtcaagcagaataggaacctaaacggtcaggtataaccctaaggttctttattatgtttcacccgtgagtggtcatgtggtggtttgtgtgcatctaactactgcatcgactaacagttcaacatgccctattgatccggtgctaatccccaagagctacttgattaagctcactacacaaaacaccgtggatatgacttcatttggtgaatattaatgtatatacattatgtttcgtgatatgtacatatagacatatcaagtaatggttttgttgtttatttgtagttttgttccatactccacaaaagtagaaaatcaatgattaagctcaattatgatttattcctagcagcttggtttatgtgacttgggactgctaaacagtacacagcatattttgtttatagtgctctagataata

SEQ ID NO: 41572 - DNA, 1501 bp, Oryza sativa
caactaaactctagccactgttctatcaaagcctgaccttgacctataccagccacatgcctacttaaccacatcatttatccagtatatttcctatcctccaaaccacagaagcccatgcatgaaatataagcgaccctagttgcttaatctcttatccaccttagcctccaaccctttagaacctgcacataaaatattagccaataatccctataccctatagaaaagataggttatacactaaaccctagccctcttaaccgtttgtcgttttcttgttattctatggcttttattgaatttggatcttcctcttctacagtagagtctgttatattttgaatggcaacctgtggtatttcaaggatcggataatcaggttgcctatctcggatttatttgcgttagagcaaggcaagttattattcctctcctttgagcataaatgccctatattctatatctctattctatgcattagtcatacatgatttcaaatgcataacctgaacatagcaaaccagatatgctagcttttgcttagccctgcctagttagactgcataaaatataatgaacttagattggaacagtacggtagaaatggttgatttccgggtggctagtactgttccaaccgacataagattgccaagtacatgtgaagaacatacgagtacgaccgcaattctcgtatgggcatagacctagctgattaagttatctagcaaaagtggtacctctgtatagtggttcttcttaagtcctcgcgcaggaggcaaacttacgccgagcagggcgattgtgatatttaccgaggcgcaggtaaatatcttgattatctcgcgagctgtgtgtgtattatgaaaacctgattgagatgacgggggtctctcaaccagttctctctaaaaaccccgggaacaccagaactcctctcgctgctgataacgttacgttcagagcgcatggggactagggttcatggaacaggtaccactgatgttagtaaccgaaaagctttgacatgacaaggctaatgtgtttggcacgtcatggattgcgggtaaagcgtacatctactgcagtatgaatattattaaaactattcgaatagccgtgctcgcggttatcgggcattggggctcacaatggcatcttggttagaacataatttcaaactttattaaatactgttgcatttaaaacattatagactttccttcaatattctctgctttctgcaagtaaacctagttctacacagaagttaccatttcatgcattcattgttggttaatataatagcttgctgagtacgttgtactcaccctcgcttcaacccctttttcagagtcattttggagttcttgccgaagctggaagttcaatcatataagttaatctcattttaacttagttctcaagtatagattagatagatggtttaactctatagcaaaacactagagttatgtcatcgtatagcttctgctgt

SEQ ID NO: 41573 - DNA, 239 bp, Oryza sativa
gctaatactagtaatatgtatgtccagtgtaatatatgtgatatcataatattcatattttaaaagggtttcatatattgttaattttatagtcattgataatatattataaaaaaattaatggtaatatcgaagacagtgtaaaaaacataagctctttatagtttggtatgcaaggagcacctgctttaagaggaaatcgtcatatgaagatgagggacatcatcttaggaaaatca

SEQ ID NO: 41574 - DNA, 1501 bp, Oryza sativa
gttcttagcgattaggaatatggcttattagagaataaaaattaataggtaaaaattttacatatgtgttcttagcgatttaaaggccaatgctgaaaaaaaaaactacgtataaaatatcttaaaatcaattcaaaattaagtttgaaaattcaaattttaactttggttttggcttattaggggaccaatgagcctcttacgtttttcttttcttttgaccaccgctatttgttttccttccaaagtatcattatttatttcacattttatattatatcttccttagtttttcctaatttttattttgcaaattttcagactgtgtaatgtttattatagtctagtggtattgttaactcatttgaaggatctagatattcctagtttagtttattgataatgagcttagatgtcgggtcccaaaactaatgattcggaaaccgacatgtttagactgtatcaagccctggatcagtagattgatataggttcaacgatctggatcttcattgcatacatttgatcaaggttttaaaggagattcctttacataaaataatagggtatttacaaacttgtggctaactattacagcagaagctatacgatgacataactctagtgttttgctatagagttaaaccatctatctaatctatacttgagaactaagttaaaatgagattaacttatatgattgaacttccagcttcggcaagaactccaaaatgactctgaaaaaggggttgaagcgagggtgagtacaacgtactcagcaagctattatattaaccaacaatgaatgcatgaaatggtaacttctgtgtagaactaggtttacttgcagaaagcagagaatattgaaggaaagtctataatgttttaaatgcaacagtatttaataaagtttgaaattatgttctaaccaagatgccattgtgagccccaatgcccgataaccgcgagcacggctattcgaatagttttaataatattcatactgcagtagatgtacgctttacccgcaatccatgacgtgccaaacacattagccttgtcatgtcaaagcttttcggttactaacatcagtggtacctgttccatgaaccctagtccccatgcgctctgaacgtaacgttatcagcagcgagaggagttctggtgttcccggggtttttagagagaactggttgagagacccccgtcatctcaatcaggttttcataatacacacacagctcgcgagataatcaagatatttacctgcgcctcggtaaatatcacaatcgccctgctcggcgtaagtttgcctcctgcgcgaggacttaagaagaaccactatacagaggtaccacttttgctagataacttaatcagctaggtctatgcccatacgagaattgcggtcgtactcgtatgttcttcacatgtacttggcaatcttatgtcggttggaacagtactagccacccggaaatcaaccatttctaccgtactg

SEQ ID NO: 41575 - DNA, 211 bp, Oryza sativa
ttacttgttgaactttttcctttttcttgattatgtaggatcgaattacaaaaactaagccaaccagagaagggtgaatggttgatatacccaaaaaccgaaaacttttagcggaaataaaagttaccctcgaattcgacagatcgcagtctgaccgaagttgctctgccggtctgaccgcctggttgctatcggtctgaccgcgattaga

SEQ ID NO: 41576 - DNA, 1501 bp, Oryza sativa
tccccgccgccgccgcgacgacgctcgtcttctgcaagatctgcatggacgccgtgccgccgtccgccgcgcaccgcgcgagccgcgggtgcgaccacgccttctgcgcggcgtgcctcgcgggctacgtcggcgccaagatccaggagaggatcgccgacgtccggtgccccgaggagcggtgccgcggcgcgctcgacccggagctctgccaggggatcctcccgcgggaggtgttcgaccggtggggcgcggcgctgtgcgaggccatggtgctcgccgccccgagggcgtactgcccgttcaaggactgctcggcgatgatgctggacgacgccggcgaggccgtcaccgagtcggagtgcccgagctgccggcgcctcttctgcgcgcagtgcgccgtgccgtggcacgccggcgtcgactgcgcggcgtacaagaagctcggcaagggggacaggggcaaggaggacctgctggtggtggagatggccaaggggaagaagtggaagaggtgccccaagtgcaagtacttcgtggagaagtcccaaggttgcctgcacatcacctgcaggtgctgcatcattttatcgttcagatgtcttttcttccatatcttgaattttctttgcaggagtatatatgttgtatcaaattgtttttgagatgatcatgatcatcacaacattttgcaggtgtggcttcgagttctgctatggatgtggagggcagtggggcgttactcatgcgagttgcagcactgcatgagaattccagtttaattttggctgggctgatctgattgaatttttctgtgttctcagtgagaccctagtagcatcaattatcatatttaggagaccgatggtcatcagtagcatgaattatatgtcattctctcaccgaattaagtttcggttatcaaaagtatgaacttggagctaatttctaaatctaaattcgctacacatggcacacagctaccgcgataatattcgcttgaataccacattcaaattatttgcaatctatatattgtctgttaaacgttcgaccttgcttcatttgaccattttagatctgtgagtgattaaaagtgcttccaatgtgtatacactcgggtgttcaataattcttctggtaaatgatgtacccgttaacataagttagtccaatcttccggagatgtgtataggggtagtgtgtgcgtttatagcgatgggtatatgcgtgttataatcgtctgcgtttgtaacgtgtttcctaaaaaaatatgtactagctggctagctgccattctggcccgttctagcctccttgttttgttaattagacagaattgagagtatgtagcaccacagaaaaaagggttagttatcgaattgtttccatctcttcaatgttagcacttgtaaacttgtggatcttgtccatttatttgatccctcaaatccgatgcatgaggccttctttgaaatggacgaatctcaaagtttttctt

SEQ ID NO: 41577 - DNA, 1501 bp, Oryza sativa
gtagaaggtgttgatcatgaggggcagaagctgcccccctcaatccgtccatccccctccctaagtaggcctggatctccttttataccttaaggggttaccacatgggtccaacaacctaacttagtggagaaatattacaatctttgcattaaatgcatgtcttgtctcttaacttgggaagccaagcgcatgtcgtcttgatgatggggcctgtcaaattaaatggcgactgacacgaggggtgcccctgtcagtcgccatttaagggatgaagacttttgggctcctgtttgaccagagcggataaatcgactccggctatgatgagagactaaaaagcctctcattatgatgtgacgggacagagcacgcagcacgtcgcctggcacactgacagggtgggggttcacagccactgtcccatcgatcaatcgaccggtcacggaccggtcacagatcggtcacagacctatcagatgcgcaacatgccgcattaaatgccgcgtgacacggctgcaaggactgctttaaatgggttaggtgggcatcaggcgtgtccacctaaccctgtacacgtgggctgatacgtggagggggtcggggcagcccgaccccaagttgggagggggtagccgctgctccaccctgggctcgacccccctcgaggggagccacgtgggcttgggggtggcctcctccctctaaacgtgatactccgggcccatatcaccaacaaggcggaacgtcaatcttcgtgggttgtaggcgtgcagcacgaacctacaaacttgttgccgcttccttccaagtgctaggtctaatttcaatcgacgaactaaacaagacattagcatgtttatttttatgcaatgattggacagtacagtatacttcgtactttatggttttcgatgtcactataccttttattatgtgtgtatatacgcaaaaacagaatattgagacaaagttagcaagcactggatttaggctgtgtttagttcagcacaaagtttgaattttggttgaaattaaagatgatgtgactgaaagattgtgtgtgtatgacagattgatgtgatggaaaatgactgcagtttggatccaaaatttggatctaaacacagccttagcttgacgaaattcaggcagaagctgttacaccggtcggatggaggagtcgtactgggttctaaatatttgagtaacgatttgatagaaaacacgctgatcatgtatatagaaaaaaaaaatctcgagcacgggcaccgctccatcaaaaacaaaatttggcgcgcgtgcgcctcctattcccgcttctttttccctccattattattccctggttaagcacgccgaaagacaagatcaatcacagccatccatacctcaccaacggcatcagatccaccgaacggcacatggtccagtctgccgtcctctacacattctcgccttctcggaccctagttccccattccaccaaaacccccaaatc

SEQ ID NO: 41578 - DNA, 1501 bp, Oryza sativa
ctacgcataaacgctgccaggcacgatgggtggagtggaccaaagctggtgagcaaaccgacagggcccaagcggccaagcacaggaaggctgcgcatacatctacaaattaaatagccagatatttagacatgcaccattgtcatctcgtttttttcaaatttcgaggagcacaaatacaataatactatagcgatttttttttaacttttgaaacgtggttataaataggagtagcattcttttgaaatactatagtaatgttcaagtttaaagtaaggcttgacgggacaagcatgtgagcaggtgtgtcagtcaccgcgaacgatagaattgtggctcgtgtaatccggcgagcgcagcgcacgcaggaatctccggcgttttgatctccagggtccaagtatttccgctccgccgccgtagacgatgagctgcatcgcactagtgctcccgtggcatgggctccgcacgttttttcaccctctcgttgttccggttcgcgcatgatgaatgatgatgatgtgcgtggataggagagtccaggagggcaaagcaaaccttctctaaactacacactgcagtctgcaccccgcaccaaggccccgtttagttcgcgaaatgaaaattgttgagtgtcacatcggacgtttgaccggatatcggaaggagttttcagacacgaatgaaaaaactaatttcataacttgcctagaaaccgcgagacgaatcttttgagcctaattaattcgtcattagcgcatgtgggttactgtaacacttatggctaatcatgaactaattagactcaaaagattcgtctcgcaatttcctctctaactatgcaattagtttttatttttatctatatttaatgttttatggaagtgtccaaaaattcgatgtgatgtttttgagaaaaactttttgaaaactaaacagggcccaaaaagaactacactctgcagtacagacacacatcacattccgcatcaaggcatgtcatgcgtaaaacgaatgcacacgccatgaaacctactgtactactccatccatccctaatataagggattttaacattttacttacactatttgatcactcgtcttacttaaaaaaaaattgtgcaaatataaaagacgaaaagttgtgcttaaaagactttgaataataaagtaagtaaaaaataaataataattttaaaatattttaaataagacgaatggtaaaacagtgcaagtaaaatgtgaaaatctcttatattagaggatggagggagtagtgagatgatcaaattcgatcaattcagatttccaggccacagctgagctcgatgcattcgtgcatggaagttacggcccgacaggcgacttgcgatgtcgcatctaagctcagcccactggcccatgcagtgatgaaattgatgatggcccatacggatgtcgcagcacatatctggcccaacaaacaccgcacgcacgtaaactacgttctcctaagt

SEQ ID NO: 41579 - DNA, 193 bp, Oryza sativa
tagtcccggataccgggactacagggggttacgaaccgggactaaaaagcacttctccaccagtgcgtacaccctataccccccacttgattgtctagaatgtggttcgggtcatttattttgcgtcgtcagcatttaccaatcaccagcccctacgttatgtgcacacacatgttgtaattcgcctcccaga

SEQ ID NO: 41580 - DNA, 192 bp, Oryza sativa
tggccaccacagccgcagccgtcgccggccgtcgtcgcggcgccgccctcctcctctcccgcctcgccccgctgagctccgggccggccaccgcccttcaccgccggagttgcgatcaccgttgcctcgctggctcgccgcgcctcgcaagggaggaagagagagacaagaaaagaggggaaacagaaaaga

SEQ ID NO: 41581 - DNA, 385 bp, Oryza sativa
aactttttataaatatgaaaacggacataacgtaattagaaatttgcatttaaaattggttagaacgataaaatttcatgatttcctagctagcttgtagatatcaactcaaccaccaaactcttcagccaacaaattgcacttatatgggctactagctcattataggctggtaatgtttaggattaattggaaccatgccattataacttttatgattttgaaatattttattactattcgtctatttggagaaatgtcactataattttgctgttattcgatagatggcactacttaactcgtgactgtattttctaaaatttttagatcagattgcccatttcttcttccttcatcgatctccctctctatcacatgtagt

SEQ ID NO: 41582 - DNA, 302 bp, Oryza sativa
ggagggcgaacgcatcaccctcgggcccgacgccccccgagggtgccaggccacgtgggcgattgtgtctgcctcaagcctctagtcatgatactcccggttccatgtcaccgacagcctgagaggaatattcgtgtcagctcggatgggaccgcacccaagcaaaactgcgtgaccccctgccagagggttacgtaatttcgtcagagccacggtgaggaaagggcgaggtaccgtattagggagaggcctcgccctacaccgttgtggctcccgcaccgaggaagaagatggaaagggga

SEQ ID NO: 41583 - DNA, 1501 bp, Oryza sativa; identical to SEQ ID NO: 19555

SEQ ID NO: 41584 - DNA, 1501 bp, Oryza sativa
acagaggaatggaattacccctacttaagcttccaaacagggcattgactggtccagcaattccatgacgtttcattgtaccacccctccatttggatgtaggcacacagctaagctgcaagcctacatatagcatgtccaactcagtcataatttgttgcgttgctatgacgaccgcgacgaacttgcctcgatcagctgttctgctcatctgcatttctgcatacaggcacgcagccagttgtttatttgcagaaattcaggtttttggattatttccagtgcacgcatggaagtatagcaattaggccaagcaccagccaagatttgcatgagcctggccagtctgttgcacagttgcagactgcatgaggatatgcacaccagctgttccttgttttggtgcaccaattcttacagtcaaaactcaccaaaatttaagcagggagaagtcttcagaaagaaatactgtactacaacaaagctgtaagcacacaaattggaacagttagcaagtaccactccctctgtttttaaacacctggttatgctattactttattatcatgccgcacatttcagaaatttattaatttttcaacatttacaaatttattagcagctgaaataatgccaatggttgtcactgcgtgacttgtgagactaagggcatgttttgcacaactttagctccaattctagatttccttagctggagcctaactaaataattttagctccacataaaacatgaacagagttgggtggaacgctcctacaaaataaactagagagttcacagctccactctacccaactcctgaaactaaatttataaattggagctctacaaggacctaaaattaagggtgccaactattagagaatgttttcgcgaacgcaactagtattgaatgtaacaatctcgacgatgtttggatgaactagctgctctaaatttagaacttgaagctctaccaaggctcaaaattacaactgctgtagccgtgcgacaaccaggtcagccgaactccgccctcatttctcaagcagtacggatcatacctgaaatttaaatatataaaataaattcaaaaaacggagaattcgctacttgacagttcacccttcgctgtaacaccgtgagtttactgcaaccatattaccaggagccagccttgcaaacgcaagagaaaagagagagagaaaaaaaaaacaaattcagctctattcacctccgaacaaaacgctacagttgcctctccactgttgctcgctcagcgccaaactaatctccccggttataccgctcgccgacatgtgggccccacacccctcccccccttcttctcttctccctccccccatatatagcgagccagccttcctctccaccttcccaatcataatcatcatcgcctactccctctctctctctaaaacctcgctgtctttctctatctagcgggtcgcggtgagtcgtcgtcgtcgtcgccggcga

SEQ ID NO: 41585 - DNA, 1501 bp, Oryza sativa
taatatacaaaaggaggtttactcataaccaataattggataatgccacaacttcttcaccaccatttcaccaaaacttacccaaccttcttaaatatatagtaccgaaatttctcccgtaccttaagccataggcgaaatacaactccgaacaaagatgtggcatatggactattttccgctgttgcctccattggatgatctgagacacagtgattgggtactttggttgggggtctgaagcagagtggggaaggggagtgaggagaggagcaagaagaaaataggggaacggcatggggatgggggactatactgaataagccaaaaccacatcactacctcagtttatgacggtaggatgaacggtttagaaagttacagggtgaatttctaaaccatggttaaaagcgcaaggttgtagaataaaccttttcctttaatatttgacagcttgcatatgttcaaaaatgtcatctgtttaagaatgaaggtaacatatcagagaaaaagtcatttggaaactatgttcaattgtaaagctttggctgagcttatcagcaccacgtgaaacgaggcatgccattagcgcatcgttaagtatggactattataaattacagaagtgaatttatttgatttttaataaaatatataaagtttttgcacgaaattagtggttcagaaaacgtggctcatggcaaactggccctaagacatgacaatgacaatcagtctcatttattcataatgggatgtctcataaacatcccaaattaattatttgcagttgtttgtgttaaatatgtgatccgaattttggaccaacaatatatttggattagttatctaataggactgcattataggattagtttcctattaggactttgagtctttacctattaggactcctagatttctcctatatatatatcccttgtaagccgtacagggagggtgcgacagctcaatgtatcccctgcgtttgtatctaactcctctatagtgatcattgccggtcggcgtctatagttttttccctcaagggtttttcacgtaaaatttatctccgttgtacatttattttcataacagttcggcccttcataatagaactgcgagctgaaaatatgtgagatcttgtaacagttgccctgcatgctgtgttgcagatcgttgctaagggaatggcctttaccattcccatcggaggtggctgctgtgtgtcgcgtggccgatgaatccaccgaaaagagatattgacaggtctatctcctagtgttggaagctgtgggagtatttcaaatggtaatgtactaagttccttgggtgaaaacaaataaaaggtagctgataatttccacattcaaggaaaataattaaaatgatccaactttaattagtatcaactgaatgtttgtagacttggagttctttggaacatctgttactgtagaacattgcataatgtaattcatcattcatttatcctttttga

SEQ ID NO: 41586 - DNA, 1501 bp, Oryza sativa
aatctcacaccttattatgacatagctagcagaaaatagcttgaactgatattccagtatcacacaagtataaaacctcatctaatataaagatctacggttgccaccttttcttttatcacggattggcccattggattggttctgagtcattcgctacctgtaacctgttgacctcaataaaagttttagcagctgaactatatatcataactgattttaatctgaatgttttctaaatgcatccttgcttgatggatctctttagcataatctggtgatcgatacgatgcatgcacttcataagtacagtgcaagttgtgttagtttttcaatgttgctagctagcttgagggaatggtttgtttcaaaacaaacgagttagttgtatcttcagttcttctcattcttcatattctgcacaattgttcgttaaaatctctctatgttcaatcagatattggcttatcgattcactgtcagtaagcttgggattacattgtctaagtatcattaagtgtaagttttttttttttaaaaaagaaagctattctaagagcaggttgcaatatatgctacttggagttacaagttagctgttcattttctagaaatattgcagggtttttgtattttctaacaaagctgattgaccatgttgtgctgttttgtcaggttcaaatgatcataatatatatctgcaactctaatttatttaaaacttctaggagaagttgaggatcacacattcacataaaagtggccatttcttatacaattgtaagcacaatgtttttatgaccaatagcatcggatgatcaaagtgccttttatctccattttccacattctcttgaaccttgaggttttttttttctgtctaatccttaattcatacaacgtaggaccttgtattattttatcttatgcttttgtatttcaatgaaacatggcttgaatatatgtttatttattctttatttgatgtgaaatgaatcgtacactttaaatttaataaacttattattgttgtcatatcggtgatatgctgatctcaagttaatttatatttgcatgatgtgccttgcacgtgcacgattactagtttttatattatggacatcatgtattcatgatgtttagcacttaatcatataattattacgatgggtcatttattgattattgtattaatgttccttggattgctaactcgatgttgtattgattgcatacacacgtaacatccgataaatttaatctgtttccagaccgattccgcaccgactttgcaccatttccgacatccgaaacaatccgctccacatccgtacactatccgcacccgctccgaatctgcttaaaaaatatggtttaggatatggtataactactatccgttcgaatccgctccattttcacccctacgtccaaccatcgtggtgtggatggcttcggcgtggcctttcctgcttggcggcacaacgtcggtgaggcgtca

SEQ ID NO: 41587 - DNA, 1501 bp, Oryza sativa
aagtgatcggtaccataacatatcatgtcaacaaatggatacctctagcagttgtattattctttttcacagttttttttaagaatgagttactctctccgtctaaattaaatgcagttttacactattcatgttcaacatttgactgttcatcttatttgaaatatttttatgattaatatttttattgttattagataataaaacatgaatagtactttatgtgtaactattttttaaaatttttttataaacttttcaaataaaacggacggttaaacgttggacacggatttctacggctgcatttattttgggacggagatagtatatagctgcatgtagttaattggtgcagacctggcaccatgaaattaaagaaagcgctgtgcacagtgccatgtcacgcgtgcatgtcagcacttctagcatcaattagatcctaaattaaataaccaattggttactggatcggagcacataaattaactcggtcatatgatactccacagtactagtatatatgaagatgaatccatccatctatatacacggtggtattgtggtaaaattaaagccatgcatcgccattccgattcatcccaaatcagccgaaacaaacagatttatacttcaaatagtactactacatcgcattgtattttagatttgtttattttaggatgaaatgattatatatgtacatttgattttctccgtagtacgcacgcgaagaaaaagtactactgcaccgatctggcaggactccgttggaccgatatcgagcctcgtagctgcaagagctagctagatcaccgtcacgtgcggtcaaggataagctagggggaccctctcgtccggtcaaaataaacgagaacgcaatgtgggggtgatgggcggctacaccgtccgtacagctgtcagacacgtggtggtggcgggcaggcgcgtctcggtcaccatctactagcacgagcagctagctagcgagagatcgatcagccaccgcgatgatatgatatgatcgccctcgcggccacgcccacgcgggccacagttaagcccatctcgccctcctcatcaatctctcgcgatccccaaattcatcggtggcactggcatcggccggcctcgcctgaatcaaacggccgttttagagcaagtttaatagtatagcccactattagcttcaatttatatatagccaatctaatagtcaatttatacaatagttgcttactatactattaatatatggtcccacatgtcatacacacattgtatcttgaagtacgtgctgtagctggctatagatctgtagcccgctgctcttctctctcatcttttatctcattaaaatatgtttacaactggctaatagcctgctattgtaactgctatttatcactgcatcttcctctcccattcctcctgcaagtctgcagcaagataacgcaaatgtgagctctgtatacctagctgtgacgccccctgtatcaag

SEQ ID NO: 41588 - DNA, 1501 bp, Oryza sativa
gaggacgccgtggactcggcaccggccaccggacgtcggcctcctcctccaccctctgtcaatatctgatccgtcatgtaggcttatttgttttgctgatggtggatgtaggtgaaggcttcggtggcaagaaaggggaaaacgacgagtccacacgacgaccagccgctcgagtccaccatggcttcgccttcaccactgctaagctccgacgacgatgcaaggtgagcacatctagctgtcctactcccaactcagtacccctccctagacgcctaactacagtaccatatccccctccccctccactaaattcctcttccatggctacatcgttgtctcgttgagtcactaactcacgttcggcgatccacaataagggacgccaatgcggagttggaccagccatcgcatgctataagcgctgcagctgcagccacacctgccgttgtgcctgttgctggatctgccattgttcatgtgggcagatctggttcctccaactccggtgcaaaggcctgcagtcggccgccgcaaccacctataaaaaggaccaccactaggcaaaaagccatcttgcaggagcaccttctgcttcgactaaggcaggagctccttctgctccaagaactccagaagcttcatcttccaccaacggcgtgcgcttattcaaatccatggggttcgatttcacgctaaccctttatatattgtagcttcacttttgtaatcctaagttcctaacaatttagcatgtgcaatttattaatttgcagcttgcttgattttcttagatattgaatgttgtatttagagtatctgtagaaaattagatatctttacatgtatattgtatggttgtacattgaatgttgttaagttataaatatgttatgaacttaagtttttgaaattaaaggaatctgaatctgtgtagtgtagctcataaaaattttattattctataggctgtagcagatttcagtatgctttatgtgtagagattcttcatttcaagttttccaagattattctataggctgaaagatatattgatctatatttatttgtcaattgtcagatttaccacgaattcaactgctggtactggttgtgggagtagcagccagcaagaatcacaatcacttccaccacaagcagagtctgttaatgattctgagccaatacaagttgaagatgatgagccagaagatgattctgagaattttggcacaaagaggaagcttacttctgttgtttggaaggatttcaagaaagtcaaagtctgtggtgatgtcaagactgaatgccttcattgccacaagcggcttggagggaagagcagcaatgggacttcacatctacatgaccatttgaaaatttgcacattgagaaagatcaagatggggccaaagacacttgcacaatcttcattgaggttcaatattacatgagtatcctttatctattgttgaccatattggctttcgaagatttgtgc

SEQ ID NO: 41589 - DNA, 675 bp, Oryza sativa
tggtccctagccgaagccggcgtgctaattccggaagttggtatgtcagtcccggtcagatccattccaggcttcagcgcaagtatggcaaggaagtcgctggccattaaatgaaggttgaaatgggcgtccaccgaaaaaggggcgagcagagcaggaaacgtgcgctctgcttgtcagaggtcacttctggctgtagactagccctcattgtaaaagcatgtttcctttcttaggtggcgagaggcccttgtggtgacccctgaccagagaaaaaggaggcccaggcctagaaagaaaggagagagaaaaaaaagaggagaagagaggggacgaacggggctagagcctgaactctctctcgctctccggctctctgtattccttcactcacagatccaccagaacacaggagtagggtgttacgcttctcagcggcccgaacctgtctacgtcgcccgtgtctcgcgcatttcttctctcgctgacgttcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttcgcccgctcagcccaa

SEQ ID NO: 41590 - DNA, 1501 bp, Oryza sativa
acacaacctaataaattcactggacaccaatctaatggcatgtattttgacaaaatatgtagcagcaaaagtactaatcagccataaatcacatcatgagctacaaaacatcatcaacgttgcacaacaatcgataggaagtcatgcttgcactgttgtttccgaccttcctaaagattttcatgtaaaactatataaggaactggtgaattatcaacaccaaacatggcatatggatatgtaatcatgaaaaatgggtataaacctacaaggctaacctcaacaaatgaaaatattcattgatcatgatgacataaaaaaacatgatcagagttactactatacataaattaaaaacatcattttttgataaaagaagtactaattggtttatccaactaacattaataggtaactcagtacaattagcccagcagccatttttcctagccacaacttccagcacaatacattttctacaattggcctcatttctgttttgaaagcaataaatgagacagaaaacattgggagcacagtttacttctatgtatggaaaaaactacgacttggaaaaatcagaaatacatttgccgagcgaaaaaagccagtgaagatgcagccaggtatttgccatgccgctgccatagcctagcactctgtaactacatggccaatataaactgttaatatagattagttcacacaagtatacaacagtcaatactttcactgtagcttaaaaacaaacatataataagaaaagaatgcaataattatattttctagcatgttcagactttagatatacgtattgacaaggcctcacataaacttgaaagtgagtattatactaagttcataagtgatcttaaaacaagttttttaaaaaagccagttcgagtatgttttttggaactcctgattaccaggccttgtagcatgattcttcaaaggagcaagcaactcgaaatgtctggtccaaaatcaaaacccctcccgatattcataatatatagaaattgtgttcatcaagggataaacctagtgaattactgctgaaacataggagacaaattatatcccgaggtcaatctcaaataaacaaaggtgaaaaagaattttcggacaaatactttgtcattgtacaaaataggatatacgagggaaaactatagatttgtcgcttcaatttgattacctgtatcaccgtcctattttgcaacttgtagtaaaatggagtacggtaataaaatcctattaccagttgcaatagtacaacggaactcaattgattcccagaatttgtagtatacaaataacccatttgatgacacaaagggatggagggggtccagttgtaaaagaagggctctgtaacattattttatctgcattaccaaattctctgtaacactattttatctgcattacaaaatttagaactcaaaaaagcaggaattcagatcttaacgtagtcaaattcttgtgagcacaaatt

SEQ ID NO: 41591 - DNA, 361 bp, Oryza sativa
aacaattttaaacggagggagtatgtgcagatgatatgtgggcctcacgtacctttttaaattattttgctgactaggatgctacatcagcgaaaccacccatatatactgccatacaaccttatgtgtacggttgtataagttcaggggtacacatttctggttttgtggttaagggacctcaaaaaatcttgcagctaagttgagggaactctggtgaacttattcctacattgtatagcaatttgtagtattaaattgggctacaaacaggctgtttcctaacgggctttgaatttgctattttctccaaagatttgtggaatatgttcacctgacatccctcaattatgctccaagt

SEQ ID NO: 41592 - DNA, 154 bp, Oryza sativa
  unsure (1)..(154): unsure at all n locations
tccaaatcaaatacggacaagcagtgtctgttataccaaaaattcgatttaattaacacatttacaagcnctgtttttatgtgtgcaatattaaataatatttcgacggtttcaaaaattgttaatgaatacctgtcaggtaggaggcctgata

SEQ ID NO: 41593 - DNA, 244 bp, Oryza sativa
aatccaacgacctatcatcttaatgattttctcgaatttaatgcgtgactctccattcttccatacatgattggctacataggcattgagaaatgtaaatattaattaatcgcttgtttacgaggaatgactagtagcatatttaaatggatgataagtacaattacttatccttggtctgtgtgtcaagataaaatatgactattaaaagtagatggagggagtataaatcaataattcaaca

SEQ ID NO: 41594 - DNA, 369 bp, Oryza sativa
aaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgccaaatccgattattatttgcattactttcttagggttttctcttgatttgcacctgcattttcttggggttgtttacaaattaaatttggcttgggaggagaacttcggggtgtgacatccactgccgcccactgagttgcacctccggcatcaccgtgttgtgctactctttctccgccgcccaaccctagg

SEQ ID NO: 41595 - DNA, 1501 bp, Oryza sativa
acccctaggtcgtcctcccacctctttaaatagctaggtacccgttcagggtttcttgggttttcgttagattaaagtttagctttgttgctttgccgtgtaatcccgtgatcggttagattgtcggtttgctcgttacggaaccccaacttatcatttgtatgcaattcttatttgcaattcacattgcttttatcttgttcttacttatttcttcggtttgcttgcaggaataaggttgatctgcaccggcaagatcaacaacctacggagtggtgtatcgatcgctaaggcgcaacataacaacgtctcatacggttgtagttgggtcgtcaacatttcttccaaattgtagttctcatcaattcaccgaaagatcgggccaacaacagccttgagtgtcttgagtggagctcagggtttatcaatcttcaaggaggacgtagtcgcgctgaacgtggtagacaaattcgttgctggcaccttagggcggaactccaggtcgacacactgtaaatagccttaatgttgttgcgcccttcctccagttagggggtgggcagaaaaagaccgaaccgaaaaaccgaaccaaagtgaccaagaaattcggtcagcacttttaactaaattagttcggtcaaaaggtcttaggactcagttaacagaattgaccaaaaaaaccaaaatatatcagtggcccaataacatatgtgaaatctcagcccactaggcccaatacctcatcacctgagcaaaatcatcgccccatccagctacaaaacaactacgtcacgactttatcctcctacccacgaggccacgatcgagtttcagaaaaaaaaaagaattggcaactccccagtccccactgcgcggaggcgttgctagcggcaacctgcgccgagctgctcgtttgcctctcatggcggaagaaggccgtgcgccctgtagcgcccctgccgcctgccggccagccgcaccccgtggcgaaagaggcatcgatggcggaagaggtcggccagcccttgatgaaagcgatggagcgggggaacaatgacgatgggagatgagattgatgggatctggagcttctggtggagtgaagattgacgagatccaatacatggcatgatcgatttgcttgatttgcttctcttttttttcctaaatcgtgctctacttgctgcttggctgcttgatttgctttttttttcctgaatcagtgctctacttgctagtacttgctaggggcatcctcatattgtagacttatagtctttcatctgagttgcgattattttttctgttgttgaaaccattgttacggttagttcggtcaatgactgagaccgaaccgaactaaccgaagaccgaagcgctcggtcttgtgttttcttgaagatcgatcggtctcgtgattttgaagaccgaattttccaaaagaccaaagaatcgaaccgaatttctcgggtagaccgaatgcccacccctacctctagta

SEQ ID NO: 41596 - DNA, 557 bp, Oryza sativa
atgttacaaacatacaaattattagtcaggttctctctactatgatcttcccacgggattaaataaatacgatacccttggaatactctcgggtgaaatgctacaatggtatatccgtgcgctttgcggatgaactctgtaaccataatataccaggagtatttctgcgccattgctgggaatgatatttctagtaatgtcgttaacaaataccaacaataccctccaaccatcatagggagtgaatctccaccgttccctcaaagccctggatccaacggagctgttcctggcaggcttcctccttgacctcttctatcttcagacttgtgaattttggcccaattcgatcgtgtcaattcttagttcttggcccgtctttccataagtccgattctcgacatcgttcgattgattgatcgtctattttgatgtcggttctcctccatcttatgcttattttctgcaagaggttagtaatcctagtgctagtggaatatatattattttaacaagaagatgcattgcaaacataactagttctcctttatttcagt

SEQ ID NO: 41597 - DNA, 289 bp, Oryza sativa
ctccactcagcttcactcccattttaggtggagctgaaactgtttggcagaactccagctctatgagaggtggagctagagctggagctgtgccgaacaggccctaagagttggagctataaaaaacatacacactagatatacactagaaaaaatatccgtgtgttgcaacgggtgaagtctattttaatcttattattgttatatggtttagttaagatgaaattcactgtaggagttcacttggatatatatatttttagaaaatcatgagctgtagttaggagtc

SEQ ID NO: 41598 - DNA, 1501 bp, Oryza sativa
ggtatgatagcaatttaaatatgcccaaaatctaaacttttttatcatagtactcgaggcatacaccatcgaccctccatgctagggcaataatgaatctggtcatctcaagcgtgtagcagctggatccgccacgccaaggaggggggagggagctgctttgctagggagaggtggagaaaccgttgcaccggtcggggaaaggtggcaattgctcggtcatgtgaggtggggaggagtcttgggacttaggccttgtttagttgggggaaaattttgggattggttttcacattggatatgcggacatacatttaaagtattaagcgtagtctaataacaaaaaaatacagattccggcaagaaactgtgagacgaatttattaagactaattaatccatcattagtaaatatttactgtagcaccacattgtcaaatcatggcgcaattaggcttaaaagattcgtctcgcaatttacacgtaatctgtgtaattggtttttttcttacatttaatactccatgcatgtgtgcaagcattcgatatgacagcgtgaaaatttttgttttggaaactaaacaggccttaaaataccagagtgcttgggcagctcggctcaactagttttttttttttaaggtcagcaggaagatgttggaacttaatgaatgggccttagcccactcgaagattaattctttggcaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcagggcagggcagggcaggcggcgcgcgtgcacgacgtacgcgttgaatggtccgaaaaattggctcctcacccttgcgcagatgcagcctccttttgtaaccgacccgccgtcttcacgcaatatatgcgaaaatcagtctagggtttgcctcctactctgtactgcgccgtcgctcgtagactactccatcccgctcgccagcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgctgcgcatatttgatctgttcatgttattctgcgtagtttacatgtgtagaactaatgatgcgttcatgctagttttcatctgtaatgtcatgatttatttatggaataaattaaatcattatatgctgcccataatctcaacaatccaaaaaccttattataggcattgtgattttacta

SEQ ID NO: 41599 - DNA, 1501 bp, Oryza sativa
cacattccacaaccaatgtgagactatttaacaatctaccaattcacatacattggtgtccctcagccgttcatcgccccttcatcgtttcctcacggtcccttaccctttcacaaccaatatgagtctattcgacaatctctcccttcacatatatattggtgtccctcagctgttcatcgccccttcatcgtttccccacagtccctcaagtatacggccccgcaggcacccatggtccatcaggccttcacacactttgtctctcgggctagagatgatgaaatagccaggctctaataccaattataggatcgtaaagggtttttcccaccccaaaagctagtcattgaggtgaggggctcccccacttatatattaaatctcttacccttccacaaccaatgtgttactattcaacactcatatgtaggagatatgtcttattagtaacactgaaaattctcttcttttgtttttctctcgtagttttattggatttttttggaaaaaaaaacttaaaaatagattaatatgattttttaaagcaactttcctatagaaacttttttgcaaaacacgcaccgtttagtattttgaaaagcatgtacatgaaaaacaaagagatgagttgggaacttaagggaaagactcggccttagcagtttttatgggatgtgggataagatgagaataggaggaggactacggtgcttttataatctatactactttaaatgatcctattgatagtgtccgtgtctgtcttaacgttacaagctgacatgtggaaccataaagatccccacatatggacgttctttttttatatgacattatatgcctactcaattaactatactatatatataaacttgtaccttttacttttgtttttatcttttataatatccattgtaatgcatgggactttagagatgaccaaacatgccccaactacaactagagctgccttccctagcccagctgatttttactactaagcctatgggcttgttgggcccatctttatgggcttttggaccaaattgtcttgcaagattaggcctagcagaatggctgaccaaatcagatataacacgggcttcttgtaaattgtctcgattttgctagaaatttgctagaaaattgtctaaccacttgaaaaggcctgaacaaagatcatctaacagtgaaagctttctggagtacatacctacatcaatagaaacttttttaagcttcatgttcctacatgatcagtcactacaaagctcaattaattgctctggagcatgacctgtgaaggtcaattcactcggagaattaacaccgaagcaaatagagtaacatgcgtatactaactgttactactacggagtactcctaccatttagaacaagttaattggatttgcgaaaactccaaatgcaattaattaagcagctcaaacccattcaattaacctaattaattagcctctcccgctgtaattacccag

SEQ ID NO: 41600 - DNA, 1501 bp, Oryza sativa
ttgcaaggcaagtcccacctccctctctttgatcactttgaacctatgttttgaaggttattgaaaatatttgcaaatcttgcatgtcgattggacactaataaattaaaattttgttaaacttgttagacaaactcctattacttgcattatcaccctaaccccacatatatccatatcccacattcctaaccttaggaacaatatgactatgccactttatatatgagtttagatgtcactagattgctataatgcttagccatgcttagtatgtgtagtacttgtcatttgggctcttattaacttgaaaaaatgattttattcaagttctggacagaaatgaataaatgaggaatttgacaaacaaagcatatggccatcaaagtaggcattaatcatatataaatatgcacctcattgccatccatagtagcaaggagatcattcttaaatctcatcacattttgaagttaaatttcagcatttagaagattaaacataagtctatactcaacacatatccacataccgctcataaccgtgagcacggctaatcgattagtttttagactctgctgagcttgtacagctttacccacataatgtgaatcgctctagtttgtccgatacccgtcggtaccaccacactctacacattaagcgagtctagaggtcacaacgaggcttttacattaagtcttgtctaatccttgcatgagcacaatgagtgttgttccacactaattctagaatcttaatgtcattatattggggggtctttaccaatataacgccataggcaagccggtacaatcgcttcctatgtggcactcaacgttgtacgtgaggcggaacattacagtcgtcccctcacgcggaacagtacagtcgttccctaccaaaccataaataaaagtgaggcggaacgttacagtcgtcccctcataaacatcatacacataaaaagcggattggtacagtcatctcctttgcaatacacacataaacacaaatagccctacagttcactcgtaggcactatcgctactacaacggcctcccgaatgctacaacggcctcccgaatgcaaggttagaccagcacttaacttagtaggccaaggtcaccccataataacacatgtggatgtacggtaaacataatgaacagacattgagtatagtccttagatcagtctgggcacactctccccctatcggtatacaactagtcaacatatgtataccacatgaggcccaaacttaaaattcaagtttttcaacattttgtttgtcaaattcctcatttattcgcaaatatgatttgaatgtattttatgcaaataaaacttgctttatgctaaaaggaaccatattatgccttctttgattatatgccttgcaagtagggtgttaggcttgtcttggtgcttgccagtacattatttctaataatgtactggctcttgctattggattaactatttgcttgcaggttt

SEQ ID NO: 41601 - DNA, 388 bp, Oryza sativa
tccataatttttgagtagaaaacgttaactaggtacattcatttacctccaataaaatccacacgacctcatatgcaacacgaattaatctatgaattaacaagttagggaagagaaaataatctgaaaattcgtccaaaaatctctttcacacagttttctacccatccccacactccagcctagtgtacttcgccctgggcccacctgacggtgtcacaagctagctccaactctgtgcagaaccttcccaccgatctaaagactgagagaaaaagagagaacgagagagagagagagagccgaccgagctctggggcgcgtcgacgcgtggccgagacgtgtcgccgctccaaacccaacatctcttgatctcttccctcccagc

SEQ ID NO: 41602 - DNA, 1501 bp, Oryza sativa
cctcccacaccatccttctcgccaggaatccccttgctgccgcccacctcctcgacgacgcccaccaccaatcctcacgccctcgtcgtcgccaccggctcgagacctacgacatcgtcgtcgaggccacgcgccgcctacaaccgtgtcatgttccagctccgctgatccaaggccatcctcaacttccccaacgaggtcacagccgactcaaattcctacatgaaattttctttgaatgcttgtctataacttttctaactttgtactagtgaaattcatttgtttataaccctcagtagctattaaaaaactaaacaattagctatctcaaacggagcctcaatattcaaatataaggaatattaggttctaccaatatctgttctgaacatactaacatatacttcctccgttccacaatataagatattttggcatcttcatacctcgtctaaattcaccaacatctatataaattaggacgcgtatatgaaatacatatatggatccatgcatctatttaaaacccaaaacgtcttatagtgtgaaataaaagatatcatataaattcaccaacattcatatgaatttggacatgtatataaagacacatacatggatacatgcataactatttaaaactcaaaacgtcttatggtgtgaaatagaggaagtataaatttaaaatataggtgtatatatttggcatatcctttttatttgtgctataatatattattagtctgtttgttaaaactctaattcctaaatttaacttcacttgctttagagtggagttgtgaagcggctcgaaccccactcagtttacctctctagtccattttatgatagctcttcagtatgttccgctccctttttaggtgaagctatagttctgccaacaagctctctatctagtactactggttctattatagttattggttaagtactctctccgtcctagaaaaaataaatctaggattggatgtgacacatcctaatacaacgaatctaaacagatatatgttcagattcatagtagtaggatgtgtcatatctaatactagatcggttttttcttggacggagggagtaatgccttccatgtgcatcctagccattcagttctctaggcaaataattagccctccgaaatcttgctatttagaagtatttaataaagtctatgtacagaactacttgttgaacccctgggctaattcgcaagacgaatctaaagaggtatattaattcataattagcggatgattactgtagtatcactgtagtaaatcatggattaattaggcttattagattcgtctcctaaattagcttacgggttatggaatgggttttgttagttatctacgtttaatacttctaaatagtaagattctggagggctaataattagccctccggatccaaagaggccctagttgattatgctcccttcaagagccagaccctcgctttcccctatagatggcca

SEQ ID NO: 41603 - DNA, 1501 bp, Oryza sativa
ggcgcaaaaaaaaccaggtgaaaaaaagaccggccaaaaaaaacgaatccgcgtggatgcggtaaaaaaaagagaaaaaaaaaacaaatctaaaaaaaaagaattatatgtggtgcagtaaaaaaatcgaatcctattatatttgacatggtactatatctctattttctctatctctactacttaaaaaaattaaaaacgtttccgttgtccgtaataacgaaagaagggcgaaaaaaacattaaaacagaaaaaagaaagttcgattcaatttacttccattgtccgtaaaaatcttatcttatcttaatctcaatctttccaaggggacgagcagcaccctccatccccgcccgcgcgatgaaacaccagccaaagaaaaaaaacaaaattaagcagagggataaactagattgaagttcccaaaattaaaagaggataaacgatattgaaactcccctaactcgaaaagagggaataaaatatattgaaatttcccgacaaaattctctaaattcgaagaaccctaatttcgggtaagaaccataagagtcaaatccaaatcaattaagccaagggtccgggttacttaccggacttgaagcccctgagctcattggagctttccgggaagtggcactgccgcaccttcacctcctcgcagtcgtgtcgggttccctgcatgcgcgctgtcctggagcacccctccaccgtcctttgccgaagacgggaagcgtcggcttggcgtcgcccctaccgccgatgaggtcaggccgctcggcgcttgtcgccgtttgcacgcccaccttgccggaccgctgacgtcatggcatggctttgcgcgccctcgtgtgcgccccccagccggcgaagcaggagccactcagcggtcatcgctgcacgcgcgcaccagcttgccggaccactgtcgttccgctctctcgtcgccggagagaaatgggatcaggagagagggatttgggagctagggttttgcccctctcctcggtcggcgcttcatccggcgcggggacgattggagccgtccatcagatcagacggctcagattcgcccagtgtcgggccgtcgtcgccgttgattacgctgcgcctaatgggccacggaagtgcatcggaccgtccccgcatatgtgggccgcgctcagctgctcagcttgcgggccatcgaatggactcaactcgccgaagatgggccagcccaagtttgggctggcttgggaagacctgggccgaaagcaaatttgatcaaacaatgtggctcacatttttcaaattaaagtccgtcggataaactcttaagtaggcttgaaaaataaatctaaaactaaatcctaaatcctatgctaattgatcaaattagactcggttctacctatttgttaatatatcaaattatacttgatttttacaaatttgaggtttttagggtgacactatcaaacggcgtttttcccgttgcaacgcacgggcactattgct

SEQ ID NO: 41604 - DNA, 1501 bp, Oryza sativa
acgtgactatccgctgcctcggggcggcgggggtggatgtgccaagcctctcgccgccaccctcgggcttggacacgacggcgaggcggtccgcgcgctgctccatacaagcgagcgcgactttgaggtcgccatggacagagatggggccaccggggcccggcatcttcatctgtaggtaggcgtagtggaccgccgccatgaacttcaccaacgcgggcctcctcaggaccgcgttgtagggcagactgaggtctgccacatcgaagttcacccgctccgtgcggaagttggcgggtccaccgaaggtgaccgggagatcgatgtgacctaacggccacgtgtgccctggcgtcacaccgataatcggctgggatggccggagcatcatccccggggccttgatagcgtcaaaggctgcgggggaaaggatgttgagggccgctcctccatcaatgaggacacgccccagcttcacgttgcaaacagtgggggaaaccaccattgcgatctgtcctccccgggcaacgcatggtgggtggtcggtctggtcgaaggtgagggcaacctccgaccatcgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggccatcatcgccgtcatcgatgtcctcggcgggggccttctgcttggcctcacttcgccgattgccggaaggaaccgccggggacttgccctctcggcgctcctgcctcctctcctcctcccacttcctcgttcgctcagccaaacttttgaccgcacggcagtccacgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcatcggaatggactgacctcttcttcctcctcctgtcacgccgccctgtctgagcggcggatccaggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcatgccccccctgaacgcgtagattaccgcgtgtgcagggatgcatggtatggtgttgcggacttgacagaaccgctgaatgtattagcgaagtgactcatcatcccttcgctgtactgcgtgtaagtccgcttcttcacctgggcgcggatatgtgccctgaaagttcatggtgaactgttggcacaaatcctcccaggagtggactgacgtgggtggcaagttcattagccaaccccgcgcctgcccctt

SEQ ID NO: 41605 - DNA, 1501 bp, Oryza sativa
cccggacccgagctcccgtgcccatataaaggaccccctagtcgtcctctacctatcctctcaagtcccgtcttccgccgccgccggaatcgctctccccgcgctctccttctctctccaagcgccggcgccgctccagccgcgccgttcgtcgtcgtctgtcgtcgctttcggttgccgctgccgccgttgggttcgcaggaaggagaggaagaccggcctccacttccccgacgccgaagacctctggaagtacctcgccgactcgaatccaagcttcgccgcctccggccgccactccagcagccgtgcgccgtcgcctaggccgtcgccctcctgcgccgccacctccatcggctccgcaaggtcgagatctaccccgtctaccggttcccctccgccaagtctcgctggaagtcgctgtcaccgtgaaggccgagtttgcctcctcggtttgatctccggccgagcctccttgctgttgcagtcgtcgccggttcaccccgaggccgtcgtcggcatcgcagcaccaagccgaaggccgtccacccctccgttgtcgccgaaggtcgccgaaacaccgtcgccaccgtggacagtatctcaccgccgtcccgatctcgtcgccggccatcttccgtagctgtccgtcgtcgcgtaagtgttggtaagaatcgctgttgcctcctctttctcccggtgcccttcgtttgcattcgtttgcattattgtgccgtggttcgccggcaaccgccgctcctatgacgttcaccggtatagatttttttccctagggccttaatccaatctaatctaatccgttgtttgtctagcgtcgtcatcatcgaccctccctctccgatcgatttggttcggcgagacttctatccgtgtcccctcgggttaggtttcaatccctcggtcatgtcgccgccgctgttgctctaaccctagcgcagccgctgccgcgtcacttggcagctgccctgtgcaccgccgctgccgccagcaccttgttgccgccgcgtcgctctttagccgctgtacatcgtcgctgcgctagccgcctagccgtcgctgtgccgctccctgctacagccgtgctgctgctgctcgtgcgtgccaagttgctgctgtcccgctaccgtagccaccatctgtcgtcgctgtgccatcgccttaaccctagccgcgtgtctctgccgtagctgtgtgtcgccgccgccgcctagctgagccaagtcgccctagtgccgccgtgtcgcagctgtgtgccactttaacctaaccgccgctttagctgttgctcagtagtcaagttgtctagccgtaggtgcatccctaaattcctaccaacctatcgtttgccgtaccggggctttaccgtgaatcgtgtctagctcaccggtttagccgcagacgttgttgagtcgttcgctcgttcgttcaaacgaggtgttccccgtgcttcgttcattcgtccgtgtcgagttgtccttta

SEQ ID NO: 41606 - DNA, 1239 bp, Oryza sativa
agagctccacccagatctactcctattttaggtggagctaaaattgtttggctgagctctagctctagaagaggtagagctgaagttaaagctgtgccaattagacactacattcaaataattaacatcggctatatgcatgcacaaaaagttgaatgactattgctaactctattttttaatccgtttttcttctaaaagtatttacgcaaatggacaaacatacctagatattctgaatgttacttctaatgctagatctattggtgcatttttcactttaagaattaattcattatatttttggtcaacatttgagaaaaaagtcaattacatcttatattaaagaaaggagatatacagtacacatctatatcaacattttatctcgtacttgggtaaatatttggaagataagcatatatctaacgttaataaatatctagccaactcacatactcatttctcatttgctctaacgcaaaaaagggaagcatttaggctcaagtttagtcctaaaaaaaatagtttcatatcatcctcacttcagttcattctgcagatcatttttttagaaggcaattactatttctattaactaatataataccgagtagaaggaaaagacctaatataggggtggtcgtgacacgtgatcagtctgatcgacgcaaatgcgcctcccctagctcttggctcccctttccacatgcacttttaaaaattcaaatcaattcaaaaaataagtttcaagaaaaagagaaacaaaatagaaaaatatctacagcacgtaaaaaaatccgtgtatataaattttacatatagaaatatatgcattgcaaactttatacatataaactttatgtataaccccaaaaaaaaactttatgtatagaaacattctcagtaaaaagtattttaatttaaattcaaatttaaatttaaatcaggtatatgaacttttgaatataaactttatgtgtataattgtgtggcatatattgactaatacaatatgtatataatgaattaattcctattaaaatgaaacattgaaacgatagctcccagcggttagatctccctcattagcgattcctagaagtagagcatgcagatagctcgcttgtcatcattatccacagcatgcgattaacgtgacctagtggctaattatgggtagtttagtggctaattaagtgatgaaggtgggggccccactacgtggcgtgttacagt

SEQ ID NO: 41607 - DNA, 193 bp, Oryza sativa
gaaatttgggctaaatttctgggcgtgacacccaggccgctgtgtttcgcatcaacacgctccggggcggcgaggtgcacagcctcgccctcccgtcgagcacacatacgctctgcagagtttggttcgccaccggtttgtaacatcttggtatcacgagaccatgatcatgttcgccgctgccgcggcgcca

SEQ ID NO: 41608 - DNA, 1501 bp, Oryza sativa
attcattttatgagtcaaaataattttgggggtagtaaatgatttcaaatggaaaaaatgtcatcagcaaagttgtataacttatccagatttacaacttttagtttggtcatttttctatataacatttttttaacagtttgaatttgaatttgaaaatataacaaattcaagcaacattttcaaatactaaatgatttcaattgaaaaagtcatcaacaacaaagttgaataattcatcaagatctaaaacttttatttttgttatttcttcatccaacgaaatgttagtaatattattcataaattttacatatatgtgttatagtttataaaaccagataagagatatgtcaattttatgaataatgttactatcactttgtcgtatgaagaaatgaccaaaataaaagttttagatcttgatgagttattcaactttgttgttgatgactttttcagttgatatcatttagtatttgacaatattgtttgaagttgtcatattttcaaattcaaattcaaatggttcaaaaaatgttatatagaaaaatgaccaaaataaaagttatagatcttgatgagttatacaactttcttgtttatgactttttcagttgaagccgttcactgatctaaaattctatttgaacttttaaaactttgaatttcgaatttcaaattgtttaaatagagtcatatggagaaatgaccaaaataaaaattttacacctcgatgagttctacaactttggttttggtgacttttccatttgaaatcatttaataacccccaatttgacatcctggcttagggcttaataagattaatagaatactcataccaacaagttacaactacttttccggaagccaatctagcgtgctcggcttggaacaatttcaggatgggtgactgatcgggaagtttgaattcaagttaggacaaaaaaagactggcctagaggcctaaaactagccaaaaaataaaatttatttatttttggattatactcatctgtgacgggcattaacttaggcccgattgagatgagggtcatctgtgacgggccatagttaatgctgtcatctgtgacaggctatagttaatgcccgtcacagataagggtcatctgtgacgggcgctagttgtggcccgattgagataggtcatccgtgacgggctatagtttgactagtcgtctgggtcaaagctatcggtgacgggctttaattagggcccgatttagatagattcatccgtgacggccgtttgcccgattgagataactcttcacatctgtgacttctagtctgtgacagacgccgtgcccgattgagatggggtataccgctcgattgagatgatggtatcccttctagtgataggatctgatgatcggtccaacccagacacagtcaagtccaattaagattgttctcatgttttcttgcttgcagcacccaaaacaaatccctatccaataatttgaagttttgt

SEQ ID NO: 41609 - DNA, 1501 bp, Oryza sativa
aaccgggactaatcaacacatgattttacttttggctttacacattttaatcgtgtgttaaatgagaaacgtccagaggtcttccggctaactccataagatggtgggctagatgacctaaattcgaagcctcactctttctaattatttaatactagattattctctaatattcgcgtctttttaatcgtgtgttaaatggtacactcgtattcgtgtgtgtagtgtaacgcttgaaaggtacgcgcgaagtcttgttttaatcggaaaagtgattattgtgcactagttggaccaataagggaagaaaccagttctctgcaaagctggcaaatctctagtaaaggccggtgttgcccggtccggggctccccggctcccgaggatttcgtcgttaggctcgcgggtcgcctgttccgccgcgcgatgcgtcgtcagatgggccgtagcctgcttgggcatggggcaatcgagtcgatgccacgccgggcgcgggttgggcctcgtcgcgggggggtgcttgtcagctgtcagctgtcacttcctggaacggattctcgggctgccgatcttgccggtgggcgcccgcggcatcggcgcagtactaactgggaataagttcaatttgtgatcaatcgaaatctaatccgttatcctaaaccataaaaccaaatatctctaccccaaacttttaaaaccggttcaatttaactctcttgatgatttcgctgacgtggcgcctatgtgactcccctcctatattccctctttcttcgttggcagcggcggtcagcggttgcggcctctctctccgatgacctagagctcgccaccacccgcacccgcccccgcaccctcatccgatccatcccttccctcctccatggccaaagatgccgcggcggccgccatggccacggcctcgctctctagcgatctggagcccgccacaacaacgcaaatcgccacaacaacggggagcggcggcgtcagtatccaacagtggggacggggttctcggcccattccgccccagcggcgagggcccgacagcaggggaagagacaccatggccgcccgccgccaaccgaagaggaagaaccgatgagaaagggagagaaagagagagaaaagggagggaaagagggaggaggaagaagtgatttatgttggccccacatatcattatatcagtggggcctacaactttttttttgaatgaccaatgggccccgcatatatatttttaattctaatgccacttaagcgtcatgttaacgccaagtagtacgaagacctggtcagcactgccacgtaggcgccatgtcagcgaaaccgctcttcaaaactgccgagggagtcaaattgaactggttttagttgagggtcatggattagattcgggtcacttttaagggagtcaaagtgaacttattcctactaactgggaaggctttgtttcgatgggccgccaccgtcagcggcctgtccatttgcccaa

SEQ ID NO: 41610 - DNA, 313 bp, Oryza sativa
atgcaatgtccagataactcatcagctgaaaccccgatgaaacccttattagcaatcaagaaacaagctagagattatggttctaaacatgacttagtagatcaaacttaattgatgcagcactaagtatgaaaagaaacataatatctagacaatcaaacccttaactgattttcggggtggtagatatctaagtcaatctaatctagcaagacgatttagccgataccggcagaaaccctaaagcgagaagcagccgatagagctaaattgatatgctaagattaaattaacatagccatatgataaattg

SEQ ID NO: 41611 - DNA, 881 bp, Oryza sativa
ccgaaatcgctcgaccaaatcttgggaggggatcgagacgatctctccaccaatccaaggaaaggaataatcgatggaactggacgagcacttgagattatctcacgccgccatcaaggctttcccaaaacgagaggcgacgctgaagcgggaggttttaaatgtactaggaacagggtttacaatttcgctttcggtcaaaatttcagtgctataccgcaatttggaaattttcggtacttttgggccgaaattatataaattttttaacaaatttcgactgaatttggataaattttgaccgtattcacaaaaaattgagaaaattcgaaaatttcggacgagataatggcttgccggtggggtctaaaatttcgaaccggcattgcaatcactgactaggaattcttttttttttgtgtccgtttctactcgatctgagccgtccgtttcagcaacaacggacacaacaaatccacacgagggatggtgcagcacgtacaggtttgtgagacgctgcgtggtggggccagggacatggagggtcaactttgatttaccgtttttttttttgacaactcaccaaggaagatacaaacttgatttaagcaaattcatttcactagcatatttaattttacgttagtatttctctactacttaaatgatgagctgattacagattggtccatgaagataagtatgtgtgttctatgtatgacctttttttggaagaaaaaatggttacatcatctagacatggatatacatccatggatgatatagttagtttgatatgctttctattttagttttatattctcaagataattgttttaatatatattttttcaatcggtatatatacttatcaggcgtaa

SEQ ID NO: 41612 - DNA, 1501 bp, Oryza sativa
cagtcatggtagcctgcaagctaacaaacactgaaatcgactagggccaagtgggagataataatcagcccaagtgttttgcagttataattacccagtcattagccagtctctgaatatatatctaaggaaattaaactccaccgttattacacaaataacaaaatcaccttccattttggtttctggcaaaacgccactgctgcaaacgggtgttggctagctagctcgtactgaaacctgaaaacgtgtgtgtggtactaggaaaaggagggacaggggcgtagtacgttggatcacacgaacacattgggcggatgctttgcttgtctgcgagcggctatggaggtgagcaaaccggtgttgttcgttcgttagctagatcggtgctccaagggctccggccaaatccaacttcttctgcagctgatccgcactgaaacatgttggctgtatccaactacacagggctatcttgtgtctttggctttgcctgcagaagcagctagctgaacggcattgacatggtgcctatctatttggaacaggaatgtattatgtaccattaccaaagcaggccaaggacaagcacacgagtagttaatctctcttgtatatatatttgatgatagaaatgtcttatatccctgacctcaatcaatctcttctatatagtatgtcggatttgcaatagtattacttcccgtaaaggggcggcaaaatcaaaaagaaaaatgccgttctgaagtaggtataagtacagatgagtggcggctccttctgtcttgccattaatttatttataaatatagtagttcagaggttagtagtttttatcaccctagcaagtaacatctgttgttttaaatgttaatagtcattttttttatctttatagttgttcagctcaagattatcttcaaggatgatgaaagatgaaaaatacatctccaaccacttagtacacccagttaaaagctcaattcttaacttagttatagagttgggctaacccagttgtcagggccgccatcgaatcccctatctatctgcgttaaatttgtaagtaagttcatatttctctcaatagtattgatatttggcttcttcgtggtatctaacttttttcctcatgatggttaagcttgccactacatgtagtcaagttgtattgattaaaaatatatatagtctgccaaactatattcagatatggcatggctaaaaaatttcataatatcacacgcttgtaagttttcataatgtatgattataaatttagtggttgagtgtcatacgtagctttgaatttgaaaagtgaaacatagattatttttttttagggaggagttgagattttaatacacgtacgttccgttttcaacgtgtgttaagtagccaacaatcaatcaaagaaaaagatgcaattgggacgttaattagtctgattattgcagaggcttcgtttttctacctaaaagccagcaaagatttcgctttt

SEQ ID NO: 41613 - DNA, 1057 bp, Oryza sativa
aataatttgtgcaaataattaaatacctagaagctatatttttaattataattaaatactagaagctatacctagattcatattgggtatctgatggttgataattgatagctcaccctctagcttttatgtcctttgaaatttgtcaaatgaagtaaagtgcatattgttttatgtttttagcaagagcagtacaaattttatcattttagttcccactgtcctacatgtaaaatggagtaaattacattaaattacacttgtactgcaaaaactatatattcaagaaaatatagttgttctgacttatgtatggctttctgaaattcgaatagttgtcaaaaagaagacacaagcctacctgcaacaaattcttagtaggatcataatcgcctttgtaacatgtctaaatatggaagatgttgttgatgactaatcagactcacaagtttgtttatctcggatatcatgatttatgagtgacttctgtgtatttatggttctgtgaatttatggttctgtgaattcattcttctaagatagttttagtcgattctcaatgttgggttcactgcaacctactattgtgcttcctgtgcatggtatacttggcatcctcccttttttgtttaaaatatctcatgaacatagctcatttttttaatgtggatatgctggaacccagggatctctgttgcacatcaatgtattagtaagtcggcatctaattttgaaaggttctaaagcagtaaccattgtttgtgctgccaccaaccttatatcgcttacatggcccaaccagccgcttgtgctacctacctaagcagtacatggttggacgctgattccccttgtttgtgacctagtagatcaccaaatttcagccaatttgccattttcattattttctgacaccattgctggttcctcatatacatagttattggagatgtaagtagggttgcttagttacctggagtatgattcttgcttcttaggaattctggtagcttcaccttttccagcggatgtttttggcaacgattgactattttgt

SEQ ID NO: 41614 - DNA, 318 bp, Oryza sativa
actatagggcgaattcgagctcggtaccctatattcgacctcttaaattgctctagttcggttggtatttttgcctaccaatttatcatatggctatgttaatttaatcttagcatatcaatttagctctatcggctgcttctcgctttagggtttctgccggtatcggctaaatcgtcttgctagattagattgacttagatatctaccaccccgaaaatcagttaagggtttgattgtctagatattatgtttcttttcatacttagtgctgcatcaattaagtttgatctactaagtcatgtttagaaccataat

SEQ ID NO: 41615 - DNA, 1501 bp, Oryza sativa
agcttcatctaaagctcagttttgctgcaggctagttttcttgcttgaaatcgagaaatttggactgatgttgatcgtggagtgtgatcacaggcgctcctttcttcgatgaatgtaacaaaaatctgtaaaatttccataattacgttggtttatagtatgcttgagctagctgaactcaactggaagtgcactggccacagttccagaatccagcagaaattagagggccattaatttgtcactcgtcaggcagaatctttgcaacttgttctatcaaatatcctggagagtacagttcatgcttacagccaaacagacatctgtttaggacagtagcggcggcagcaatcacgggcacggcccaaaattgtactacacccgtttgtttccccttgagccgatcgcatgtttgtccttctgtttggcatctaaattttggtcatttaaactcaccagaggtgacaattttttgtgtaatctgttcatgtcaacgttgtggtcacggcctatacatggagtacctaagctaggcacaaacttttgctgcaatttttttttatttctgtccaattgatcgtgaactatcttgtatctttcaggttgtatgtttgtaagactatactgcagtaaaaaaaaccaattcttgcattgactgaatggacttcaaagttcaaccaaattggtcgttttcgaaggacagagattaacacgtctttcaggatcaaggtggactgcttgtgcgagctagattagagcaagttgggacgactacttgactagtattctaatcgaaatgcaccactgttttgcactgagagctggtggtaaatgtccaattcatcgtagcatactatcagcccaacatggtgtttggttgctctctctgataggtccatttttacttctttgaattgctgaatctgacatttttctctatcagtggagctttactatggcatcagttaacctttattatatataagacagtagtttttaccatgagtgtgatttcatgtcatactttccatccaatttctttccaacttttttggtctagtctgctccaagctaagtaaagctacaaaattcgcatcaaacgagcacaaaattagatacaacagttgtgtgattctcgcagacggtattgtttattctcaacaagaaaagatggatttgtttcggtttggtgacaaaacgatgaaatgccaaacaacaactgcacttgtctatttcactcgggggtggactgatgacatgttacagctggttggttctgactggtgtcatctcatcttctagaggcataacaagaacaaactacctaacaaggcgtacaaaacaagcttttatctttagttccttctctgaatctactgctaaccactcttctcatcaccaagtccccgataaagtttggttaccagtaagaaagaaaaatatgagatcctctcatggaaagtgaaatgcaggagcaaaaaaatggaagaaaagattgact

SEQ ID NO: 41616 - DNA, 1501 bp, Oryza sativa
catgcagatactccttctaagaagtagtactgtctgtactgatgaggatttgtgtgacccaactaatccattgttcatgtggttggcaacaggccaggtgctacaagttccacgaaaaagaccagctttaggcaccacagatcatcaaaatatggtaaaaaaaagaaaggcattttcaagaaagaaatagatgaaaatgagagggacataaccccatgatagccgtgatttgcacggtgcctatggcacctcgttactcagttagcgtcagtccgttaaacggtggttttcacaacagagacgttaatcgtcggctccaaaagcgaaatctttgctggcttttaggtagaaaaacgaagcctctgcaataatcagactaattaacgtcccaattgcatctttttctttgattgattgttggctacttaacacacgttgaaaacggaacgtacgtgtattaaaatctcaactcctccctaaaaaaaaataatctatgtttcacttttcaaattcaaagctacgtatgacactcaaccactaaatttataatcatacattatgaaaacttacaagcgtgtgatattatgaaattttttagccatgccatatctgaatatagtttggcagactatatatatttttaatcaatacaacttgactacatgtagtggcaagcttaaccatcatgaggaaaaaagttagataccacgaagaagccaaatatcaatactattgagagaaatatgaacttacttacaaatttaacgcagatagataggggattcgatggcggccctgacaactgggttagcccaactctataactaagttaagaattgagcttttaactgggtgtactaagtggttggagatgtatttttcatctttcatcatccttgaagataatcttgagctgaacaactataaagataaaaaaaatgactattaacatttaaaacaacagatgttacttgctagggtgataaaaactactaacctctgaactactatatttataaataaattaatggcaagacagaaggagccgccactcatctgtacttatacctacttcagaacggcatttttctttttgattttgccgcccctttacgggaagtaatactattgcaaatccgacatactatatagaagagattgattgaggtcagggatataagacatttctatcatcaaatatatatacaagagagattaactactcgtgtgcttgtccttggcctgctttggtaatggtacataatacattcctgttccaaatagataggcaccatgtcaatgccgttcagctagctgcttctgcaggcaaagccaaagacacaagatagccctgtgtagttggatacagccaacatgtttcagtgcggatcagctgcagaagaagttggatttggccggagcccttggagcaccgatctagctaacgaacgaacaacaccggtttgctcacctccatagccgctcgcagacaagcaaagca

SEQ ID NO: 41617 - DNA, 401 bp, Oryza sativa
cctttgtttgtgtttatttacgttggagagattttcgtgtgggttggagattaccgctgctggatgtttagtagctctagtgtggttcggtgctattgtggtggagatgtgcggccctggggaaaatagggtctgctagggcacaatcttgggatctgatgtgtccagggaaacatagggctgttttggttttagtgccaaatcttgcactaccaacaggtagtctaaatagtacttgtgtgatgtttggattgattccataacttgccaaatcaatagaaatctctccctagaaatctctaacaaaatgttgatagtaataaaacttgcccaagatttggcactaccactggtagggtagcaatccaaacatgcccatatatataatagggttcgatgtt

SEQ ID NO: 41618 - DNA, 806 bp, Oryza sativa
aaaacccacagcaggaatatttatgaagtacatgcattgtagatccttcatattcagtggaatccaacatggaccaaaaagggatttgggagaatatagagagaagaaactcagatgctatcccacgacaacaaacggcagaagccattgtgtcttgtataatttcctcccatttctcaaaggtaaatcttttcacagtccatgacaatgcgaacacctccctcctgcatctactgaaaccatgatttggtgcagaaaatgtcacttgaacacctaatgctgcattacttgcaaggacgagtgttacttcaggtcgaagtttcaatgtctccagaaattatgatccggtaaattagctcttccatttctatcccaaatcttcaccttacaagtttctaaccctgtgttttttttttctccaattgctcgacccaaagggatgcaatggacattgcaaagcaagcggaagaggagatactgaaggctgattccagcataagccaagtaagcgtacagctaagattgggccagcaaattaagcaacttaagctgccaggaggcaaaaatagagcgaagaatcaacaggcacaaatgcagtagcgtcagctacactgtcacggttgattaggctgttttttttttcttttttttttcaaacattattcgatcgacttcgcttgctgctgagtgctgaggcagtagactagttctagcttcgtacagagtgatcttagcctgttcaggcttcagagatactactatggagcagtatatatatatatatatatatatatatatatatagga

SEQ ID NO: 41619 - DNA, 1501 bp, Oryza sativa
aactaacacgtatataaaatacaatatgaatattacacatttgtagtttcataaagttattgcaaaatttaaaattatgatgtcattttaatatatttgaataatataatgagaaaatatacatgctattatatgagataaaatataatgatgctagccgcacaatctgcgcgggccatcatgctagttcttgtaaaaacattagtgtcagctgtctcactctcatgctagacatgagaatgcacacctttgattccaatgtggactacggagcaaactcggccacgagaatctgatcctctttatttctcttcgtttgttttcttcttcttttttattggattcttcttagaacaaaactgtatgtatttggatgtcaagtgtattactcaaacttaatctttagttgtatctttttttttcttacagatctaaatatggcttacaataacaattaaaagaatcagctaaccacctttgttttaacacgtcaaactttcatagtacaaaggtttccatcttttacaaataaatatgtattgccaactactaattagtctccgagggtgtgtttggataatgggaaatggagagtgggattgggattgggaaatgaatgaagagttaggattaaatggaagagggagaatgaatggttaggatttaaagataccttttgatgggtgggaaatcattttccaatcctattatccaaacaatgtccgaaagtgattgataggtcaatgtatggtgtatagcatggttcagttctgccttcccccagcaaaagacacaagctatcttttcatctcgcttttggcacgtgtcactacattggtttgtgaagaccgatgagaagtagaatctggcttttgtgaagaaaaaataccacattgtagagctgaaatcaatttatttactcaccatttgccacaatcgtaagcatgtatagttctcaacccctcaccatgttgtctcgtccttccctccgatttgttctctgtactatgccaacgcctctgcttggagggatcatccatgtcgatcgtctctttctctcacatggatcttttgtgattcataatggaactcaattttgaggttttgggagacatttcttttgataagttatttacctcgttgaataatcttgctagcaagaaaaatgtcgtgttggccaatgtgttcacaaacgtactacttgatgtctcctttagaaaagccctaattggagataatcgggtgactttatatgatagggcaattgcgttttttaccctactttgaagactaaccactgatttggtcatttgactctcttttttagaaacgaaaatggggcttgaccctattctgtgaaggcaacatgacggtgttaactcaagacaaaaatttcatttatacccttgtgaatttaacctagtttctcaaagttttttattcagttttgtgcaattagtatatattaaactgaatcaaacaaaatttcatggcacaaatt

SEQ ID NO: 41620 - DNA, 336 bp, Oryza sativa
gtctaattaattaggaatgtttggattttttttttttgctgaaaatcattttcaagaatgaaagaaatttggtctgtttacatttactgttccttgtttagtgctttacagtcttcacctttagaagtttatattcaagcagtagtggagacagggaggggcaggaaggggtctcgcctcccccaagcacactatatttactgtagcttttataaaattttaaaccgttagtattgttgggcccctccaactaataaaatccagtgtttctgctccgccactgtattcaaggctagctttcatgatgctacttgaagtgatgatttcactgatgca

SEQ ID NO: 41621 - DNA, 536 bp, Oryza sativa
cgtctctttctctcacatggatcttttgtgattcataatggaactcaattttgaggttttggagacatttcttttgataagttatttacctcgttgtataatcttgctagcaagaaaaatgtcgtgttggccaatatgttcacaagcgtactacttgatgtctcttttagaaaagccctagttggagataatcgggtgactttatatgatagggcgattgcgttttttaccctactttgaagactaaccactgatttggtcctgatttttcgagtttgctcatttgactctctttttttagaaacgaagatggggcttgaccctattatgtgaaggcaacatgacggtgttaactcaagacaaaaatttcatttatacccttgtgaatttaacctagtttctcaaagttttttattcaatatagttatgtgcaattagtatatattaaactgcctcaaacacaatttcatggcacaaatttatgtccaccaaaaacaaaaaaaaacatgtcaagcagcaggacaccacgtcgccga

SEQ ID NO: 41622 - DNA, 1501 bp, Oryza sativa
ttaattgtgtgtgtataaacctaaagaaaatatcaaaacggtgatactacccctatgtcttagaattattatttttaagagaaatactattagacctcgcctagtagttatatataatttactcatttgcctcagacatttatttgcttttgcattcaaccaacttggcaccctgaattccgttaaaatgtgctgccaaacagcaagattattcgctagacatctgctcggaaagataaattaactaataatgcttctacacaagccacatgatctagttgaatattcttctaaaaacattagtgtcagctgtctcactatcatgctagacatgagaatgcacacctttgattccaatgtggactacggagcaaactcggccacgagaatctgatcctctttctctctcttcgtttgttttcttcttcttcttctttatgggattcttcttttgtttttacaaactcaaaggtttccatttttataaataaaataagtccctttcatatgaatatatattgccaaccactaattaatccctgagagtaattgattggtcaatgtgtggttatttctaccttgcccccacaaaagatacaagctatcttttcatctcgcttttggcctagatcacgacatacatatatatttggtttataaagactgaagagaaacagaatgattgctgacaggtgcttctcctagcttttctgaaggaaaaataccacattatacagctgaagtcgagctatttactcaccatttgccacaactgtaagccccaatatctgtcaattaatgtcaacaaggtgggggtgagcaggcaagaattaaggcgcttcatgcgggcaaaactttggggttgcagagcttctatactgtttactgcaaaattgcatgctatggatatccctaaatagaagagtatacggagttactgtcctgcttgacaatagtaagatagtttagaagtatgaaaactatatatagatgttaatttgttgagcaacaatagtaaaatgcaaacaggaaattttgggttgacatgggacttttaaatcctttgtgaatatctgaataagaaaaggccctaattaatcgtgtgtgcacgtaaatcatgatctctaaaggactacacatacccatttgatggaagaacccactctcatctcaatcacattttggacggcccggatcattgtgagattcatagagctactgtgcctcaaccatatcctgtcctcctccttctccctctactcgctcagatcgatgcattccagtagccagcctcccacaccaccgccattgcactcgttccccctgatcttgtcaacgcctacgaggtccctctctcctgctcctcaatccaacgggggtgacgtggccccgttccatcatcttcctacgctaccactttctcaccactagctccactttgtccccgttgttcaacccatgtggcttagcttcaatgacgatgccgtcataggaatccctc

SEQ ID NO: 41623 - DNA, 1501 bp, Oryza sativa
ttttccaccggaggagtcggacgtttttttacgacaaaatttttttctccttttttattttttctctcaatttttttccgtcgtctctccttttttttttccaccggaggagttggggtcggacttttttttatttaacgatagaagttcttttttctcactttttttacaccggatgacggatatgtattttcaaaagcaaacgaatttaaaaaccgactcatatacaaatgatgtatctaaataccggtaaaaacatcaatttttataatagtagagactaacttcagaattgtttaggaatacccgattagaatgagtagagatataaatagatatagatataagcatgggaggaaaagaaaccatgtcaaccataaagaatatattttttttggatagaaacggaggagttaatgatggacacagacgcgtaaaaaccgtaaaggcatattttaatttttttggctaaagagtttaccaacacttggtattaataaattctaaccaaaatccgatacatcatcaaaatcttaatgctatactattcagtttaacgctaacgccactaaacttccgcaatgctaaatcctctatctaccatgaaaacatagtcctatatctaccatcaaaacataatagactactctttctatcccacaagaactccaatcctgatttcacatggtggatttagagcaggtacaatagatcattttttgttggctatactgcatccatgtcagaaaaattgatgagttagagtgtgaatgactaaatgagtggacagagagtgaaagcgagcgaataaataagcgtcaactgctcacacgctccaaggtgaaaactatctatgctaccatatctcctattagttccaaggtgaatatagacattgtctatattcgttgtactaggagggttatatcctctcatagattgtttttttacgaaggagtagttcttttctcacggagagaatgattggatagagagcaaaaggatattggcagacgtgaaaaggttagattaagaaattaagaatagatgtattctatttgggtgtagatgatttaacatctactgctaccctgtcaaaaaaaaataaattctaaggatgtatctagacaacatgtatgttcaaatacatcctcaggattggacttttttttagacggaggggatacttatttgtacacatactgctcttattcactaggggcctgtttagatcacaccccaaaattttacaccctgttacatcgaacgttcgaacacttgcatgaagtattaaatatagggtaaaaaataactaattgcacatattgcgactactttgtgagacgaatcttttaagcctatttgcttcatggtttaacaatgtggcgcaacaataaacatgtgctaatgactgattaattatgcttaataaatttgtctcgtggtttactgacagatattgtaattatttttttattagcgccaaacaccccatgcgaca

SEQ ID NO: 41624 - DNA, 167 bp, Oryza sativa
gcggagcgcgtgtggaggcggcgcggagaggtggagcaggagtggatggaggcaagacgggtgggagagcgaggcaatgagagacccgttgggggtgacggccaccgcgccaccgccgcctcctcccaaccgaggcggcgtcttcgccgactcctcccaaccgaggc

SEQ ID NO: 41625 - DNA, 1501 bp, Oryza sativa
gcatagtatagtctcatttgcataaatagcatttaataaatatttcagaatttaataaaacagtagagtattaaattaaacaatattaatccaacgctatacaacataccctgttgcataggcccaaccattctgaacaaccaacctcggctgcacagttctatctccaagccaggaatataccattccaaaccaggagttaaacaagttattaaacagcatcatttaatatggtaagaagtgtgagactaatcacgaaagacattgttagacccgcccataaccgcgggcacggctattggaatagttttaactctagccagaggtgtaccactgtacccccaagacacaacctcaacatcatgtcaaccaagcgtcgcgatacttacaaagtacccgaatagagattgtgacaataccctctatataatacaatttaaagcagtgcaccgttcctggatcataatcacccccttataaacaaggcatggactccccagcgacccccgtgggcttatctccaccacttcacagcctggtgctctacaatgaaccatactatacagaaagtaaagccgttgctcacgctggcttgtggttggcatggttaatgtttcacaaccgaaaatcgtgaaccggtccttaattttcatgagcacgaccatcaaaaccatgtgctcacaacccaccattatcaggttttagttggcaaattaattaattaaccaatcacgattaaccatcgtgagctatcattaagccatcattaaataatagtgaatcataagttatcctaatagtgtgctaatgtttctaagcatggctaagcaattatgtctaatatctagctgaaccaatatataaagctcaactagtcaaattataataacccaaagtattaaggaatagagtaatcaagaacaaaagggctataacaaggcaataggttatttccacccaatgacattcaaaaataaatgcaatagttgaatagaaacaataactttaaacgggatcaacatgctcaaaggattgtttggaatctgtgtgacttgccttgctcgccttggaattcctcaaagtcttctcctgcaaaatcggactctccgggaacatcggaatctaaagagaaaagagcaaaaacactaaaacagcacataaacaagcataaaaagtacatgtggatatttttaacatgtagatctcaattttagaaaaatttagagacttgaaccaactaaatccgagctaagatgaataagttatgaatttttaaagattaaatcggattaaatcatttatatagattttaattgaattatgatgcaataatgaataattttttaaaaggaaaaggggattattgcgtcagtggctcgggttcacggtggaccgggtgcacagcggcggtctacggaaacgaacggccgggatcaaccctatccaaaacagacggccgagatctaatcggtctaccgcggctcacgggaaacgacgacga

SEQ ID NO: 41626 - DNA, 1501 bp, Oryza sativa
agattagatctccggtctgaccaccgagatcagctgccgcttgctgtcaccgccaccggtctgaccgtctctctcccgccggtctgaccgtcgcttgtcgccagtctgaccgccggtatgtcgccggttagaccgccgaaacccggtgaaacacaaattgaagaactcttaaagtgaatgacgactttattgattctctctgtgtttacaaagtgcaccaatagcactccttacaaaaatttcgactaaactcgaaaccctaactcaaaacgcaactcaattgctctcaaatgcgatacagggaagcctcacgctccccctctatttatacccgaggtaggcagcctaaagccacaaaccaaactcatactaagagtcctaaacaccttaggaaaccctctagtacaagaaacaaactttacataaccaatcatatcaaattcggactccttccaaattcgactccgtatcccatacgcacacaatacctccatcgtatgccatatggaatctccatcaaccacgtgcatcaactctagcctaagtatcccgcatgatctctgaccaccacggacgtcgtcttgtccccaagccgactcccggtccatcaccgcaaatactctcctgaggcatcaagttacctacacatgaaataaacaaagaaacccatattccgagaccaagctatctccaacttgattcattagtagcaaacaacagtattacatacgtatagtatacatctagaagccataatcatgaaacaatcacggatatccaaacaaacaactcgaaactgaaaccgacacagcgtcggccggtcagaccgcaggctgcgccggtctgaccggcagcacatgcccggtctgaccggtccaataaacagcagtacctgtagatcacctgtgaaatccaatcatctccaaaaccacttcgtgaataaattccaaatagcaaaaccaataatctccgacgccaattgttcatcacagaataataatcaaaaacacctttgattttacaatatgtattaattaagagattatatcgaatattacctttgtacatgtccaaacagagtatgtcctctatacaccaactaaagatacatacagttatattcatgaataccatatataacacatggttattattagagcatgcgcaatagatgactaatgctatttcctatcacaaaaaattggatgtgtttttaaagaaaaagtggctccagcagacctcaaagctagatcccaaaactttggggaccctaatcttccgctctccacaagtcgatcatgtagtgctctggctcctaatccctcgctcggagtaaaaaaaaacgcgaacattagggaatggcctaatatctaacaaataggagtgaggctttgaatacagactggtaagcctaaagatccctgggcttttatttgctcagagtgaattctgatcctatttatttggggtttggatacactttttattattgaaagtcaat

SEQ ID NO: 41627 - DNA, 222 bp, Oryza sativa
ctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 41628 - DNA, 1501 bp, Oryza sativa
aacttagttaaacttgaagccagtttgactttgactaaagccaaaacatgttaatctgaaacggagggagtacttaattagctagagtatctctcactcgaagtcaatttattgatgaatgcttgcatgaaatatatttgaccgatggatggatggatcgatcgtacgtagtgcatgttgatatctagtccaaagtcgtgcaagctcaaacatcacggcatttgactgacggtgacaaaacttaccaaagccatagtcaaatgaaagccatcttttttttattattattttcttagctaggtatcgagtgctgctggtaatgttgatcaccatgattaataatgtgtggcacggaggatggaatgtactaatgtttgaaaagaaatttccttttcaaaaggatgtgacaaaataaactaagtactgtgtgaaggagaaacaaaaaaaaaattccatcccaaaatttattttagaattcataattagattttgaggcgtgaatagatttctctctcaaagatatatactaattgactttcaataataaaaagtgtatccaaaccccaaataaataggatcagaattcactctgagcaaataaaagcccagggatctttaggcttaccagtctgtattcaaagcctcactcctatttgttagatattaggccattccctaatgttcgcgtttttttttactccgagcgagggattaggagccagagcactacatgatcgacttgtggagagcggaagattagggtccccaaagttttgggatctagctttgaggtctgctggagccactttttctttaaaaacacatccaattttttgtgataggaaatagcattagtcatctattgcgcatgctctaataataaccatgtgttatatatggtattcatgaatataactgtatgtatctttagttggtgtatagaggacatactctgtttggacatgtacaaaggtaatattcgatataatctcttaattaatacatattgtaaaatcaaaggtgtttttgattattattctgtgatgaacaattggcgtcggagattattggttttgctatttggaatttattcacgaagtggttttggagatgattggatttcacaggtgatctacaggtactgctgtttattggaccggtcagaccgggcatgtgctgccggtcagaccggcgcagcctgcggtctgaccggccgacgctgtgtcggtttcagtttcgagttgtttgtttggatatccgtgattgtttcatgattatggcttctagatgtatactatacgtatgtaatactgttgtttgctactaatgaatcaagttggagatagcttggtctcggaatatgggtttctttgtttatttcatgtgtaggtaacttgatgcctcaggagagtatttgcggtgatggaccgggagtcggcttggggacaagacgacgtccgtggtggtcagagatcatgcgggatacttaggctagagttga

SEQ ID NO: 41629 - DNA, 1493 bp, Oryza sativa
gggtgttactgagtcacccatgacgcttcctcttgacaaactacggtacttcttccattgcaaggcctttgtattctacgataaattcgtacgaagctatattgtggtgctcattcatgatccacataaacagatctcatttgctagattagaacatgacaagtggacatggctgccaccacacttgggaattcatgactgcgcctacaaggatggcctactgtatgcagtgacgtcatttggggaaatcttctcgtttgatctcgacgccactgtgatcacagcaaaggtaattatgggcaggacaaaggagtatgcgtgtgagagaatttatattgttcatgctccatgtggtgatctgctgcaagtttggaaaccacaggaggggaatggtaattgggttgatgaaatcactggctttccagctcttgtgagcaacactcagaacacaagaatatttagagttgacactgtggctaaaaagctggtgcaaatatttagcttggatgaccatgtgttgtttattgggaataaccagtcatcttgtcttggtgtttgtgagtacccacagctgaaggcaaatcatgtgtattttacagatgatttcgagtgcttgtcctccaagagcatgtggggtctccgccttgatattggagtccttaacctggaagataagagcatcgatgaaattgtagcacctcggcttttcctcaagtgtcgagctcctgtgtttctcgtaccgaatcctagcatgatgaattcaactctccacggttagacaaaaggtcccaatatgtttgtgtgtgtttagtagagtgcccgtgcgttgcaacgggaaatgtaaagacaagaaaattaaggaaaagttaaaaaaaattacattatgtaattaattaattaaaatacaaattttcttaaaaatttggatatttttttaagttggtaggtgtataattaaattataattacactctttggaattttattgaagttttcagagcttaattgcaaattttaataatacaaagatagtttcagcatttattcttcagcccgcgaattaaaatttctcgttcattctcttctgggtaaccgaaggtgaagtgctatttgatgcggactctgtatgatttgttgtgtgttggacccgggatgttgcggacaaaaataggtgagaacggatgaaaatttcaccggaagattaggtataggtatatagaatgttagattagattagattagattagaggtagataacatataaacgatgaaatcggatagaaatcagacttttttctttttacatacaatcggacctttttcgctctttttttattttagacggacgatggaaacattttcaaatttttgaagtataagtagagatagagattagccattttcgttttcttagagagtattatcacggaaaacatggtagtttattaatctataattaattaagtattagtaaaaaatagattaatatgttt

SEQ ID NO: 41630 - DNA, 1501 bp, Oryza sativa
aactagaagcaggtaacaggaaaccaaaagtgccttttgcaagatttttgcaactttgaggaaggctagaatgattgatgtaacttatatgaactttaggtaatacaattggacaaacttcctgactgatgctaatcttgtactagcattatgacttcaatataaatagtcagcatgatgtgttgacactatgagttatgggctgcaagagatgaccttgtttggcactttctgaacaattttcttcttagtgccttagtcagagaagactgctcggcagaaagtccaacttttttctgttgtaagtctcatctttcactctcctaacccccaactaacatggaatcttgatcttcctttcccaaatgatgaacttgccaataattactttgtttgatctaattgtaatctagtgttccagattctggtcagctggagtactgtactggtcctactaggcatattcaattaacaactacaatgacaagtaggttgtgtgatgaattatttatctgtttggatctttgaagaaaatagtacagtactctagaaagcaagtaagagaattttgattagtgggtaattaattaagctgttaataatttttacctggatggtacggccgagctgcatgggcttggccttcgcctggacggtctcgccgaggtgggccggcctgatgtggttgatggacagctgcacgccggcgaccctccggtagccggacgcgatgtagccgccgatgctcgccgccgcctccgccatcagcgccgacacgccgccgccgagcaccttgaacggctgcacgcaagcacgaacgtcgagacattttttttggaagccaagaaggacgggacggccggccggcggcggcgatcgtacctggcagcaggtggcggtgacgaggaggcggccgacgacctcgccggcggtgatggtggtgaactccattcccagggagtgcagagcattgtccggcgggccgtactccggcggccatggccagctactctctctctttccgtcctcgccggcgccggccattgctctgctcactccggtgaggtgagagagggcagaagaggaggccttgccggatatggttgggccggagtgcatatatattaatcagcccacttaatggcctgttcttttctaatcaaaggatggacgaatgcgcatgcttctttggtttttagttttaaaagtaatttttaactttatgatcgttaatttattcatttgtatcatctatactaattatcacaatcatgtaactattcagtcattcagatattcaacacaaaataattattctgtactccaccagtcctggaatgtaagaacatgtagacattttgtaagagattaaggttgaggtaagagttggttgtgattctttaagacgaataaggttgggttcttaagtctaccttcttaactttgcattcctggttgttcacatgcacgttttccaaactgctaaacggtagttttttaa

SEQ ID NO: 41631 - DNA, 194 bp, Oryza sativa
gaaaatatgcagatcataatgttggctgacaatactaaatattttccacagttttctataacacctgagatgcaggagaagattgatgagttccttttgagggtgaaacttttgagctctttgcaaaatagagcccccatcccaatgcccattcaaatagctgctcttttcaatccgctcctttccctaaaagg

SEQ ID NO: 41632 - DNA, 1235 bp, Oryza sativa
tgatctcgacgccactgtgatcacagcaaaggtaattatgggcaggacaaaggagtatgcgtgtgagagaatttatattgttcatgctccatgtggtgatctgctgcaagtttggaaaccacaggaggggaatggtaattgggttgatgaaatcactggctttccagctcttgtgagcaacactcagaacacaagaatatttagagttgacactgtggctaaaaagctggtgcaaatatttagcttggatgaccatgtgttgtttattgggaataaccagtcatcttgtcttggtgtttgtgagtacccacagctgaaggcaaatcatgtgtattttacagatgatttcgagtgcttgtcctccaagagcatgtggggtctccgccttgatattggagtccttaacctggaagataagagcatcgatgaaattgtagcacctcggcttttcctcaagtgtcgagctcctgtgtttctcgtaccgaatcctagcatgatgaattcaactctccacggttagacaaaaggtcccaatatgtttgtgtgtgtttagtagagtgcccgtgcgttgcaacgggaaatgtaaagacaagaaaattaaggaaaagttaaaaaaaattacattatgtaattaattaattaaaatacaaattttcttaaaaatttggatatttttttaagttggtaggtgtataattaaattataattacactctttggaattttattgaagttttcagagcttaattgcaaattttaataatacaaagatagtttcagcatttattcttcagcccgcgaattaaaatttctcgttcattctcttctgggtaaccgaaggtgaagtgctatttgatgcggactctgtatgatttgttgtgtgttggacccgggatgttgcggacaaaaataggtgagaacggatgaaaatttcaccggaagattaggtataggtatatagaatgttagattagattagattagattagaggtagataacatataaacgatgaaatcggatagaaatcagacttttttctttttacatacaatcggacctttttcgctctttttttattttagacggacgatggaaacattttcaaatttttgaagtataagtagagatagagattagccattttcgttttcttagagagtattatcacggaaaacatggtagtttattaatctataattaattaagtattagtaaaaaatagattaatatgttt

SEQ ID NO: 41633 - DNA, 1501 bp, Oryza sativa
tgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggcctagctaatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccagatcacccagcccgtggggatcagccacgtcgggagacctccaagctttcatgacaaggcatttccaaagccaacacaggtttaccatatgccgacgagaggggtcccagaccaacaagaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcacaagcaccgacccaggtgtcgggttttccaagtcttttgtaaaactccagttttacccaagttgttactcagattttaagtttgaaggcgaccgtcgatactggcatagggtgcacgaatatcgaggcgcaactggatggttacaaggggacatggtatagcaattaacaatggaaggatcaaatgcaacaagttaggtaggtctgccaatctgccttgcagacggaacaacagattaagtgtaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactacacgcaaaatggggcaactcaacaaacggcgaaaataaagccctattaatgacctctaagcgtgccattggatagatctcgacatttgagaaattttggaatttgaacggagtcaaacggatttacggttggaaagatattgaacttctaagattattggatttttggtctaaaggaaaaggatttaattaaatcccctttttttggaaaagaaaagaaaagaaaaggggagagggagggaatatagacttccctcgggcggctagggcgcggcccgagagaaagggcggctcggccgagcttaa

SEQ ID NO: 41634 - DNA, 1501 bp, Oryza sativa
ggaacctgaggtaagtgagctgcactttgttgatctgagtctagctgcactttgttgatctgagtctaggttgttgcgagatatgagatagtaaataagagtttctatgatcctgttctaagtttgacttgaattccgaatgttttattttccgaaatgataaatttcaaagttcctcatttgatatgagttcctactagagccaaaaaatatccatattgattaagccatatacattttggttacttgtaagtccattgaaatttgtcaaatctttgtgacttctgtagatacttttcatgctctatgatcaagatcatacacccacatatatgcatatgctaaacttctacactgcaagctagcatccattctatctttatttccattataccatcatcaaaataaattcttcatgcttatatgtgctttcttctcctaaaaagaaaatcctttctgaataaaaaagaaaagagaaaaaggagggaaaggcatggttatgaaaataataatcataataaacttatgctctctcaaaatattgagcaagatgttaaaaaaaatgtagccatgccctctctatatttatgaaaggaggatttggagaagaaagtaagcacaaaggagaagaattttctttcttttccacattccatttccaccatatgtcacacacactttgcacaatcttgatcttgagtatgattagtcatctattttagtccaagtttttgacttagtaataaatgtgaatacaagtatgccatgtttgatccctaccaagctccatatatcaaaccttagagtaggattcaaaaaggcaaatttggtgaggaattcatattcaaacactctgagtgatcgagagaatcatttgaggaaacttagatttcttttgaaaaatcatttgaaaacttccaagataaaagttaaataaagattgggtgactagcgctctaattgttgttctgtctctcaaccgctcaagacaaggaaaggcagtgtctcgcgggaattaggtgtaagggtaagccataatgccaaacttatttggtttgagagagagtacacataccttgcatctgtatctttgagatatacagcatagtagcaactcctaatcgacaaccaagtttaaatttttgtgagccctttactcggaacgagcaaaggttcaagcttggggggtttgttgacggtcgttatcgaccagtttcgaccgtcaatattacccaattagtaaatactagctatgtttgcgatgtataattcccgaataaaatatctacttccactatgtactatgctactaacatctatgtagaagaagcacatataaatagagaagaatcgaccaaaaatagatgaacgatcaatcagacgctgtcgagaatcagacttatggatagatgggctgagaactcagatatgacacgatccaataggaccaaaattcactattctggataagagaggagttatgggggctacctgccaaaaa

SEQ ID NO: 41635 - DNA, 842 bp, Oryza sativa
gggagggtgcccaccgtccgccgcagggatgccgggccaccgctacctcttctcctgctggatccggcggaggggagggcaccgtccctgcctgcccccgtgggagggggaggggtaacgacgccccccccagtgggggagggggagcctcccttcccgctggatccggcggaggggaggacgctgcatccgcctgccatcgtgggagggggagtgggaccggcgctgccgccggtgggggaaggggagcggcgccgccacagcagagacgccgcgccgccgctgcctgccctcccgctagatcctgcggaggggagggcgccgcccctgcccgccgcctcccctcctgccgctggccgcagccagccaccgtgggtgggggagggggaacggcgccaccgtggcggaagggagaggcgacggcgtcaccgtgggagggggagggggagcggcgccgccacggcggagggagagaggcgacggcgtctttttgagagagaggggagaaaaaatgattttagggttagggtttagctactgaacttttatataggtttggaacaatctggagcattgatcagatcggacggctgtggctgctcccgcgtcgggccgcgattcccaggccgccacacaattgggtcgtctcatgggccgcatgtatgctccgaacggaataagttaagtttaggtcccttaaggctgttatttctttttaagagcaaggttaataatacagccgacttgttggctataaggttctttatagccttctctcagcctacccatataatagttagctctttacaattaatatagggtccacttgtctctttcacaga

SEQ ID NO: 41636 - DNA, 587 bp, Oryza sativa
tttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttctagaaaatgtattattaattgatttttattgccgaacgaaaatcggggcgttacaaatctcccccccttgcaggaatctcgtcccgagattctgggatggctagaaagaaagccagtgctggtgggcgatctgactgatctgcacattgaactgccacattctgcttcgaactgattgattgactggttgatcaaacctgcatgattgaactggctggattcgacctttctgttcctttgctttgccaaaactggactgattggttctgcttgaactgacccaggccagaactgcggatgctcctggaacttacttatcttggactgaaccgttgatgctagcaatttgataacctgacagttcaccaagttggctagagaagga

SEQ ID NO: 41637 - DNA, 823 bp, Oryza sativa
ttttcctttggaaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttggtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttacaaataaatatgcatgttttactaattacatgggatccgggtattacctatctgctcgcttgtgccatgtttacttgatatctgttctttgtcaaccttgggtaatgaatccactagctcatgttacttatgtgacctagctagaactatatgcttagccatgcttaattaccactagctcagttgatgggataattgcagtattagaccctttagtatcagagtgagctgcgtgctcgagacacccggccatgcttcatggtcgtaattatccaactaaaatgcaactgaatagtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacgcatccaggcaagggtgggcgtga

SEQ ID NO: 41638 - DNA, 524 bp, Oryza sativa
tgtttatatgtgcgtatatatatatatatatatatatatatatatatatatatatatatatatatatatatatatatatatatatatatatatatatatatatatatgtagaatggcaagagacgtcagaataaacttaatattacctctatttttaatatacggtataattgtttacatttaaacattatgattgactattcactttattgaaaaatatataagtaccattttttttgtgaattattttatcattagaggcacaagtacctcgatagccaggaaagaggggtagccgccatgcaggctcgacacctactagcatcatcgtgaaaactatacatggaatcatccaacacaatcgattggccgtagtccgtgagaaattactaaacccatgtataaattaactatagtaaacattaggtgtcgctgaaactgtaatgaaaaaaatttggatcatacactagggacatatatatagttattgattcaaatatctgatatatatattgaaagttaca

SEQ ID NO: 41639 - DNA, 1501 bp, Oryza sativa
tgggaaatgcaatggtgtgggtataatgatcgtgcatacgattgctctgtgtcatgacaatgatattagagtagtatttggtaatttaagcgtggtgtttagattactagatatcgttatttggggttaaatgctacgaatacatcaaggtgggccgctgatggtgacagctcagtacgggtattcctccgcttgtgtatatactcctaagttactttcctggggaggctactcctccgtatttagcccaggttagatggtcatgacggattgttgtaagaaactcggcaatcaggggtggcttctcgaagcaccaggacggtattggaaagagggtattagctaagtaatcatataacttggatgtatatgtataatatgtatctatattagaagtataagaatagattctttctattctcttcccacttagcttagataatttattatgagagtatataattctcttgctgtgtgtcattctaccctatttataatcttaacccctgcttatactttgattattacaagtaatatataaattattagtatagttctctctgttataatcttcccgcaggattaaataaatacgatacccttggaatactgtcacgcccagaaatttagtccaaatttctagactattttgtgtattaaatcactgtccaggaccagccagggtacacaaaacgacaagtaatatacagttccaaacgtaaataaagcgtaaaatacttacaaaagaggcacttagtcctcgcaccgaaacgaaagcagcagcagcggaaaagggcgatcctagcggggcttcatctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaggggatacaaggaggggtttgtggctatttgcataaaggcggttgtaaaacattttattgagcaaaacagtaaaactgttgagtaattaaagtaacattaaatctccactgatcaacgctacaccacgttgaacaggcccaaccaacccacctggactacagtgtattgggtcgatttattaagatgggactaatcacggtgaatctggtcgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggacccttcgcataaccccctctaaccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcagcta

SEQ ID NO: 41640 - DNA, 1501 bp, Oryza sativa
catataaatccggcaccatcgattcgatcattgataacctgatagagaagctaccgatagataagcttcttaaattaggatgttgaatataccagcgatatagacaaataaagcaacagcaaatatgttgtacatcccacatgccaaaaaaaaaagttgaggaatatgcgtctagatttcaactgaaacaataatggtcatatacaagtactatgcagaattgaagattgactttaaattaagacatacagttagaccatactccattagttgggagagtgtctgacgtcgccaggtgagccgttcgtataggctgcaaccaccagacctggagagcaaagagatctggtcaaccgttcatcagttgaaggcgcacgctcacagttagcaccaccgttattgcgacaaacaaaaacactccgaaagaaacccctgcagcgtcaagcgcttcagccggcaacataggccttgtttagttcgcgaaaatttttttttcttttgtcacatcgaacgtttgaccgaatgtcgaaagaggttttcggacacgaatgaaaaactaatttcataactcgcctggaaaccgcgagacgaatttattaaacataattaatccgtcattaacacatatgggttactgtagcacttatatctaatcatggattaattaggctcaaaagattcgtctcgtgattttcatacaaagtatcatgatttttatacaaactgtgcaattagttttttattttatctatatttaatgctctatacatatatccaaagatttgatatgacattttttaggaaaaatattttggaacctaaacaagaccatagccattatagtggagtagtatacgtatagtttaagctaagcgccgtccgctgacggcgcgcgcagccgcaggcgccgcggaaaaaaaaaggcagagcagcagcaaagcataacatcgtcgcgttgcctgagccacaagccatcaatcacggtccacatccaagcatccgacgcagctgcagctacagaggctaaacgagacccaacatgcagcgatgccaccaccaccactaaacaaatactccacggaatatttcaccgcgtcatgtgccggtgcgtgcccgggtggtggccgcactctcaagccaggtctctgcgaaaactcgtactacacatgcaagtatccaacctgcaggttcagctcaactccaagcagctcggcgctttcggccggcctgcacagagaaaggcagccgccgacgacgagccgcctgcgtcaaaaaacgcttgccgacagcagcaagaaaggtctgacgctgcacccgccgtgacatgtctcttttgccgagagaagagcactcacccaactacatatacatcctcctaccaaaaataggttcattttcatatgtaaatctagacatagattcatcaattcctgttactactacgtacaccctccgtctaaaaataaaaaaaaatccattttatactgattcacatgtataa

SEQ ID NO: 41641 - DNA, 1501 bp, Oryza sativa
aaataagtaaattgtagtttggctcgtatatttttacccttgtttctgatagcttacccatattttatactttggaccgtgtaactttactatttactatgtgtttcactcaagaccacatcctcatattttccaaatctggtaacacatcatggcatcacccatgcacctacaccattgcgtgtgtgctctctctcgcgtgcacacattgccatcaccaagcatgactatcggtgttgtgcagcccaatcaatgtgtaacttggatctaaccgagagaggagagtggtgatggtggcaacctgatctacaagggagcaggagtagggcagcagcgagcgtccccagtcccaatgggcgatggtttgtgtcctgatttggaggacggagtagagatagtggttcattatatcgggcgccctatttggagataggagcatcaacgtatgggattagcaacattggaggggttttagctcgagtgttggcataccagaggtgctagtgatgaaccttgggctaggcaatagggcaagcaatgttgagctccttgccatatctgcacaagaacaagtagtgggctgactcctaatgtcgcactacacatatattcccttgtgttcacctctttcttcttctatggatggaccaaatagccatggtagaaactcaagcaataactcaactcagtaccctattcgaagctactatgttttggtaagattagatggtattattaagtgaaaaatttataaattcttatttcatcgtgtaactagggtaatataaagtgatggaagatgaaatttactcaatttttagagtaaattttactttggaccacctttttattactggtgtttcgctttggaccaccctttaaccggtgttttcactttcaaccaggtaatcttacctttgttatactttggactactctaactcttatctcaagcatatgaatgatttcaagtacgccggctcaaattcatcagtaaacccacaccgctttatatagacaatttatttgaaatacgacaagtttgatgtaaatagaaaaagaagttaagggtggtccaaaataacataaatgcaaaattacccggatcaaagtaaaaacattagttaaaatgtggtccaaaacaaaacaccagtagtaataaaaggtgaccaaagtgaaaattactctatttgttactatccaaccaaccactttctcatcaataattcaaatcattgtaaaaaaaaatgcaataataaggaaaaagaaggaccctcatcaaacaaaaaggaaaaagaggaagagaaatgagaaaaaaaaggggcaataatcacctaatggttgatcgcgatccaacggctgcggagaacccagcgtgagccataaatcatccacccccgcgccgttgtccgcctcccctcgctcccctaaaaccctaaccccccttccgccgccgcccccaaacctcaacccgccgccgccgccgacgccgccggcgaga

SEQ ID NO: 41642 - DNA, 1501 bp, Oryza sativa
tcaaaagttagttttatacatgatataaaaatgtttcaacaatattaagtatttgcaaatatactgcatttttcatatgatttttttatgtctcactcgttgggactcaatgcttcatacaatgattgctagtattgcagtcaatatattcaaaatgttgcattttttttgaaacatttttattgagtaagctggaacatttaacgaagtggtgaaacaaatttttataaatggttaaacaacgttcaatttttcttatcaaaatataattctatgagatattattataaagatttaattacaatgagtataatggtcaaattggattattagcctcataggatggctgtttgaggtgaggcttttcagcgaaagcccatcgcctcgctgattaggctgagagctttcagccagatatacatggatatacaagagctaaaagctaggagctacaaccaccagtcgtagaaattcttcttcgaaccatttaagcaaaacaaaccaaccgatggattttctttggctgaattgaagaaggcaactttggctgatcagccaaaacatttaactttccgatgagaacctataaattagataattaatttagaagaaaatttcacttaaagacctaagaaatagcttaagataagcatataaaatgggcttaagccatatatgaatttatgcacatccatatagcgtcttgcgtgtgttagatagccaaccagagaaaaagattagagggagtaccgccagcatcagggaatgaagcacccgattttttatttttatttaaaaaatcagacgcctgatttgtagttacttccttaagcatgttttgtagttacttccttaagcatggctggttctgttttgcaatcacatgataccaattgccaaaccaaaatttcgcaacattcaaatctatgctgaccataaaatataacaattagcaatttagcatagggattagcatagacgttcataaatggtcgaaaatgtttccaatttggaagcacagcagctttcctgctatgttctctttcagctatcaatacaaaacttatggttaatatagtcacctactctctttacacggcaaaattatttctatatgtgatgcaatatttttcatgattatttacataatggccacagccagcatcacagatatcagcggtcaggtctccacaattccaacatccgcagcaacagctagaggattcgcccatgtcacgattaacagcaaccgatgccactgcactgatgccttctaacacaatcgaatatacaactaacccagttcccaggcttccgaaaaagatgtgcacataaacacttattgaactgtgtgacaccttcaggaagatccaacgactattcctcttgacaatgaaccatgcaatctgtcgtgcccatgtcataaatcgggcaggatagatcacactagccttgccatttagcaccctgtgtttgttatccgattaatttgtcagttagg

SEQ ID NO: 41643 - DNA, 1501 bp, Oryza sativa; identical to SEQ ID NO: 39984

SEQ ID NO: 41644 - DNA, 1501 bp, Oryza sativa
atggtagtgtggacaagaatgcagaggctgaaggcggtgaagtggaggatgaagatagtattgcagctcctaggcctaaaagatcgaagagactgatgaagaacttgaacgaggacaaggaaccagaacaggaaccaacgactgatggtgacaatccggcagaagcagctgagaataacatatctcctgacgataatgatacagaagaggcaaaagatcggactccttcagcctaactgacaaattaatcggataacaaacacagggtgctaaatggcaaggctagtgtgatctatcctgcccgatttatgacatgggcacgacagattgcatggttcattgtcaagaggaatagtcgttggatcttcctgaaggtgtcacacagttcaataagtgtttatgtgcacatctttttcggaagcctgggaactgggttagttgtatattcgattgtgttagaaggcatcagtgcagtggcatcggttgctgttaatcgtgacatgggcgaatcctctagctgttgctgcggatgttggaattgtggagacctgaccgctgatatctgtgatgctggctgtggccattatgtaaataatcatgaaaaatattgcatcacatatagaaataattttgccgtgtaaagagagtaggtgactatattaaccataagttttgtattgatagctgaaagagaacatagcaggaaagctgctgtgcttccaaattggaaacattttcgaccatttatgaacgtctatgctaatccctatgctaaattgctaattgttatattttatggtcagcatagatttgaatgttgcgaaattttggtttggcaattggtatcatgtgattgcaaaacagaaccagccatgcttaaggaagtaactacaaaacatgcttaaggaagtaactacaaatcaggcgtctgattttttaaataaaaataaaaaatcgggtgcttcattccctgatgctggcggtactccctctaatctttttctctggttggctatctaacacacgcaagacgctatatggatgtgcataaattcatatatggcttaagcccattttatatgcttatcttaagctatttcttaggtctttaagtgaaattttcttctaaattaattatctaatttataggttctcatcggaaagttaaatgttttggctgatcagccaaagttgccttcttcaattcagccaaagaaaatccatcggttggtttgttttgcttaaatggttcgaagaagaatttctacgactggtggttgtagctcctagcttttagctcttgtatatccatgtatatctggctgaaagctctcagcctaatcagcgaggcgatgggctttcgctgaaaagcctcacctcaaacagccatcctatgaggctaataatccaatttgaccattatactcattgtaattaaatctttataataatatctcatagaattatattttgataagaaaaattgaacgttgtttaacca

SEQ ID NO: 41645 - DNA, 1501 bp, Oryza sativa; identical to SEQ ID NO: 31716

SEQ ID NO: 41646 - DNA, 1501 bp, Oryza sativa; identical to SEQ ID NO: 31712

SEQ ID NO: 41647 - DNA, 189 bp, Oryza sativa
tgctctatgatttaacaatgtggtgctacagtaaatatttgctaatgacgaattaattaggcttaataaattcgtctcgcagtttactaacggattctcgcggtttgattagccctaagtgctatagtaacccatatgtgctaatgacggattaattagacttaataaatctgtttcacggtttccaga

SEQ ID NO: 41648 - DNA, 1415 bp, Oryza sativa
  unsure (1)..(1415): unsure at all n locations
tgctctatgatttaacaatgtggtgctacagtaaatatttgctaatgacgaattaattaggcttaataaattcgtctcgcagtttactaacggattctcgcggtttgattagccctaagtgctatagtaacccatatgtgctaatgacggattaattagacttaataaatctgtttcacggtttccagacaagtttgaaattagttttttcattcgtatctgaaaaccccttccgacatctggtcactactggagaaaccatctttgcttggttgaccaaaaactacactagtctcggtagagaaggcggagacgttggcgagcggcgggagctcaacggcggcggcgacatcctgtcggcgacggagcacttcaacgatgcgtactccatcggcaaggggagcttcgggaccgtgtacagcgccgacctcggcggcgggcgcaccgacctcggcatgaagcggctagacgcatcagagaccggcgacgcgtgctgcggtannnnnnnnnnnnnnnnnnnnnnnnnnngaacgtcggcaccgaggggatgcgacgcatcggtgtgaacgagaagccaaacgctgtgttgctgctgttgggcgtgccgagggcgataaaaagcatcgtgttgctgtcgaagaagatcatagaaagagaggaagaagaacagagaaagagagatagacaagtggacccatgggcaaacttgtctttaaccaaagtttctctccccgttttcattgaaaaataataaaataatagaagaagtgtctagcagctaattaccactttttacagtatccatgagcaaatacacgatcttcgggtgtctcacagcaaagaccacaatctttgagtgtcctgtaccaaattttgcctaaataaataagttctgaatgactatatacctattaatgaataaaaatatattttattatacaattgattgctcggttcacaccatcatattcaccgattattaatactaactgtccattaaacttcctataaactctcttaagttgtcacgtggcatcctcacaaacgctcttaggctgccatgtgacgctctaataaattatagaaaattctaaaaaaacaaaatatctaacccttaatattcacttaaattagtgtgtccaatattacataactactattaggagtgtattcgagcgctaaacatacatcagcccaggcccaccccaccccacgtaccgtcatcccacttctaccgttgtcggagtaaacaatttactcctatcgggcgcctctacctcccatctttactcgagtaaacgatttacttcaataataaaaacaactttctgcttccgatcccacaccacgtccatatcgtgctcccaccattatcggagtaaatgatttacttcgataaaaacaacttctctgct

SEQ ID NO: 41649 - DNA, 1501 bp, Oryza sativa
atttccatcaacacaataaccaagcagctcaacaacatgttcatgcttaagcctcgacaccatagatacctgtggatgcattttgaaatgagttgcaagaaaaagaaaacttgttgcagaattcctaacagagataaaaaaaaacctgtgccaaaaattcttggtctggctgcttactagagtctagctttttgaccgctgcacttctaccatttcttagaacaccaaaatacactctgccaaaggaaccttcaccaatcaaagcttcatcaccaaaattcttagtcacttccctaatttcatcaacaggaatgatggggactgcaattggttgcactttcacaggttgaggacctcttggagttggatcagctgtgcgatatgcatcgctccctgcagacaaattgcagttcagtaaaacttgagcaccatctgtaaaccacagtatgtaatgggacaatgcagatgattataacaaaaggcccagtgccattacttgctggatggttccctgggtatggattcctgttgtctggtactccttgagtatcttcatcaccacagcatgcaaagcacgacatattctactagaaacaaaccctggaacagaatcatgcagatttttattagaaaccagcaacatgcatttagtttacagaaaagtagcatcagacagacggtcaaagagagagaaattgaatgagcacaaattgaaaaacacaagcagaagtgcaaacacaaatacaccaccataagacattcaaacagacacatgattgaactagttaatactatgtagatggacaaataacctgatgaaagtgtggagataataggaaagtgaatgaaataaattaacttcgaaaactcagggttcacacttaccttgcagagagtggaatgcatagaacatgacatatgtggaataaataaaggaggtgctaaaagatctatcagtaatttctccacaagccattttgttcccatcatttccttattctttttatgtaactttttgtgcattttctcaacccaaccaggacaatcaaatgaattatgtccacaaatgcccgatgaactacttgaaggtaccacgtatcaatgcatggtgaatggtataatggtagtgctgagctactaaaaccacatatgagttatctcatttgtctcttcttcccagtattatcggaaacggacaagcgagttggctcatgtgtgtgatttcggaaagagaaacggcatgcaagatactactcagaagacgacaaggttgctgaatccgagtacgttttagatttggggtgctcaattcggcaaaaaacaattggccacatttttcaggtaacactgcttctttcaccagacaaacttaaccactacaattcttgatcagcacggcaagttcactggaaccaaatatactgatatgctggaaacaaactaagcaaaggatgcccaggtaggattgaaatctgcctaaggccagaactaataaccacct

SEQ ID NO: 41650 - DNA, 1501 bp, Oryza sativa
agacgccgccacctgatggtccgcgagcggcccgatgatgtcagtcagaggaagagcctacgcttaatcaagtcttaaggtgatctcgaaaggaaaatgcgggatgcctatcgagtacacttacgttgatagcgtcattgcgttcggctgcccccttctcacaaaggggcacggggatgtcactcgccgttgtcagaccactgatcatcacctggtcgacgcggcgctccatggtttcgctgttcaaacctgtgaatcgagaaccaaacttcgataaatcaagaggaacgcgaacgtacacatgtcaagaaaaatgcgagaaagataccccgaggagaaacccgggtcgcgtcctccggtccggaatagttaaaggctggatgggcccgagcttggaacggctggatccgcctaccaacgaagtctgcaatgacttcataccccgacaagccccgtactcggaagtcgtcgatgatgtcgataaacgactgaagagagggggtcaaggggggctttgcggtccaagacgaaatcttgtcaggttgttctttgggaacaacgaagacagggtctgaatctttgatctcaagatagagccacctattccgccatttgctgtgagaagaagggcactggaaggggatataacgcgacttcaggccatcccgaagtcagaacccgacgcaaccagataccctgttggactccatccaacgcagctcgtagtagaagcgaaagagatcaagaaaaggctctacaccaatgtaggcctcgcaaagatgagcaaagatgctaagaaaagcgatagaattggggttcaaatgaagaagagaaagaccatagaagttcaaaactaggagaaggaattcggaaggcggagggagaaaaccgcagagaatatagtcttcgatcgcaaccatgcgacctaagacgggctggggattagtacctcctgcttccctctccatggttccacgaccgggaagggcgccgtcttcctgaagcttcttcagcgacgcactggtggaagatgatttcctgaggtccatcgctaatcgaagatcgccggagaaagggcctaggttgatgaactagggtttcttgtggcggtgaagaaggcgaagagcgcttacaggtggaatattttctgcacggtgggcggacttcaaaatggatccccaacattcctttaaataggcgcactaccaacggtgcgaattccaaggaacagagagagatgcctgccggaaatttctgggtccgttacgcgcggcggttttttggacttagtttaaaattcgctcgtgaccgttgggcttcaaatggcgtgctcgactacggcctgtctccgcggtcctcgcactaggaacgacaacagtctcgacacccgaagtcgcgaatggttacacgagttcattttaagcagaagtcgggggctacatgcatcagggctacgggttaggcataccctttaccctttaatatacgttacatatcggta

SEQ ID NO: 41651 - DNA, 791 bp, Oryza sativa
gcttcttcaggctggtgagaaaagagacaagcaactgaaggagctgaaggatcaggtgggcatgaagcaacccagtgtcccataccgtgatgacaagcacaacttctgggagaaccagagcttcaagttcatcgcctccatgtcaatgctcgcactagtgatgctcacaaagcgatgaaacagcatcctgtgtaaagaatgctacttagtagtatattccagtgttaggtgagcaccttgctcatagtctatagttcaggaagccagagatgtagtcaagtaggtcattgctgcatgatcagtcgtcagatgatgccccaactgaatttgccgacatccaagattagtctgtagtattgtagtactgtagtgcagttgctgctagcttatgtaagctcataattaagcaatattgtagttacagatctaccttaatttatgtctggccgcgttgcggttatgttaatgctggcatggttcgcttgttctaatctttagcattttcagttgattgagctagttcctgattctgaactctgaaaatttcagaggttcagtatgcaaacaggacgcacttgttctgaacaaccgtgccaaggcccaaatctgcaatgctgaggtaatgggaagaaaatatggacaaatttgggggcatttcttctgcacaaagatcaatcaaatgcagaacaagagaaggcaagttcagttcagttcagttcagttcaagatgcagaattttgttttccctcttgagtaaggtagatagatatgcatgtcaccttcagacaagt

SEQ ID NO: 41652 - DNA, 155 bp, Oryza sativa
tgtggattcatggcgatgagaaattttactctctattttacatctttcagactccactttatattgtctccgcaaaccaattaccaatgttgatgctggttttgacgctctaatgagtcccttttgcaattcagatgcacttcctcaataactat

SEQ ID NO: 41653 - DNA, 1501 bp, Oryza sativa
atttgagaataataatccactgtgataaaaaatagatccgatgatttaaataatggatctatcagtttaagtaaatatataaattagttaatatagatcttaaatttaaaataattaatttaaattactttgtgtaaactttattttaaaatagtgcataatttgaaaataatagtacaaacaccgatttaagtggaaattattttacattattagttaaatgggtaacatataatgtgtaaattttattttcaaaaattgtagagctaatttagttagctgcgagttctatgatggtagactctttgtttgtgaaattatgattatttaaaagaaatatatccattatatattaaaaaagaagaaaaaaggaaaaaaaagggaaggaagcatacgtaccatacacgtttgcctacatatgtgcgggagaaggaggaaagtatatgtgtgggagaaggaggagaggtgggaccccatagtatttggtttgttttaggattaattttatctaacggtgtataatattggacccatcaatttaagtgaaaattaagggtagatgttttgcttttttcttagaatttctaggattttctctaatttattaaagcgccatgtggtggcgtgagagcgtttgtaggaagtttaattgactttttgtatattaggaaggaagcccgcgcaaatgcgcgggcaatttatttataaaagattgctaaaagaagtcatacttcacgatattaattataagaaccaattatttattatttataaaaataatgctgaagaaatcctatctcaccatattaattaattataaggaccatagatcaccttatatataattatataaaaataaatgtcgaccataaattttgatataccaaatgacaatagtatctttcatattcaaacagaaataactttgtcccggatatatgtaaactcgcatgttactactatttactatcattgtcttataagttaggtacctttttattaaatggaattacatccataccaagaaaataaacttattatgtcattaatacaacgaaaagatcatctctacttcatatcaaattgttcatgtctcacttgtgtttaaatatatgcataaatattttgaaatattattcctaccaattcatgggataaaaccattaaattagatctaaatgccccgaagctgactgtagccaccaaggctttcttcccttatgccttgaaacatgtgtcccgtatcggcatagccgttctcctcgtggagcacaattttaacatctaattcactatcagctaaagaatcacatcgctaagtaagccagttgaattttattgcgaatagtagcctctcattagggtcacctcaacttagtcatatgcatgcccccgccataagtatagtagcatagcaaactatgttatccatgcttggcgcccttcagggaatgacacatagataagatgaaagtgataaataaaaatttaaaagttttga

SEQ ID NO: 41654 - DNA, 1501 bp, Oryza sativa
ccgaagaagacgcgtaagccctagttggtgctagtttgctgctgcttgcgagaaggagagagtggagtgagtcagtaagatatctgaggtggagggggaaacgaggattttatttatttttatttttggttcgctcgtgatctgcgtgctcgtttcttggagctgagttgcatcgtcggatggaggtaggggattctttggcacttgagtttatctttggttccaaatatgcttactatgattcgattcatgctattttttttggctaatttatgggagaagatcaagagctcggagtttctgggtggtgattttacagtgctctctctgctgtttctctgcttttttttacactcaaatctaaggaatctggagtgtttttgagttatgctgttccccactgtttgaagtattttaaatttgttcgtacttgtacgaaattttcaattttttttttgccttccaaactattcttaacgaaaattagagtgttcacacactctaattaattaatcctcaagtaagaagggtaagagatttatgaggacttacgctccagatttcatactgggaaattctcgacttttgtgctgcattttttttcttctctcggtttcttccccaaaaatttgaatttgtttgaaaattttcggatggacactggacagcctcctttttgtcctcatctctttgtgagctcagtgaaagattccttttcatctggttttgtctcaatccttcttttcagtaaatttttagtcgtagcgtcccgcaagagaagtttttggcattccagaaaagttcttttttattccaacacaagaacagacaccaaaaaaatagctatattgttctaccgcacattttatttttaattgttgcaccatacttaatctctactgttaaacaagttgacttcaagcaccaagaacatgcaaaatttgctgcctggtgcgtgcagttgactaattagatgcgtgatttgatcggcatgaggcagtcacttgtagtgtgaataatattttgtatactttgcttgttttttcctcattgccaatacaataatattatgatgagtactgaaagctacacttctgtcacttagttgccaaatgtctaggctccactcaatctcgtacccttgatccgaagaaagcggatgttttcatatcagtagtttaagcggaacacgttgcatgtagcaagcatcattgtatgttttcatctcctctcaaaattggtattgttttctgcagcgaaagctacctgctggcccatactgacctgagataggaggcttcttgtgaggcaaccacagaggtgtttggcttggtcaaagaagagctcatctcccttgtttttgtctttcttcatgggggtgcttgatgacttgctgtgaggcctgagccgtcctgtttgttgttcttggatagaatataacagtattccagaagcagtgtttttggtgctaatattggaagagaaacagtattttggggct

SEQ ID NO: 41655 - DNA, 876 bp, Oryza sativa
attaaaatagtcttcacccgttgcaacgcacgggtattttgttagtatatgaataaattaaaaagagagttgacagggtggtaaaaaaattattgccaataaaagtttatcgagatttattgaaaaaagagatacaatgaacacccaattaaaaatagaaaacaccttactctaatttcagtttattttgttagaactattttctaaacctagttccatctaaactctggatccgaataggactctgaatcaaacggaatacgattccatcttgtgaatacgaccacgggtcgcgttcgtcgcctccgccgtcggcggcggtggcggaggcttccagcggccaaattttgagaaaacctcttggggcatcgaaatttctgaaatacattgactgattctgcaaaaatcgagggagaatgtagcatgccgacgagcctcgatgaactattaaaagctaaatcctactgaagctagcagactacgatgagctattccttgtctggcaacccaagagacgcatgtcagcaacagcaagtcccttcctgtcaaagagaggacacaacaacttcacagtgcttgatcaaaatctcctcgccattttccttcttgtcatcttccccttcaaccacatactgtgtatgttatactctctccgtttcaaaatatttgataccgttgactttttagtatatgtttgaccgttcgtcttatttaaaaaatttgtaaaatatgtaaaattatatgtgtacatgaaagtatatttaacaatgaatcaaatgatataaaaagaataaataattacttaaattttttgaataagacgaatagtcaaacacgtacttaaaaagtcaacggtatcaaacattttgaaacaga

SEQ ID NO: 41656 - DNA, 1501 bp, Oryza sativa
aaacactgcttctggaatactgttatattctatccaagaacaacaaacaggacggctcaggcctcacagcaagtcatcaagcacccccatgaagaaagacaaaaacaagggagatgagctcttctttgaccaagccaaacacctctgtggttgcctcacaagaagcctcctatctcaggtcagtatgggccagcaggtagctttcgctgcagaaaacaataccaattttgagaggagatgaaaacatacaatgatgcttgctacatgcaacgtgttccgcttaaactactgatatgaaaacatccgctttcttcggatcaagggtacgagattgagtggagcctagacatttggcaactaagtgacagaagtgtagctttcagtactcatcataatattattgtattggcaatgaggaaaaaacaagcaaagtatacaaaatattattcacactacaagtgactgcctcatgccgatcaaatcacgcatctaattagtcaactgcacgcaccaggcagcaaattttgcatgttcttggtgcttgaagtcaacttgtttaacagtagagattaagtatggtgcaacaattaaaaataaaatgtgcggtagaacaatatagctatttttttggtgtctgttcttgtgttggaataaaaaagaacttttctggaatgccaaaaacttctcttgcgggacgctacgactaaaaatttactgaaaagaaggattgagacaaaaccagatgaaaaggaatctttcactgagctcacaaagagatgaggacaaaaaggaggctgtccagtgtccatccgaaaattttcaaacaaattcaaatttttggggaagaaaccgagagaagaaaaaaaatgcagcacaaaagtcgagaatttcccagtatgaaatctggagcgtaagtcctcataaatctcttacccttcttacttgaggattaattaattagagtgtgtgaacactctaattttcgttaagaatagtttggaaggcaaaaaaaaaattgaaaatttcgtacaagtacgaacaaatttaaaatacttcaaacagtggggaacagcataactcaaaaacactccagattccttagatttgagtgtaaaaaaaagcagagaaacagcagagagagcactgtaaaatcaccacccagaaactccgagctcttgatcttctcccataaattagccaaaaaaaatagcatgaatcgaatcatagtaagcatatttggaaccaaagataaactcaagtgccaaagaatcccctacctccatccgacgatgcaactcagctccaagaaacgagcacgcagatcacgagcgaaccaaaaataaaaataaataaaatcctcgtttccccctccacctcagatatcttactgactcactccactctctccttctcgcaagcagcagcaaactagcaccaactagggcttacgcgtcttcttcgggaagcgacagcagcggcgccggaatccgctcggggcggg

SEQ ID NO: 41657 - DNA, 1501 bp, Oryza sativa
cagcttcaaggaaatccaggagtaactctatggagatgttgccaatatgactctcatgtttaaaatgactccctatattattttcataatggttttcactgaagtgaagcccacatgatatcctaatcaccaaaaaaccggagaaaggagagaaggaggatatgacatatgagtcccactctactttttaatttccgagatgattggaatgagtgaaaactgactaaaaacaaccgagagagtcgttttgaatggctttaatagttgaaggggtagatatacctggtttttcagttgaaggatatgaattaaatccaacctacaccctctatctttactattataaaaatgaaagatgtttttaccggtattttggtacgtcatccgtgtttaagtcggtttttaagtttgttcgcttttggaaacacatatccgtgtttgagtcaaattttaaattcgtttgattttaaaaatacaaaatgaatcgtataagaaatctctttaaaaaaactcgcatgctaacttaagatgaatatcggactcctaattgcagcttatggttttccaaaaagtatatccaaacgaatttcaccctagctaaaccgtataataataataatattaaaatagccttgatccgtcagaactcacgaacatttactttctagtcttataaaaaaaatcaatttctagatgaacctaaacaagcatgtatccaagttcatcccccaaaagttatctatttttaggatagagggagtgcaataagtaggaacttaggcccttcacagtgctccaccctggagcgttccttcgtcccaccacgtagacttcgtgatgtcatggaggagagaatgtgtgggcccgagttcctccgcatgattgctcggttccttggtgagcaacgagttcctcataaaaaagcctgcaaaaaggtctgaagcatgcacaaaaccatcggaaagaggcgaggaagagcatgaggaggagaacgggaagagtctgggtcacgcgtctggctcgccacttccccaccgccgaggccgccgcgctcgcctacgacgacgccacaagccaccaccgccgccgcgctcgcctacgacagtgtcgcgagcgcagcggcgcacgacgacgctgcaagccgccgtcgtcgcgtcccacccggtgatcgtcgggctcgccagggaggtcgccggcgagtgccgtgggctgccactcacgctcatcaccatcagcatggaggaggagaacgccggcatgctgtaggaccgagatgtcgactagaggagggtgaataggcgatttaaaaactaaatgacacctaatcaaaactaacctaagttgctaggctcggtgagggttaagtctaactaagcaactaagttatgttttgcaaacctagggtgatagtggctcaattaattctctaggaaagtaaattacactcctatgtcaatgttttgcaatcctagggtgatatgatctcaagaaagtctctagg

SEQ ID NO: 41658 - DNA, 1501 bp, Oryza sativa
atttaccccgttctaaatcgttatggcaaaattcccactataaaattgaaaagaaaaaaaactaccaacagaactatcattcaaatagtattcttacaaaataagaaaatccagtggcaaatttgtaaatgccactatacttgtgaaaacataagaataggaaaaacgtaggaagagtgtcatgcccattgattttctataggaattaagaacacgtggaagttcaaaaattattgttttggatggtacatagaaaaaacagaggaaccttgtggctgtgccatggaagagataaacatgcggtagaaccttatgctagattgccctccaaattcctatgaaaatagtccattactgaatttcaaaataatctgagagagctattcctttattccaaaagactacatagaaatttttccatatgaatcaaatcctccacaatttccgtagttctctttgttccaaaagagttcacgatcatggcatcatatttgttcaaaggttaattcagttgcagaaaaatatttaggtataattttacaattcaactaattacattcccatctgttccaataggattgggagataaagttatgatttagtttctttctatgccggttttcatgatgggctgggtctttggagcttttattggaagctaggggatcgacatagcaggattttgtttttgggaaggatggatgaagacaattgcgcttttaaagtagctaagatataaaaagtggtttattagatcacatgtttcataagcccgagtgaccatttatttatttgaaatttagttacattaatattcgcttaatattttgaaagttaaaactttcctttttaaagtgttcattatatgtaaccataataatcacatctgcctaaaaaaaaccaaatatatttcttcgttgccttttacttagaatgtcttatcttaccaattatacactcaccatattacaactaatgaaaacacgataacttatagtagcactataccctattcatcaaccatatgcatagcaatactagcaagcatacatgtctatccactgaacattccgtgaaactctattttgaatctaaattaaaaacttgattttatttccgctcacctaagtaaagcacaaattcacaacacgttatgaaagaggtcaactatatttcacctaaatccgcaaatccaggcaaccgttgcgtagacttgaaattcagttgcactattcagcgccggacttttcggaagtaacaacttttctactatttctacattacgatttacctgtaatttaaacttcaataacaaacagatcagacaaaacctaaatcatcttaaaccaattacatgcataccacattacaaccaaaacaggtgtatttccagccacactataccgttgtacatcctcagctgtgcatgtaacaatattagcaataataacgatataaacacacacaactcaggggagggagggcatttccgctttgtcca

SEQ ID NO: 41659 - DNA, 1501 bp, Oryza sativa
tatgaatagatttgtcttgaaaaatactttcataaaaatatacatatattatttttaataaatatttttatagaaacaagaagtcaaagttgtattttgtaaatcgtatcactgtccaaaatgacttcctttacgagtatggagggagtatactataaagttttcatacgaaatgtacagtttaaccgtttggatagcgtggtgacgaaagatgaggtgaaatttgtatctttatataccaacagcaaggacagtcattgggacagtttgaggcccatggcacattgctttttcctaatttcggaaccaaatcaatcaggaacatgtgggaaacgtacaaagatgggacgctggaatccaaaagaaaacgtaaccgaggcaaatcccgtccttccttcccgtggccttctagaaggcagcccagccctgcactgcacagctgcacatgccgtttgcctaaccctcgtatccttctagaaggagatcaggaggaggaatcaaatcagctggcacctgtcagtatcataaagcctgctgttttcctctgcaattatgcatgcatatccatctaataaaggggttgtacaattaatagacacagtgttccggctggtcggctgatgccttccgagagcaagtacaatagcagactataaactagctataaacagatatctaagacacaatatgcatatgatagatgagaacatacattaatagtataatatatgtttataggtaactattctataaattagctattaagttgactatagatgatttagagctagtagttggctatactattaaacttacttcgaagaatatttatcatatcgaaatgaagagtaattgtttgcaatttaattaataaattataagttatccatttgtcttttctaaaatataaagtagttatattttaaaacagattgagtacataataatgagtggattgtaaattcacgcagcacgagggaagaggggacgaacagttctctaaatttgaagagtactagtaaagataatgatcaaataaacactataatttcacaaagttcatagtaagagtttgttcatttactctcctctgaaatgtggcaaacattttacctatggactatatggcaaacattattctgctgtacgtgttctaattttttaacccaactgatcagacgagaataatacatagcttttccaccgaacaatggttgaccaatatattgatattaacgacctgctcgaaatataatttgacagcgataagcacacgtgatggtaactccagtgtttatgggtgtcactatgtcagagcttactaaatgcaagattagatggagccgataacaaatggtgcatgtagaagggatacttcgaagtatatagagcattggagcacacttttcacatcccttcttctaaagctgcatctcattaccaaaaagaaaaactgtatctcattttgaatttcaaaataaatttaggcaggctttccttc

SEQ ID NO: 41660 - DNA, 1501 bp, Oryza sativa
atatttaataatcttcgcgattaagatcatgttgtgttgaagtatgtcatacacatctttcttcatcaactaagattcaattgattgctacgtatagaactcaatgtgtttccgaaggtaagaagttgctttataatcccttaattagcttaagatttagcttaagcttcaactatagcttaacatttcggttggactgataaaaatcccataaagggtttttaagcaaatttcatatgcatataccacatgcacgccctcacactcatatagatgtaccctaacaaatttatacaggattggagatcaaatctcacatagcatgtctatcccattacatagctaaataatattagttggggcctaaccttatgtaaactaggcatgcatattggtcatgaagaaattggggataggcaggaaagtacttctcttcccgtctagccttaaggtgaagtgaaatcaagatgtgtcaataaaacacttgtcgtcattgtaccagtaaaaatgtattttagttcgctaggattgggtcagcttatatagccttaggaggtacacatgaagttacaataatgcccttcaaaagcttagaaccctaagggtgtatccatacgttcggacgattcctaggaccactagcgccaacttgcaagtgaagttggagtgatatcccgacatctttttgtgcgaatattcctgcttggtagcataaaagcttatgtttttacctgccaaaagcttggtaacagtgcttgaaaagcttctgtttcattctccttgtaccatttacctcccgtagcacgctcgaatactactcatccaaccaatgtgttcttgctcggatagttcgatcttcttctagttacatgttaggaactcaagaagtatttacctccatttaaaacatgctttaggaaaatactagaggtggcgtattggttgaataagagatatgacacttagtccttgctataaatcgggatacaataacaagtataatgcaagcatccatgccaggtttaggacccaaatctaaataactatgcatgtttcaccacaagaatcctagtcaataccacagttcctcctataaaattattaaagaaaagcaaaacacaaaactaaagaacacctatataaaaaaaacctacaatgaagccaagtaaatatatcaagccaagcaagtttttgttataccaaacagaaaggttggatgacatgcttgtagaggttactcaatctactgcaagaaaggattgctatgcgtgcctatgagaggtggggtcaggctgtcagtgactagatgaggggtttggtacatgttgttgcatgggtgcagcgtgatcacgtgctccggaggttggtttagctagctagctgcatccacaagtcaaagcctctctcaccttcgatcggctgctccaaacgaagagaaaatatcacggtagtgtcggtacaaaaaaaaaccacaacccctaaacctagaccttcccattcc

SEQ ID NO: 41661 - DNA, 1501 bp, Oryza sativa
acatcggacccgatacgatacaatgacgacccagttctatccgagtaggactccttccatctgtgaactccataatgaatttccttaacgtatgccgaaaacgtccgtatacgcgcaagtataccatatcaatatgtgacgtatatcgaagggtaaagggtataccttacccgtaaccctgacagtagcccccgacttctgcttatatgaactcgtgaaaccgatcgcgacttctgatgtcgaagttgtcgtcgttctcggtgtgaggactgagagacaaggagtgatcgacaacgccaggtgaagctcaacggtcatgagtgaatttaaattgaagtccgaaaaactgccgcgcgtaacggacccagaaatttccgacggccatctctctcctttccttggaattcgcaccgtcggaagtgcgtctatttaagggagttttggggatccaatttgaagtccgcctgttgtgaaaaaactctccagcccccaagcgtccctcgtcttctccgctcccgcaaaaaaccctagctagctcatctcggtcctttctccggcgatccccggcggcaatggatctcgacaagtctacctccaccagcacgtcgctaaagaagttgcaggaggatggcgcccttcccggtcgcgggaccgcggagagagaagtaggaggtactgaaccccaacctgtcctaggtcgcatggttgtgatcgaggactttattctctgtggttttcttcctccgccttctgaatttcttctcttggtcttgaatttctacagtctttccttgctccatttgaaccccaattccatcgccttcatgagtatcttttcgcatctttgtgaggcctacattggggtagagccgtttcttgacctcttccgcttttactatgagttgagttggatggaacccaaaaaggtgtctggatgtgtcggtttccgacttcgggatggcctgaagtcgcgatacatcctcttccagtgcccctcatctcgcagcaaatggcgggggaggtggttctatcttcagatagaagattcggatccggtttttattgttcctgaggagcaactagacaagatttcatcttggaccgccaaactcgccttgaccccatccctccaatctttcatcgatatcattgatgacctccgagtacggggattgtcggggtatgaagtcgctgccgacttcattggtaggcggatctagccgctccaggctcgagcccatccagcctttgattattctgggccggaggacgcgacccgggtttctcctcggggtatttttctttttagttaaattggctcccttatgtgcgtgttcttcccgacttatcggattctggtctcgatctacaggcttggacagcgcaaccgtggagcgccgtgtcggccaactgatgatcactggcccgacaacggcgagcaacgtccaagtccccctttgcgagaaaggggcagccgagcgcgacgttgccatcaatgtaa

SEQ ID NO: 41662 - DNA, 1501 bp, Oryza sativa; identical to SEQ ID NO: 31713

SEQ ID NO: 41663 - DNA, 1501 bp, Oryza sativa
acaatcataataaccttattatttaatgaatacagtgcacgcacacattctatatataaacttaattaacatgaaggttgagacttagagaagggatggaaggaagggagattaaaaggaaatatttttttatgtaatcaatttgctgggtcccacattagtagaaatacaattttagatagaaattcaaattttatgaaacggaggtagtaaattaatgtgggaaataaactttccttttaaaatcatggctgagaatattttcctaatattcttcattccctaatatactctataattttccttaaactttcatagtaaaaaacaaaggaataagttcaccggaggtccctcaacttaacagcgagaatttttgaggtcccttaaccacaaaaccagaaatgtttacctctaaactcacacaaaccgtgcactcaagatcctatagcagtatatatggctggtttcgctgacgtggcatcctagtcagaaaaaaaattaaaaaatgtacgtgaggcccacatgtcagttgcacatctcttctcttctagttttattctcctcctcttctctattctcttcttcaggccggcagcaggcggagagccggcgggcaagcgcagatgaaggcgacgggcggagagccgtcgggctgctgtcgccggagctgcatagccggctcctctccgaccaccgcgcgcccttgctctccctcctccgccgccaggatgacgagctccggaccaagatcaagaaccacctcctcgcgctcggatggaccatcgcctccaaagcccagcctccctggcctcgcgcccaggctccgctacgtctccctcgccggaagcatgcatgctatttgtatgtatgtatgtatgtatgtaagctcgctaatggccaggtgattagcgagcttaggaaatgggctcagcaaacaccacctcatcctggaaggcaaccatccatcatcataagaagtcaatactgccctggtccatctcctcgtggaaggcaacctcgcccgcccgcagcacccctgtgtccccatcacctggccgatctgcttaggagcatcgtcaaccaacgcctacgtcggacttccatggcagctagcacagccatcctcggcgccagtacgatgtacgccatcaactcatcatcagacgccagtcgccgacgatgctacctccacggtgccaccacgttgtcaagacgccggatgtcctcgcatgtgcggcagctgcaacaacaagagcacggcgacggcgatggtgcctccgcccctggccacctctgccgcccacggcctgccgactccccccccccccgcgcgccccgcccagcgctcccgccgccgacgacgccctccccttctcttgcgtcaccggccggcgccgccggcatccgaacctctcgtgacccgtggcccgtggctccatgcacgcccgccactccgctgccgtgctcgcccaccgatgctctgcccggcggtgctccaccg

SEQ ID NO: 41664 - DNA, 1501 bp, Oryza sativa
aaaaacatccgtatacgcgcaagtataccatatcgatatgtgacgtatatcaaaaagtagagggtatactttacccgtaaccctgacagaaatgcagagctttcaaaaagaactgctcattcttccaattatatttcttgtatttatttatgcccccgtctcggcaagtgttttatagatgatgcattcacaagtgcgtagactatataacgtgaatatacatttttttgtgtaattgaaaaaaaaagttcccacatctcagtttgaacctcaaacaccggtacaccgtcttgcctttaggtttttgaatttttatgattcttaatcttttaattctaaacataaatcatctctttacttatttctaaacctgaatatttgttgccacgccacttcgtctgtgcgtgacgaaataatattgtcacaccatcaataatcgatttattgatgtgaaaattttgctttgtcatgtcaatatgaatggcttggcaagagaacgttgccacgtgcccacgtcagccagagtgcgtgtggcaaaataacaccgtcacactagccagggtagtgtgatactctctccgtcccataatataagggattttgatattttgcttgcactgtttgatcactcgtcttattcaaaaattttgtgaaaatataaaaaagcgaaaagttgtgcgtaaagtacttcagataataaagtaagtcaaaaaaataattaataattccaaaaaaaatttaatacgacgaatgttcaaacggtgcaagcaaaaagtaagtaaaaaataaataataattccaaaaaatttttaatacgacgagtggtcaaacagtataagcaaaaagtcaaaatcccttatattagaggacggagggagtagtattgttctagatgacatggcaacggtatttcatgacaccactcttgctgacgtggtcgaaagattcagtttaaaaataagttttgttatgatttaggctgtgtttagttccactctaaaattggaagtttaaaaaaattagaacgatatgacggaataattggaagtttgtgggtgtaggaaagttcgatgtgacggaaaagttagaaatttgaaaaaaaaattggaaaacaggacattactttaaaattaaaattttaaaaggttaaaaaaaaatcttggcctccccccctctctctctccactaaaaaagcatgttcgtttgaagctccattgttccactccacggttcaactaaccaccaaattaccagactacccctcggagctcgaggccaagggccgccatggatcgccgggacatggcgagccaccgcggccggagttccactcgtggccacggatggggccgaggctggcgaggtcggggagaaggccgcggccttggtctcagccgcggcgccggcccctcaccgccacctcctccttcctcctccacctcttccttcccggcggcggccagcgccaccgcggctggtaccggcggcgacgccccgccga

SEQ ID NO: 41665 - DNA, 1501 bp, Oryza sativa
cagcagtattctacgactagtacagatcacaataaaaattgtcaaaatataaacgggtctttttgtttactgaagaagatgtagttgatcattccgaccttgtgtcctgaccggcctgaagtgaagtcttgatggatactgttaagttggtcgatcagttaaaatgaaggtcatctagtacaacaaaataatggctttcattgccaatcaatctattgctggcactactacaattcagaacacaattttaccactcaaattactttttactcactattcatttcatttaaacctataaaaatttagtcgaatatcctccaccgtcatcgtgtcgcgatccgcaatctctctgtatggatagaaggaagaatgttttggatcttagctcacagacttttgtgggcaatttcatccctgtgatatcatgggaagtttcatatgttgacaagggagagtgagcagtgttgacctcaatgatcattcaacatttcctgcctgctggaagccaaaatcttgtccaacaagccgtactccatactgcggctacatatacctctgaaattgctgatcaaatcttcaaaaaaaattgcaagttctacacgcgcttgctcgatccgtcgcggccccataatttttcaccggaaaaaaaatggatgaaaatttttaaccatggtaggacaataaggacccctttgcaagtcatatctgaagctctagaacagatgactgaacattttacatgttgtcaattaattaagctggtcggcagcttaatcgattgatctgaggataattaatcttgtcaataactgttttcacctaaaaacaggtagtagaattctctgatctcacctaaaatccatccagggcaaaaggtagaccagaggataattttgtcagaacatgagatgaaagtaaagggagaagaaaagaaagcatggaaactttgtagtgcagcacttgcaattgcaaagcaagcaaaagggacccaagagcagaagctcatgcttcatggtggcacgtaggccaccctcacagccttcactgccgacgcccggcccgggcccaccgcgcagcctcaccggcctcggacacgtgtacatagagctagtaagcaaaataaaaaataaaaaataaaaaaataaagagagatagaagcttgaactacacatcagtacatcacacacagagagacccttggtgcttactacacatcagtagttagctactggctggtttgttttgtctcctcttcttgcctcccccttataaaggaaggtgagcattgcatcttgctccttagtactcctcctcctgcatcatcatcccaatcctcaattcagaattcagaactgccatttgctaccttacataccatacctagctgaattgctgtcagttaatctcttgatcagatcgatcaccctgcagcttcttgttgtttctagcatttctggtgaagaaaccaaatcttcagcagcttaaggtaggagatcatcaa

SEQ ID NO: 41666 - DNA, 220 bp, Oryza sativa
aatcaggcggaggggaggccactgccgccctcgcgtgggccaccgccacgagaggcctcggccgcccagccgcttaccgacagaccagctcgttccactgcctgggggctgcaggtgcaggagagggaggagcggaatcagcgggagggaaggccaccgccgcgcggctggttcgatccgccgccgcaggggccggaggcgcaggagaggtaggaggaga

SEQ ID NO: 41667 - DNA, 388 bp, Oryza sativa
agtttttttaattaatttttggatgctcccaataatttaatctgtaatataatattatataatgccctcttgtccagttgtctgtgcttgtgcttgtccaggcacacagtcttatcctccttgcccactttaatctctttgctagattagctaattatcctcagccacattatttctgggctctgatcaatttcccaaaattgcccaccaaaaaggtctcaacttgctagcttctgctaattatcaacagccacatatatcatttcagtgctctgatttcccaaattatactttcctaaaatgtctcaacttgtggttaaacaagcatgtgatggtgccattgaggggtagattagtcatttgaaagagatttcagcccacaagatca

SEQ ID NO: 41668 - DNA, 288 bp, Oryza sativa
atataagacaaccgcacgggataaaaggattatcccgtgcggttgtcttaagcggaccgcacgggataatagattatcccgtgcggcccacagcctggcgccgagatcgcctggttccaggcggagccacttacggcccgcttggaacctaaaggggtcggcgtccaagaaaatcacatgtctagtagtgttgatggcctccggtggagcaaggccaacttacttgctgctttctggcacggcaagcacgatgcggtgatccgttgacgtgtgcccaacatcttcagc

SEQ ID NO: 41669 - DNA, 1501 bp, Oryza sativa
gtcggtctcccctccgccgacgaggaggccggggtcaccggatccgacggtcccggcctcctcgttggcggatgcatcgaccggagcgagaggaggatggcgacgacagtacgatggtgcggcgacagcagtggctcgcgtgaggaggcgaggcggcggactccctcgcctgggcatggagagagcagagcgagggaaggagaggaggtggtgggaagtggcggctagggtttgggtggggtggggggttttgggttgtatttttttcataaaaggccctcactttctgttattcagaccgtgctcctctttttcgatttttctcttctttgcatagaatattgcagtttgtagaggccctgtacataagaacgcagaacacagtacaaactaaagagcatatacctaaaacaaattatcaataaaatgaagggcctttttgcaaaaatagaagggccgatgcgagagctcgcgaaatcctaccgttttccagctcgggctgacgtgtcgcgacgcggcaaggtccacgacagcgcaaaacgctgagggcgcagcatttcccagctggttggaagactttagattgttctggtctgattgacccaatatttattagtagacgtttacatgaagaggtaaattggaccggtaggtgtgcttctgatccacgtgcagcatgatgcatatgaaaattaacaactttcctcggttacatatacttaccgttttgaatataaccttttctttcaaattctgaattatcatactccctttgctacgtattttatttatgacgttggttagttaaaaataaactaaccaatgtcatatagatatgtagtatctttccataaaaaaagaaaatcaaattctaactacgaatctagacatttgcgtgtccagattcataggatttgcttttttctaggacggaatactagatgtttcaaaataaagtgagtattattttaggttgtctaaagctaaaatccttcgagtgtaagcagtactaaatatgtaaagtgtgaccagcaatcggtttttctttgcttcccagatcctattaattgtctcttttaaattttatactagtaagtaaaaactaagcaagcgagtttttatccaggtagttaaattgtatgtttacatccctatatatggtaccattaacgtgggttgcatggatatagtgtcaatctcttctcagggttatcggtgttatctcatatttttttcctttgagtatgatgtactcctcttcttgcatatattcctcctgctggccttttttttttccttaaacaaaaatgaatgcaaaaaaaagtcttgaaaaatagttttattatgtcgttattcattaggtttataatcataatattgagacataagtatatattagtggccacaaatattaaccacatatatatatatatatatatatatatagttggctaatgatttcaatcagtaggagcaatatttagtgacaaacaaaaacaga

SEQ ID NO: 41670 - DNA, 953 bp, Oryza sativa
tttaactcatgagttaatctgcgagttaaatttaactgatgatgacatggacgaatctcggacgtccatttctcgatccaacggtagttttcaagtttccactatatatgtggtttgcactacatatttttccgtacaaacatatgtaaaatgtcacaccaataacgatgtgtgaggttggacagccaggcaaccgtgtatacgtgccccacaactaatccacacatctgtttttgtttgtcactaaatattgctcctactgattgaaatcattagccaactatatatatatatatatatatatatatgtggttaatatttgtggccactaatatatacttatgtctcaatattatgattataaacctaatgaataacgacataataaaactatttttcaagacttttttttgcattcatttttgtttaaggaaaaaaaaaaggccagcaggaggaatatatgcaagaagaggagtacatcatactcaaaggaaaaaaatatgagataacaccgataaccctgagaagagattgacactatatccatgcaacccacgttaatggtaccatatatagggatgtaaacatacaatttaactacctggataaaaactcgcttgcttagtttttacttactagtataaaatttaaaagagacaattaataggatctgggaagcaaagaaaaaccgattgctggtcacactttacatatttagtactgcttacactcgaaggattttagctttagacaacctaaaataatactcactttattttgaaacatctagtattccgtcctagaaaaaagcaaatcctatgaatctggacacgcaaatgtctagattcgtagttagaatttgattttctttttttatggaaagatactacatatctatatgacattggttagtttatttttaactaaccaacgtcataaataaaatacgtagc

SEQ ID NO: 41671 - DNA, 1417 bp, Oryza sativa
ttcgccgtcgatgaggtcatcttcaaacagagcattcatggaggactcaagggtcaaggccaggagaagggaagccatggagcggatcgggctggctccgcgtcttcctcgacatgcttcttgttcttgttcttggagcctctcgccatggccgtcgaacgatgggttctttgagcagctcgtgaacgcggcgaagctagacgagggtgtagtagccggcgacagcgccaggtgactccggcaagctcctcttgtctcccgattggccggtgagagagaacacacggtggtgtgcctcggaagtcgtggccgttgttgagttatgagcagaaggggtcgagggggaggagggggagaagcgaagtagccgaagagatataaatgggcgagtccacgtggatcgtcagatcaagtattttttttttaagaagaggaagaataagtttgggcttttcatgtatgagatgaagaatgttcaggatctttttgtcacacattgccatttatttaccgctaaaacattgtcaggtactagaacacattcagagtatcagattagctgcaccaatgcagtatacatggagaaaaggaagaacttaaaacacattctgaagatgatgaattcaagtagatgaacatgagcatttgtttcaagtcatcagtccaatgcagcatcggaaaggggtttgatttgttattcaggatgaaattgtgccagaacccggaaacatgccatatagcacaaaaaaaagtgtgatatatgtttcagggaaaaaaaagtttcagaatcatcgctcatgctcaaacatcaatcccaatctcaatcaatcctaataaaatccaattcaatttctctcaaaccaaatcttgaaggatcttgaatcaaatctaaatgcatatattattgtatctctatccttcacctttttattcaattcaagaaatctaagttaacatggacattgagtttccaatcttgttaatccattacattaaaaaactttttaatacgaaattatccaaaattttaaactcactgttctttttactgggactggtcttttccctgtagcgtttattctgattcctcattttaacatcgagtttgattttcgtccctaaaccataataccagatataacgcgttcctcaaattacaataccgtgcacccgagatcgtaagcagtatagtgtccgattttgactgtcatggcaagttgattcggctgagtcaatatggaccccacgtgtctgcagcctactcttcttcctcctctttctcccactcctctctattccccatatctcactcggcctcctagcgcgtccaaggacgagttcgctgttaattaactaccctgacgagttactgtaactgccgttgattaattagtgcgtgcttgctaaaatttgcagc

SEQ ID NO: 41672 - DNA, 988 bp, Oryza sativa
tacacatataattttgatgcaacaaataacaacacgtcacaaactttactgaaagatgtttcagtaattaacgaaatattccacaatctaaaaagaacattaattacctattaatcttgaacatgtactgcctatatatgtttataagtcaaaatttaaattattaaactttattttgaagttgattttgtgagttttcatcatagtttattttactgtatttacttctgaatcgttgagatatgtattaaaagttttataccaaacagatgggagagtgtaagatgcattaccaaacagaggtaactaatataatgcggtaggtgatccatctaattttgtagtgtgggtacgtacatgtacacttctcgcgaagttgcgaaagagatggatgataatggattctcgagaggatgcctgagctgcatacacgcatataagttgcctgtctgcatgcctgacaaatggatgttgtgcaagcaaacagagcacatttaatttcaacacgtagtgcgtagcactacataatgtgtgtacctaacttcttccagtacagtgttcacagcaagacacatggtgtgattaattatattttacttataattaactgacctctagcttttcttttccaccaagcaagaaaagatagtatatagggtcattttgttaatcaactggaaataaattaatatgcggccttttgtgtggcccccttttgttgttggtttatatgtgatcgacgaccgacttcaacacaataatatgtggctgtgggaggccaccagatttctttattatttactagagtgtaccaacacagtttattagtgggggatttgtccacgattttattttatatatagtttatgggtaaaattactggtgcatgactctatcaaccagagttatcaaatcctgatattgatttatgaacatatatatgggaaaatttttgtgagaattttgtacagtgtgttgatgacttgca

SEQ ID NO: 41673 - DNA, 261 bp, Oryza sativa
cccccaagagccagggttttactgtacaaactctgaactctgaagatttgccaacttttgcaagtccgattctgatccagagtttacacggaaatctgcccatgttctcatttaaccactgaagttggtgagatttcctcgtcctgctcgggttggggagctataaattcagagcgatcaggtcacattggagtcttttcttcagaaatcattccaggatagcaagacatccaagagccaggttctttttaacaggcaata

SEQ ID NO: 41674 - DNA, 1501 bp, Oryza sativa
aaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaatctttcccccccttcagtaagagaagctttagagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttccttggacggggattaatacactagcgttcgggaaaatgtatttttctcggtcgcgacatgggcccccgtcacactgcgccatataaaagaggggtggaggccggcacggcacaagggacgagattcaccgccgccgccaactccaccctacaaaccctaatccgatcgagaggggccgtagccagtgacgggaaatgccaccgccgcgccacgacctcgccgggatcgcccacgaccaccgctgttgcagccgtcatcgccgtcgacctcaccggcgccgcatccatgacaaccgagtgccaacgacgacgatggccggcacttcttcatcctccaacacctcaaccggtcggtctatctaaatcctctcccgttttcaatctctatagttcaaacatcaatcccaaatagaaccacccgactagatctaacctttttcccgcgcgcgccaaaaggccgtgggccaccgggaaaaagtttaaattaggtccctcggggggccgaaaaagaaaggaaaggaatagtagcatttttccttttaaattttgtcaatttttcatgcaaatttcaatagaattttgaatagatttttgcatgttttacctctgtttaaatttgaaccaacgggagaatttttacagagagtaaattacagagttttgctactgttcatatgatttttatatagtttttccgctgcaaatagataaaattgatgaaaattagtgtttctaaaattaaatttcgaaccaacgggagaatttaatttttggaacattaattatgtgctatgatattgtaattttctgaccaacgttgataattgcaatgttatagttatggttatatatgttatgtctaattctgcccaacggtgatataggcttaatgcataatattttaatgttaatgttgttctcaccgtacatgattattttaggtagctact

SEQ ID NO: 41675 - DNA, 715 bp, Oryza sativa
acactccaactaatcttaagcaaaacagctagtagcataatgcacgaattttgtacttagataatccactgtcttctcaaagtctttcgatcaattactttcaccagcttgtgtagcaaaagattgatttgtgccgaacatactttagcacacgaaccggccacacttggatcaaattaaagggccttttctctagctagtgttggattatatcatgaaccatgattattttgcttcaattttcaatcgagagagacttggcaagtactaaagatttaaaaaaattatatagctagtggataatccatgccagtggaaatgcaaaactagctacagttgattatgaccaggtatcgatcggtccaggatttttcaggtgggcgccgctggtatacctgaaactgtagaacaattaatactccctccttccctaaatgtttgtcaccgttgacttttttaacatgttttaccgttcgttttattgaaaacttttgtgatatgtgtataactatatgtatacatcaaagtatatttaataataaatcaaatgatagaaaagaattaccaattacttaaattttttgaataagacgaacggtcaaacatttttaaaaaagtcagcggcgtcaaatattttaggatgaaggtagtatattctaactgagccttttatttattttaatttcactgcttgttctcaaataaaaaatggtat

SEQ ID NO: 41676 - DNA, 873 bp, Oryza sativa
ctgtgtgtttgtagatcttgttaactactatagtgctcaagtgccgagtggaataatggttgctgtaatttgtacaccgagttaattatgatggagctttttattttttttccaaaaaggcacctcctcttttgatctaaactactacctgatctgttccacgaaaacttactcactctttccaaaaaaaatatagcatccaaaatttatcccaaaatagatacggttataattatattagcatttcaattttaagtattccttattgaaattcttctccaccttaccctcaaccatcgatcctcttatttaatggaagcatatagattatttttcctctgccaatttatcctttgaatgctataattgcatttttttttcaaaaccaaatggagggcacgcacattagaattgtgctccagactaaatggaggatgtgttcgctattacctgttcccaaccagaaccctccgcacgaaaaacggagcggtttattagcgcgtgattaattaagtattagctatttttttcaaaaatgaattaatttgatttttttaagcaactttcgtatagaaacttttcgtaaaaaacgtaccgtttagcagtttgaaaagcgtacgcacgaaaaacgagaaagagtggttgggaaaaggggtgtccgaacacaccctaatacccacacggtatcatgccattcttaaacgagatcccacactcttacaaaaccccattattatgaactcggcttcaaagatcttccattatccaccagcattttagggcccctttgaatcgcagggtagaaaaaacggaggaataggaaaacacaggattctaacaggaattgaagtgtaaaacagatgattgtaaaac

SEQ ID NO: 41677 - DNA, 1501 bp, Oryza sativa
taatagtaaaccaataggagaaaacctaaataaagaggcaacaccaaactaatttgcgtcaaacctagacactcgatgctggagtatttggtacagagacattgcgcttcgatgccaacgtccttgacgtcgaggtagaggtccatatctgcaacaaacttttcaggggtctaattgtaaatatattttttaaaacgagcaaagtttgttaggggcctatttgcaaaatatatttttttaaaatagctaaaatgtaaacaaaattgaacaaatcaaagacccacgccgcagcaaaagcgagcccctcgatgccgtcaaacgtcgtcatctatatttcaacacctactctcacgtgaagattaacgtctgatgtctacgtaaaaaaagttactacaatttcctgatatcgttcatattaagttgcatgtggtggtaaagtatttttgttagatgaaagaaaggatatgaacgattgaaaggaaaaggtactgtttctatttgtaatttggcaaatagatactttcataaattttgcgtgcttttctggattatattatatttatttatttattcagcttaagtcgtttcatttgatttggtttgcatgcataagtcaggtaccaaaaggtttagactcgagaggaaacaacctaataagctaaagaaaaaagaaagaagcaaacaaaattattttttgtgaaacttttatatccttgttattagcggtttaaagtttaagtctcaaaaatagacgatgataaaaaaaaaaacctaaaatcaactgtaaaattaagtttcaaacgtagaaaatttggctccgacttaatataacaagcaaacaattaatgccgatcttactgaaaaaccacatttgtataaggagagtgattacaatgctagaggtatatccttgtatatatccataccattacacttgtccagtcgtccagataatgtgattcacatatttcagcaatacaattaattctagtacttgtaaattaaccagatctagtcgaccgacaatggtcatatataaaacaaaaattgtaaaatactaaaaagctttcataaacctgtacagcagcagacggcaagcaaccagagaaatgtgatggcagaggatgaaaaaccatgtgaaatgtcccggaattttccccacctttatttatctatttatttagatcaaacttttgtatttctccaattatattattatgatattaagcaagcaagaaattcggacagtgtcgggtagctgagcaaaggtgccagtgtgctttgctttttaactctgcacctttctctttagcttctcctcgcaaatcgcaatccccatctctccttcgtctttagctcatctcttgattgatccacctcgttgttctttgattgattggtgctttctttgagaggcattggtggtggagatcgatcaagaatcgtggtttgcttgtgcttttctgagttctttgcaatggatggtggattgtagtttggt

SEQ ID NO: 41678 - DNA, 1501 bp, Oryza sativa
aaaatatgcaaaagtactgaaacaagagtgcaccttgtgaaagtgtcggtccagcactggagctcactataggtaggtagtgaagtggtaacaataaaattgaaaggtactaatctatatataattcgagtcaaagataagcattctcttccatgcatttatttatctatcctacttgaaagccgccaccacagccatggcaaattgcattggcaataaacaaagatctgcagctacactagcttatcaacctgtagcagttgaaaggcagtacgtatgcgtgtgtgactgtgaactgtatgatgggcaagactcgtgcaaatttattactcctccttttttaaaaaaataaatatatgaaaccgttaaattttaaatacttcccccgtgccataatataagggattttgactttttattacactgtttgaccattcatcttattcaaaaaattttggatttattatttactttatttgtgacttactttattatccaaagtactttaaacacaattttttgttttttatatttgcacaatttttttataagacgagtggtcaaacagtgcaagtaaaaaatcgaaatccttatattatgagacggagggagttacatttttaaccattcgtcttatttaaaaaattaatgtaaatatataagatataaatcatgcttaaagtacgttgagtgataaaacaactcatgaaaaataaattatagttacgtaaatttttttaagtaacaaaatagaggtagtactcatactaaacagtcggccttaagcaccatactttagcctaatcttgctatgctctcttttgcaaaagcaagcgtgaacaataacatacacgcacacgcacctgctatcactatcagcaatatatatttcagacaagttcacataccattctgtgataagtgataacctagctgagcatggatgaatcagctgggatggaagaacaatatataatgagcatgcttatcctcccaaggcagcaagaaagtataagaccatgttgagagcaagtttaatttcatagctaactgttgacttcaaatcatttataatcaatttaatagccaatttatacaatacttacctataaacatatattacacaattaatatttggtctcacctatcatacacacatgcatcttggagatcgtactgcagctgggtataaatctgtagcccgctgctcctctctctcatgttttatctcctcgaaatgtgtttatagctggcttatagtttgctactatacctactcttagcgagcttaaacttccaagaaagtaagaaattagtagtaaaaatttaaaaaggctattttttttcagcttctgtccttctgacttgtggtgtatgttttggattttacaaccaccgcttttcaaaatctaagtgaaaattctagattgcttagagaagctaagggttacgagagaaactatggctggcagaagcactttaaagtttaaacaaagcctaa

SEQ ID NO: 41679 - DNA, 1501 bp, Oryza sativa
atacttcaaatatgtatccgtatatccgatatgatacgtcaaaactttttatctctgaaactgaacagggcctaagatattgttgtgaagtgatgtttaattaaaacattttaattaaatgggtgaaagagccatgaatagatggtctgaatggagtggagttgcgatcccggtcaaatcgatcgggagccgtatgattggactagtgttccatgattggtcagacctgttggtacctcctacgaagccatcgcggaataagcgaaacggtatatttataaataaaaaataatttataaataaaacttttatatatttgttcttagcgatctagaactgaaggctgaaaaacaaattttgatgaaaaacttcaaaggcagctccaaatttaaggttaaaaatttaaattttagctgacaattataagtataaacgaaaagataaggcccggtcggaccagatgtggtgtggtttaaccgggtgttgttaggttcttgatgatcgtctatagggatggttggaccagtgttggctcggtctggctagtggcaatgggtcccattagaaagtccatcatgcagttagactggcataatcctcgatggagtctgtaattttgagtctcacatttattccctgatgatgtttatggcttgtaattgtttcgtatgctttttttttttgcacaatgtgaaatgaatagattatgaatttgcgggtgaaacttgggctacttaatcaatactccatctattttatattataagttgtttgactttttttttctagttgaactttttaaataacttatagaaaaatatagcagtattttcaacacaaaataaacatattattaaaatatattcaatgttggatttaacaaaactaatttaatattttatatgttgctaatttttttataaatttcgtcaaacataacaaagtttgactgaaaaaaaagtcaaatgatttataatataaaacaggggagtagaacagagttgctcctttaattgatacaccgctgagagttcgcacgtacggcaactccatccaaaaatagaacctactgtgtatacgtgctagtccagaatcaacctatcacacacagtacgaagataatataacagccaacatcaaaaaaaaaaaactaacatttattaataaaaataattgtgataacccttatggctcacttacatttatttatcttgagggcaacacaagaataaaatagcacaacggaaaagaaaataaatgcacggaagctccattcaacatgtcacagataatcaactgtggcacatggcctagtcctcgatttcagtagcaaactccttagataatagcggaaaccttccttctggagttggggcaattgtgtggtgattacatgaaatactcagcaagtacatggaaatatgcatatgcacatctgaaaaagaaaggaaaaagtacgaattaccctcccctcggaactatcgtggtcaaccgaattacc

SEQ ID NO: 41680 - DNA, 1501 bp, Oryza sativa
aattacagtcctacataactaaaattacatttgtaaattcagttgatatgatatgtaagtgcactataattttttataaaaataatgtgtgagtaaatatgtattttttattttcttttgtagttcgttgtatgtaaatataaaggcagaaaaaatttgggtgatttttttttgttagaaatcacacgacaaatgaatagacagacccattaaacaatatttaaaatccactgcaacatttgatccatacatagaaaaacatcacgagtacactagccgaaacattgcttacgcgcggaggaagttcttgaacatccaacccttacccttgagaacggcaacggacttctctggcaagccgcgctgcggcaccatgactgctggtcacctcgacggacttctcttgcaagctgcgctgcggctccacgactgctggtcacctcgccggagctgttgcatcgccggctaaagaggccgttaagcttacgcgcggaggaagttctcgaacatcgagcccttgagagctgttgcatcgccggctgaagaggccgttgagcttacgcgcggaggaagttctcgaacatccaacccttgagaaccctcgagaacagcgacagacttctatagcaagccgcactgcggtcaccacgattgcgggtcacctcgccggagctgttgcatcgtccagtgcttctggatgaaggacgacccccagctccgctccttctcgaacgccgtcaccaatgacctttgcatagctgccgccgccataagctggcccatcatccgcctcctcaccctcctatacgacgccgccgccgccaccgaccaccccgcgaacagccgccggcgctggaacacagatacggggaacagacgagagagagacgggtgcccgatttttcctttccgcatcggttttttccatcatgcacaactctccaatagtcacaaatttaaaagttctaggaaaaaaaacttggcgaagttttctggcaactccgattatttttctttaagatgtggccaataagtatttcggaaatgctaacgatctgtcgacagaaaatctacctccaaatcttgtagattttggtccaccggataaactttgtgattcgtgctccagggccttctcctccaactctggcgacctcctcttcttctccagcgccggcgacaccctagactccggtagaggaccctacgggttagggtcccgggttgaggtgggggtgggaagggtgggagggggaggggtaagagggaggagttccggttttagagggatggccgtgagaggcggcagcccgaaggtgggcggcgaggcggcggcgggcgccgccgaagccgcggggtcggaagctggcgatgggccggtgtaggcggcgggggcaaagcagaagggtgtattaggaggaggcggccggtggtggtgccctgccgccggagacggggaagacggcggcggggacagtgcgccgccatccgcttgaggaaa

SEQ ID NO: 41681 - DNA, 1501 bp, Oryza sativa
tcgagtgccacgtggcacggcgagcagcagccgcaataatacagagcgcgccaggtggcctcgcgttctttttttttttttgtttttcctccgccgctcgcttcctcctccatccaatgacgcgcggggcccgcaccggcctcgtccaccgaatgacagcgtgggccccactccacaccaaccggggtgaggtctgtggtctttgtggataaggcggcacgtagggacgcgggtgcggccacgtaggtggatttggacggtgggctggagggcccacccggcaggcagctagtagtaccgcgttggcgctgactgagatgttgggcccacgcggcggtcggcggccatactgtgggagtggatctgggcggaagaggaggaggacgtggtgctgactcggcgggcgccgacgcgtggctgtgcggcgccaaaaaccgacggccccgcgcgccgtgcgtcgattgggcgccggttcgcggcgtcgtcgcgtgtggattgcgttggttcggggaaaaactactcgaacaatggattgagcattgctgtttactccaaccatctcctaatataagatattttcatatttcacttacactatctatatcaaaatctcctatattatcgaacgaaggaagtacgattcatttaaatagtacgagtatatgataaaatttttaaaaaataaacaagatagattaatatatgatatattactcaacaaacctgcataatcaaatttaacttttacacattacaacgaataaagtaaatttaattgtgaatatacgtttactagttatagtttattttgttttctttgttacaacttataaaagatgaattttaacttgtatgtttatggagtgatttatcatataataatttatcttgttttaatttttttaaaaaataactatttagtaggttatatgtaaataacaaggaaatgtatttttgaggatttacaatccactcgttggtttcggccgttttccgcggtttttctcggtgtttccgcttcacgtgggttatgagcgttgttttggtcatacgtctgctagcaggtgctagctaccgacggactgactgtcccgaggaccggaggacggcagaagaaggcgaaaaattggtatcgtgcagccgtgtgggacaatgacctataccatgtagtgttctatctaaataaatttcggcagaaatacgtgtagaacaatacccgaccggatacaggccaatgaaaaaaaatctttaagatgatacaaaaggagaaaaaaaaaataatatgcaaaaaggaatcgataatctataagaaagaagaaaaaaagaagtcgaattcacgctttggcggataataacgatatataggattctccttttggataaaccggtagcttcaagatcaggattacggaggccatgggccggatgaattctacctcccccgtttcacaatgtaaattattttagcattttctatatttgtattgatgttaatgaatct

SEQ ID NO: 41682 - DNA, 1501 bp, Oryza sativa
aaatgattttattaagttctggacagatatgaataaatgaagtatttgataaataaaatggtggaaaacatggattttagggttgggcctcaagtggtgcacatatggtgattagttgtgtaccgatagggggagagtgcgcccaaaccgacctaaggacttcactcaatgtcagttcatttcgtatacagtacaaccacatgtgctagtatgggatagcccaagcttagtaaattatttatggtttagccttacattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagttcaaggcgtgggcccgccacttaacggttctaggtcatatttccagtatgactaggatggaggaacacgtatcgtgctggtgtaaggctaaatcatgaattttggaaaagctttgttgcgggtaataaattgggtacttatgtatcgcgtgccatgctcttgcatgattattatttcgcatcatgtgggtaaagtgtacaaactctgcagagttaaaactaatcgattagccgtgctcgcggtcatgagcggcgtgtggatatgtattgagtatagacttgtgttaattcttctaaatgctgaaatttaacttcaaattgtgatgagatttgagaatgatctccttgctgccatggaaggcaatgaggtgcatatttatacatgattaatgcctaccttgatgcccaatatgtcaaatactagcttgctgaaatttatttgaaagtaaacctgatttagaaatgttttatgcaaataaaacttgctttatgctaaaaagaaccatattatgccttccttgattatatgccttgcaagtagggtcttaggcttgtcttggtgcttgccagaacattatttctaataatgtactgactcttgctgtggaattaaccttttgcttgcaggttttagacttagcctttgagtgatgcgggtgatcgactgcttcttctaggacttgaacttaatggggtaaacccctagtcggtgtgcttgtggattgggtagacaagcttccgctgttctatataattttttttggccagtcggccaatgtatctaaagtagatttagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggtacatctcaggctgaagttgactggcaggctaaaggcccggcaatgtctccaatattcctctctcgaggcgtcggatatttcattatacttgtttg

SEQ ID NO: 41683 - DNA, 1501 bp, Oryza sativa
ccatatgcaaatcgagcttttctgttgggatgtcacatcagaagagaatagatggcaacacatgtatgcaatttgcaccagatgatagctgccctctgtgttttacccttagctccgtaatcactactgattcagcctgttctgtaaactacagttgcatacttgcttgggtacggtttatgtgccatgaaacgtgacacgaagcaaagaaaaataattttagagtagggattttatgtttctactcttagcggtttaaatagaaaacaataagaaaaccacgtagaccaatctgaaattaagtttcaaaaattcaaatttagccttggtttataggctgacgagttgccaatggaactcgcaaaaatacctcttaagctgcagttgcgcagttgttttccatcactgtccaggcatagctgcattcatgcagctaaatcacaatcagatgaaccgcatcctaatcaagatttttggccgcgaatgcaatgtacctgcaggtgctggatgaaggacgaaccgtggaagcatgataagctggatcggcaggcgtagcgtgcacgagtcacgcttgacattgaagcacaaggatttgtttggatttgggcagaaaaaaaaacaccaagtccatctcctgaagttgctgccccggatgctgctgctgcagtgtacataatagccacctgtgatctttctggcctcctggcttgtaattctgttctagtttgttttttttttctaattgttacacattcttgggcggtgccggctgttgaaacctagagagtttcttcttctttttaatctcccccaatttacattgtaaacggcaggcttgtgtagccaaaaatgccaagttgtgtgttgcaagttgcaacttgatgtgttctttaaattagtgtaatacatggagtaataggctgcagtgctgagaacagtgtcaaaagcagtgttgtggattgtgtgatttgttagtagagatcttcttcaatgcttgaaattaattaggacccttgatcagatatgatagagagaaggtacctgaaaaaaggtattaaaagggcaatcaggtatggaaggtggaagggtaaaatggtaattattttttattaaattatttttgggaaagggcaaaagcgagagaagctacaaacgtttcagcggtgaacttcacattctgacttgtatatactactatatgttgacgaatacatacggtaatcatttgttgatttgagtcgagcgtttttataatgcctaatgggccttataaattctactgagtaagaaactagtggttaccatggtatcaggatgtatctgagagccaaaactgtgtgtatttgttaatccgaagcagtattttgttggacctaatctcagttgaggataagaagctcgtgttcttccaacgcgagctaatcatgcagattacgtatgttaatcatgcatcaatcatcatcgtataagcattgcaatgtcatggacaaaagaattattg

SEQ ID NO: 41684 - DNA, 1501 bp, Oryza sativa
actgggggctcgctctattttcttttgtatcatgctggtttactgtaacatacctgaattctaggattaaggaatttccatcaaaactagttgaaagggaagttcttcaattttgtaaaccaagaatttctattttaaacctaggtggagttgatccaactcttgcaagaataaaatttgagaacaaattaaaaactttttcatctttaacctaggacttggatgcaacccaagtgaaagcatgcatacttgcataaatcatattttgacttgagtccttcttatgcatttggattttcgatttgcatttcataataggtctcatgaatattaactaagatctagataaacaactaaaccattagggcctagtgttaactaatggaaaataatacatagaaaccatacaccttaaaaaaaatatcaacatggctaatgtcaagcctcacaaaactaattttgacatccatctgaagacatgtcatgaacatgaaagtgaacaaataaattatatcatatagggtatattctatcttaatcatctctataagcattctcttaatttaatactaaagtaaactcatgcataaataggaaaggagcttatgacatgtgtaaggtaaactgtaattctaacatatcaacatcacctcaggttaatgagagtccaaatataacttttataaacatttacatgcatttaggaaagagaaacacatataagacataagtcctgcgaattatctaaaataattcatgcaagataaaatcatgggaaaattcatgtaggctctactcaacacatacaactcactgtaattttggtataatttaataactaaatttggtacctcaaataaatcagccaaactaataaaaactagattaactgtagttcttaatcggctaaaaccatactttgtctaaaagtgcatttaactgcataaaagtgtataagtaaaataatttattcaaatactaggtcatttatcatgaataaaaataatttttccagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagctaatctgatcaacacattaagtattgaagctacaaaattagaggagaaaataattccggaaattcgtccaaaaaccaagctcacccatgtttctgcctacacatctctcttccacctagtttacttcgacctgggcccccttgtcagtccctctggcttgcccttcctctgtgcaacttccctagctgaccgagaaacactgagagggagagatcgagcgccgaccggctctggacgccgcgcgacgcgtggccacgacgtgtcgacaccctaaaaatgacgagctccatttctgcctctcccagacgcgtcgccactcttcacc

SEQ ID NO: 41685 - DNA, 516 bp, Oryza sativa
cctcatctattttcaccatatatgcaccctcctcaatacaaacttaggcatccgcataagcttaaacttgatctaaagtgagtaaattaactaagtggcaccaccctccatttcactctagctctgcccctgagttcaaggatcatgttgggtattcacccaaagtttttctgtatccgcattgcttagaaaacttattctaagcaaatttattttatagatctataatacatatactaatatacaatttgtcactataacattcgtactctatccaatcatccgtaaagaacatcgcctgcgagctcactagacaggggggacccttctcctcctctctcgagagttctcttgaatcctttctataggaatccttcgtcccctccggcccctctccctcctcctccccggtggctcgccgccgtggaagggatggagaggggtccggcccctccacccctctattagttgtagttttagtcgggtcttcccgtatggtcatggttctcccgtagt

SEQ ID NO: 41686 - DNA, 1501 bp, Oryza sativa
gaatagagtaaacacataatacataaaaaatatttctgataaatttataacatcatttttccatatcagtattttttacaagagagagtgagtaatttttgaaattctacacacacttgaagttgtttttattttggaaaatgtaagtctaatttaactatcacataatctatactttcaatttatttatattttttatgggtgttttgatgacatgcacctaatttgaatacaactcgaaatagcatatatttttacaactcaaagcatagttgatattagtttaaattattagtttagttttccatctaatccaaatgatgagaagaaaaaaaaataaggatgtgggacgcggtgtgtatacgcactgttcatagaaatagttgtgtacatactctacgtaggtacgtacttttcttaagaaggaatacctacatacctacatgcatgtatttttgccggtcgtgccaatacgacatgggcctttttacaaataaatttattttgtagttttaagatagatctaatagttgaaaataatgggtccaccaaattaaatgaaaaccgattggtcgggattttttcttattttatacaatttttatgatttattagagtgccacatggtggtctatgagcatttatagggtactatgtccggattagaagcgtttgtaggaagtttatcctcttgattacattttctccctttttctctttatgaaaatatttgcaacaataatttttaaataaccagaaccttctgaattatatatttatttgtaaaaatatattttaactcattataatttttaacttttaaatcataccttcatttttttatctatttggaccattgtgttatttatgataaaaaaacaattagaattcatacgtaagttatctacttcactcataaaatgtatattcttccatgttctatttactatcctatgcatgtatattcttccatgttccatttactatcctatgcatgtcattcaaacgtatatgaaaaattataaaagaaaagtgactatatattatttcttccggtaccatttcacttgcatgtataaataaagtcagtcactgtatatattgttagatcaactttttaaagaatgcccgcgtagctgaaaacatatattttcaaatcatatattttttattgtacgtttttttaccatatttgtgaagtaataagttttgtttttctactatagaaaatactattttaaaaaaccatctgtttttttgtctacgcataagtacatttttttcttggttttgtcttcgcatatgtacgttcgtttttttttaaataaacagtacctaaagtttctgttttttttcaattgtgtgtacgtacgtagatttttcggtataagcggtttcactcgtatggacatgattttccggtatatacggcttcaatgtacaatgtagaacttttttttggctttatagctgcacttatgtttgtttgttttttttaagc

SEQ ID NO: 41687 - DNA, 1501 bp, Oryza sativa
ataagttatttaaaaagttcaactagaaaaaaaaagtcaaacaacttataatataaaatagatggagtattgattaagtagcccaagtttcacccgcaaattcataatctattcatttcacattgtgcaaaaaaaaaaagcatacgaaacaattacaagccataaacatcatcagggaataaatgtgagactcaaaattacagactccatcgaggattatgccagtctaactgcatgatggactttctaatgggacccattgccactagccagaccgagccaacactggtccaaccatccctatagacgatcatcaagaacctaacaacacccggttaaaccacaccacatctggtccgaccgggccttatcttttcgtttatacttataattgtcagctaaaatttaaatttttaaccttaaatttggagctgcctttgaagtttttcatcaaaatttgtttttcagccttcagttctagatcgctaagaacaaatatataaaagttttatttataaattattttttatttataaatataccgtttcgcttattccgcgatggcttcgtaggaggtaccaacaggtctgaccaatcatggaacactagtccaatcatacggctcccgatcgatttgaccgggatcgcaactccactccattcagaccatctattcatggctctttcacccatttaattaaaatgttttaattaaacatcacttcacaacaatatcttaggccctgttcagtttcagagataaaaagttttgacgtatcatatcggatatacggatacatatttgaagtattaaacatagtctaataacaaaataaattatagattagtctataaactgcgagatgaatttattaagcctaattaattcgtcattaacaaatgtttactgtcgcaccacattgtcaactcatgacacgattaggcttaaaagattcgtctagcaatttacacgcaatctgtgtaattagtttgtttctatatttaatactccatacatgtgtccaaatatttaatataacagagtgaaaagttttttttgcgtgggaactaaatcccttataatcattatcataatcaactgttcatcacaaactattattcttcaccatgattttacatattgttcacacaattgagcagtatgtggatcgacgatatgcagaaggcctatgcgtttgcatgtttatatatagtcacaagtacggtagaaaatgtgacataacaagggtacctaacggtgggggccagtagcccagtgaaaaaaaaaagagagaatccttatatgccactgaaaattggtctgattccttatatgtcattgaaaattggctactcccttatatgccattgatctaaattttcacaccctctcatgtcactcccgtcagttgaccgttaattctcaagaaaaaaagacatatttacccttctgattatagggcatgcctaacaactcagagagagcaaatatgtctttttt

SEQ ID NO: 41688 - DNA, 1501 bp, Oryza sativa
tctactttagatacattggccgactggccaaaaaaaattatatagaacagcggaagcttgtctacccaatccacaagcacaccgactaggggtttaccccattaagttcaagtcctagaagaagcagtcgatcacccgcatcactcaaaggctaagtctaaaacctgcaagcaaaaggttaattccacagcaagagtcagtacattattagaaataatgttctggcaagcaccaagacaagcctaagaccctacttgcaaggcatataatcaaggaaggcataatatggttctttttagcataaagcaagttttatttgcataaaacatttctaaatcaggtttactttcaaataaatttcagcaagctagtatttgacatattgggcatcaaggtaggcattaatcatgtataaatatgcacctcattgccttccatggcagcaaggagatcattctcaaatctcatcacaatttgaagttaaatttcagcatttagaagaattaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccaatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtacacaactaatcaccatatgtgcaccacttgaggcccaaccctaaaatccatgttttccaccattttatttatcaaatacttcatttattcatatctgtccagaacttaataaaatcatttttcatgttaatatgagcccaagtgataagtaaaactattctaagcatggctaagcaatatagtgaactagtgacaatgtaactcatattccaagtagtactaggatatgattcctaaggttaggaatgagggagatggatatatatggggttaaggtgataatgcaaataataggagtttgtctaacaagtttaacaagattttaatgtattagtgtacaatcgacatgcaagatttgcaaacattttcaataacctccaaaacataggttcaaagtgatcaaagagagggaggtgggacttgc

SEQ ID NO: 41689 - DNA, 1501 bp, Oryza sativa
taaaatttgttactatttttatgttacttgattaaatctaaatgggtttgactttgaaattaaaacgacaaacggaaatggtactacccaccaaccgagatgcggacgagactccgctgactttgtgcagtttgcagttgtggcaccgacatgtgggccttatagccctgcacaaagttaggggatctgtttcctcgagatgttgggcgcctgacacgctgaccctactcccccggacgtcgtcgtctccaaccaacaacaacggcttgtttggcaacttgaggtaaaaggattgagagtttacacgagggaattgatgatgagattaaaatgggaatttgatttttatcccaatatcttgtttggtggaggtggtggaaattgataggaagtttagttggagattaggtcattaatgaaaatggatggctgtgatttgtttaggcaaagtaaaggaggaattccctcccaattaccacatctacccaggtattgaaaagggggacttcctttctcaattccctatcccatcacgccaaaattcacatgtctcataaccaaacaaaatactccctccgtattttaatgtatgacgccgttgactttttaacaaacgtttgatctttcgtcttattcaaaaaaatttatgtaattatcatttattttattgtgacttgatttatcatcaaatgttctttaagcatgacataagtatttttgtatttgcataaaaaatttgaataagacaaatgattaaacgttggttaaaaagtcaacggtgtcatacattaaaatacggagggggtatttaatagcctcatctttctaaactctcaatcccttgtaagagcaagtacaatagcaggctataaaccagctataaatatattttaaagagataaaggaagagagagaagagcagcgagctacagatttgtagctagttgcaacacggactacaagacgtaatgtgtatgacatgtggtaccaggtattaatagtatagtaagcaactattgtatgaattggctattacattggttatagatgatttggagctagtagtgagttatactattgaacttgctctaaaaactccctccgaccaaatgggccgcaaagacagtgataaataatccatgtgaggcagtcacaggtaaaaaaaaaaaaaaagcttctctaatcctagctcgtgacctgacacctgtccagatgtgaacgaatcgagcggaggctagcgaagtagtagcgagtgtagcatcttctcgcgcgctggtctccccaccgtctctttcgccatttgcacaattctctcactcctctttccccctcccttcttcttgcttcttatcccccaagcaataacgaggcgtcatctctctcgtcatcttctactctccctcctctagtcctcttcttcttctactttgtacgcgccactcactctccgagcttgacggcggcggcggcggcggaggtcgtcgagtggtggtcggggaga

SEQ ID NO: 41690 - DNA, 1501 bp, Oryza sativa
accaaaacaacgctcataacccacgtgaagcggaaacaccgagaaaaaccgcggaaaacggccgaaaccaacgagtggattgtaaatcctcaaaaatacatttccttgttatttacatataacctactaaatagttattttttaaaaaaattaaaacaagataaattattatatgataaatcactccataaacatacaagttaaaattcatcttttataagttgtaacaaagaaaacaaaataaactataactagtaaacgtatattcacaattaaatttactttattcgttgtaatgtgtaaaagttaaatttgattatgcaggtttgttgagtaatatatcatatattaatctatcttgtttattttttaaaaattttatcatatactcgtactatttaaatgaatcgtacttccttcgttcgataatataggagattttgatatagatagtgtaagtgaaatatgaaaatatcttatattaggagatggttggagtaaacagcaatgctcaatccattgttcgagtagtttttccccgaaccaacgcaatccacacgcgacgacgccgcgaaccggcgcccaatcgacgcacggcgcgcggggccgtcggtttttggcgccgcacagccacgcgtcggcgcccgccgagtcagcaccacgtcctcctcctcttccgcccagatccactcccacagtatggccgccgaccgccgcgtgggcccaacatctcagtcagcgccaacgcggtactactagctgcctgccgggtgggccctccagcccaccgtccaaatccacctacgtggccgcacccgcgtccctacgtgccgccttatccacaaagaccacagacctcaccccggttggtgtggagtggggcccacgctgtcattcggtggacgaggccggtgcgggccccgcgcgtcattggatggaggaggaagcgagcggcggaggaaaaacaaaaaaaaaaaaagaacgcgaggccacctggcgcgctctgtattattgcggctgctgctcgccgtgccacgtggcactcgactggcgcttttttcggtgtttttctttttgtttcttttcgcttcgctgtgaataaatacgaggcgaaaaattaaaaattcagtaccaccaaaccaaacccaaacgagagagagaagaacacacgcacaccccgagcgaacgcaaaggagcgagaagccgagaagaaaggagcaaagtcgcgatcgagtgacgtaagcggcgacaatggaggctgtgctgatgcagcaggcagcggcggcggcggcggtggttgcaaggccggcgaggcggcggtgcaccggggaggaggtggtgggtggaaggcgaccggggttggtccggctcggatttgcgcggcggcggtggtcgaggctgaggctgagccccgcgcgggcccacctcgccgtcgaccggagcagggaggccggcgaggaggcggcggcggtggtggaggaggagggggaggcggcggtga

SEQ ID NO: 41691 - DNA, 1501 bp, Oryza sativa
gaatttaattcttaactagtctctcaattccccccctcgaaatatggcccaaacgacagtgccatagtttcgatgagacatcgggagttctctttcttttcttgttttcttttgtcaacgaggacacaacattcacattctcaaaaagagataacaaataaagctcgtctcacagcacagcaagaccaatacatgcattattataccatagttcacatttgccacttccaaagcggcaatcatatccatcaaaatccaactttgataaacttattaagtttctttgcaaagaaggaacataaaagacatctcgaagtaaaagtgtgaagccattcgcgagctctagaggaagatctccaacagcttcaacttttttttcaactccattggcaactctaatggagctttctcttctttgcgtagtcctcgtcgaacggaatgcctttaaacaattacaagcatgaataattgctccagaatcaatccaccatgtggatctagagtaaccaacataatgagattcatttacaaatgtaacaatgttctcacctttccttgccatgatcattttcaagaagtcaggacagtctttcttgtaatgtcccgtcttcttgcaatggagacactgatctttctcaacagcgaactgttgttgctgaggcagatgctgagactgtttagcttttgaggtgggagacttgtggttctttttcttgttatctttaacatagttaattgaaccaccatttgactctttaattctctcctcctcttgcacacaattagcaatgagtttttcaaagttccatttctctggacttatgttgtagttgacaataaaattgtcaaactgctttggcaatgaggcccataaccagatggaccagaaaagtcatctgttatgcccaaatccattggcttcaacttggaagccatgttgctcattctaagtatgtggtctctaacaccacctccatggtacctttcggtcacaagctgcttgatcagctgtgtagcataagtctttgaagagccagtaaactgcctctttattctttcaaggtactctgagacagcgtcacactctgggattgagcccaatatggtaggctcaatcgtgttctttaccatagccaaacatttcttgttggctaaggaccatttcttttgttcaatgtcatacgacatgacgagaggagcattgtccctctgtctcttttgccagtcaccatctgactcattttcacctctgataagttcagcaggttctataggacatggggtagtcaacacccagtccacctctcccaagatgaaagcaaggtcgagttttcttttctattctgcgtagttatctccttttagggtcggaatatctttaatgcaacccatcaagaagtagctacctaaaataatcatgtacggtgagaacaacattaacattaaaatattatgcattaagcctatatcaccgttgggcagaattagacataacatatat

SEQ ID NO: 41692 - DNA, 407 bp, Oryza sativa
ataaaaaacgtccttgaaccgtaataccacagacactcggggtcctccaactatataaaaccggtcacccaaggtcccttggtggttttgaccccggttttagtctacgtggcagctgaatcagcgtgggacccacgtgggccccacatgccaggtgtacacgtcatctctctttcccctcttctctctcttccttccctctctactctctctctctctcgcgcaggccgggccgatgggtagggagcagaccgagacggctgggcggcgagcggtgctgagcggcggcgccgcgacggcggccggcggacggcggcggcggcggcgtcgtcgccctcttcttcttctccttctccctagaccttgtcgctcccgctccgtcctcatctccctggacgccatggacc

SEQ ID NO: 41693 - DNA, 1501 bp, Oryza sativa
gcctctctccttcgtgccgtcaccgttcacgagcggcgccatcgacgccttcttgctctagccgggagagagagatggggtggggggagtggtggggcccacgaatagctaggcagagagactctctaagtttgaccagtgagaggtacaatttggccattcggatggcttagctaaccggatggagaggctattggaggatattttttcctcatatttgctaaaatttagcttggccagccatttgaccattctattgaagttgctctaagggagcctatcactgcggggttggccaaacgccaaagcattgtttcctcggccatttccctagctgtccagctcctgaccttctggttgaacactatgttgttgtgttctttccaaatcgaccacgccgccaacacaatgatggtgtcatagcctcgctgaagcagccttgcgagggctggtagcagcggagggtggagcacccctcagccaatcactgcggcgggagaggaggatgcacgggcgctggagtcgacggagagcgagacgagggcaagagagaagccgttgtcggtggcgccgccgccgccacgtccatctccacctccgctcctctccccgcccatcgttagcccagccccgttcctcatccgccgccggttgccaagagagacgaaagggagtagtcgctgacatgtgggacccacgtgggttccacgctgactcagctaccacgtcggataaaatcagggataaaaccgcccaagaacctatgatgaccggttttgtatgttaagggaactaggctgtgttcgccattgtatgttcccaaccggaacagtacgcgtggaaaacggagcggtccattagcgtgtgattaattaagtattagctatttatttaaaaaaatggattatatttgaattttaagtaactttcgtatagaaactttgaaaatttttgtaaaaaaaatacactgtttagcagtttgaaaagcctgcgcgtggaaaacaaggaagaggggtcggaaaagggtgccgaaaacagccctaatatatctggttttttttggtgagagacgattttgtaattcggtaacaagacgaggtactttttcaaaaaaaaatcatcccatcggacggcatacagttacatccgcatcgcagcccatattgggccgaaatgggccggcccatattacgccgtgaactccgcatcgcatcgctccgcctccccctcgtctcgttccccacttcccctcgaattttttttatttttaattttttttattaaaagttttacaaaaataatttttcattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtgcggggggccgcc

SEQ ID NO: 41694 - DNA, 236 bp, Oryza sativa
cagttgatagatgaagttctataaaatatcaactatgtgtggcattgtgacaaaaaaatagaaaatagtaatgtactactaaatatttaagttaaacagtatgccaatcatgagatatcctatgtctgcctaggaaaatcacttgctctgccaggctagtttgtcaggacatccagatgtttttttttaagattcttctaaatagttgctccgagggccaaaatatcacaaataga

SEQ ID NO: 41695 - DNA, 1501 bp, Oryza sativa
gccgacgtcgtctgcgccatccctagccgccgccatccgcttccatccccgcgtggatttgaccgggcggcgtggattcgggagaggaggagtgagagaaagaggaagaagaatgggtacagaggctgacgcataggtcccgctgtcatagactcaaagtagagaggatggatggatggagaggctattggagtaaacaacgaatttgatttgacaaatgaaatggagagttggccaaatatatatttggagagtcgaatttagagagagcgttggagatgctattagattgcaggtttcgtggctagattaggctttagctcctttcttccggttctcctatcccctgttgctctttgtttttcgatgtaaagaactgtttttctccggttaataaaaaatacgcatctaccgtattcccccaaaaaagcattacgcaacactgcgatagcgcgacgttgattcggttttacatataaacccctaatttttttacaaattggccctaccttagatggcgatgcgtttcccgtcagccctgtcacgccgccgccggtcgccgaacggcagccgcagctgcgcgggcagcggcggaggcggaggcgaaattttctctactgctcgcttacaatctcagtagtgtcagtagtgtgatagagcaagaggaaatcgacgcaaaaatcagatggaagtgtgatagatcgtcggtggtgtggggaggagaagatggccggagaggaaggtggttggtggtgtgagcttgctgctgcggcggaggccactcgcttcaaggttcgctcctttctctctcatatacaaatttgtgcttgtgtttatttgcgcaagcactaggaggagtgcgatctgttagtgcctaatttaatttcagtccctttcatcagttccatcgttgttgattgctcgtaaaatattctccgttccattcttactaattaaattgaccggacaaaatatggtgttttaggtgactggcataaatttgacctgctaaaattttattgtctgaagattattgtgataattttgactgcatactggagcgtgtaccagctagccccccaagtcaaatcagtctcaagcttcattccactcgtatctggactgctgcccaaaatccattggtgcatctacttttgagttcacatgaaaatccattggtgcatctactttgagttcacatggttcacatggtgattacaagttcatgtctgataatcttatgtgctttctgatgttgactaatcggctttggctctgtagaaagtaatgaaggtagaaacacataaacgtgggaatccttcgtcttactttttgagaagaaaattctggtttagaaagagttacctcatgtagacgtctttctctctgctcatgtaaattcatgtaaatcgctttcaatactagatcagaaaattcatgtaaattgctttcaatacctgcacaaatttcttgtagacgtgtttctctctgcttcgttcct

SEQ ID NO: 41696 - DNA, 1501 bp, Oryza sativa
gagatggtgggcgaacagccacacgcgtgcgtgcgccaggccaggccgtgggcgtggcgaggcagacggcggctgcttctctctctctctctctctctttttgtaacggacggtattaaacacggtgattgattaacattactcccgcgctcgcatatacaccgccataggaacgaacagaagtacggaaggttcttcagttctacccgactcttgcacttcgttcttcctcctgtacctccctctgttcttgcgctgcaagatcctttcccggttccgttcacctacacgcacaggtgtacgggacgagcggagcctccggaatcctatccgcttgagtgcctgcacaggtaggcgggcaataaggtttttggggagcgtctcaacacgactgctctggcttactctgcatcgtcttgatggaaaaaaagtttatttatcatctttgatggaaaaataagacacatactcctaatagcattacacatatttgtaaagtctcatattcaaattcaatatattttagccgtaacaaaaaaaaatgaaaaatctaacagtttttgggtaaaaatctgttagaattttgtcttttttgttgtggctaaaatataatgaatttgaagaaaatatttcacacgttggtgtaatactattggaagtatgtatctaattttttttctagaattttctgtggcatttgctagttggtgtgcacgggaagcttatgtgcataaaatatgttgccctcaacgagatatacaactttgtagttgaatgtttattcattatttgatatcttttaggggttcaaatatttttttccaatctaagatctatttttgaatttgttctttttatatgtatttgcaaaagtcttcagacgaaggtatgttctaaaaaaaatttgtaaccttcgaataagatctacaacttaatagttgaaaggtcgttcatttgagatcattaggggggggtttaaatatgcgttaaatttgttggtctatatttttacctctagaaagtccaaacttaagaaaaatagaaaaaaaacatattaaacatgattgaggtaaaccaaagttctatgagatttcttatagtatttcctataatatggcaatttcagtaatttttagtatggtcacttactaatatcaacttacatggagactacgtaagatatatataagtaaacaatcatactgaaaatggttgttttaagtaaatatgaaccagtcatattaaagagaatattgtaaggatcgtggagaaactttggttcaccttaatcggacttgaaatgaattttctataaatttttaaagtattgtttggttcaccttaatcatttttaccagtggatcttagacttttgaattgagggacttaatcattttcacccgcggatcttagactgggagtattgtttcattaccattttatttatttcttttttgaaaaaaaaaatctctacaggttgattccggataaaacaccaagc

SEQ ID NO: 41697 - DNA, 1501 bp, Oryza sativa
cctgttgatttcaccaggatggcctttcttggtgctcaagttcatggttgcctggtttatgatcttagggtcgctggccctgcacaaaatcagctaccaaaactaacgtcaagagaagtgttattgggaggtaatattcccgtcgaacagaagtttgatgtgctggtatggaaatctggcattccaccatactgtgattacatagctacttttgagaaacagaaaccacggcgtgtggttgggaagaggaataccatctaccactgagaaaacacaagctcaaatcttaatttgggggagaactctacaaattaagaaattatatcgtcggtaatgtaatttaaaaggcttgctctgactactattggaataatttgtacagttcagatcaatgtagcacttgtgtctctactgtaggttaaaatgtgtatatttttattaagaaaaactctgttgtatctgttcctattagtttggatatgtgaaattcagtcagttacagttgttaccctgacttgtatttgcatgtatgacggaaaccttttgtaaagaaactacttcatgtttctgactatgtgacctatgtatgaacaatttaatttacacaatatctgtttgggcatagttagtttcagtccctttcatcaattccatcatggtcagagcctgccttgcttgactttctaaattccaattaccctaatggtgcatttctttatagacctctgtttagataatttcttcctgattttctcttgcaaatcacaaaggatatgttcatctctgcagttgcaagtgatctttcagccatttcatctccttttggatccagaaatttgagaagcggcacacaacagtggaggggaaggaatcttgataggctgaacagcatccttctaaagatccacaccatcgttgaggtctcatggcagatcacaacctgaggaatgatcctccagttttggcgcctatggtaggtacgttatttgattagtatttttttggcacgtcaagttgcagactgttggtgaggaggtagtacttgaagatcattctcaaaacgcctctgtttatggtcagaacaataagctatgaagaaaaaaaattttgttttaggtgtaaaaaaagatagggaagcaaattagtgctgatagctttcctaggttatataggctgtatgtacctttcaccaattatccacctttactgtagttattcagacagttcagggcatagaggcatgagtagctactgtagctaacagatgtttctttttttaaaaaaaaagaagaagagaaaataatgatgtatatgctcttactagtctgaacatgtaaatgcagtcagtcactattgctattagtactatgaacattacgtataccttttgaaaagaaactactccctccgtttcacaatgtaagactttctagcattacccacattcatttagatgttaatgaatctagacatgtatgtgtttagattcattaacatatat

SEQ ID NO: 41698 - DNA, 1501 bp, Oryza sativa
gcatagcttgtatgtattatagtcttttcatgagatttagattttgcttttaagggcgatgatgcatgacatttaaattctacttgaattaagcaaatatgcaatgttgatgctagcatatggtttgatttataaatgctctatatatatgctttattgaattgttattcctcaaatagctttaattgctcattgtgaaaagagaataaaaaatatgaaaaaaaatgaataccgaatccttggaaacagtcttgacgacaaggacgtattcgatgtgagcaaaataatgggtgccgaatccctgaaaacagtcttgacgacagggacgtacccagaataaaagagaaaaatatgagcaaaaaggctcaagaaaagaaaaagtcaaaaaaatctctttgttattttgtgctaaaggttatttgagaaagagtgataaatacaataggtatatgtgtttagtgtttattcttcaacctatgtgcttgttaagttgttgcattataaatcgtataaaattatgaattttgattgttgattcaagcttaattgtaaaatctttggttcatggttatacttaatgcatgcttgttatgttatagatgggttcatcttctttttattgcaacacatgacttgatatgcaatatgtatgctaagctcttatacattaataaacgtaattcctatgcttgatgaaatcattgtcaaaagggggagaagcaagtaaaatttttggatttttttgggagaagcaagatgaaaatttttggagaaacaaatgagttgaagagaagagcatgttgtttttggttcatgagggaatatctttcttttcaaaagtgagagaagttttcttttagattttcgagcacgatgtgtacgtttgtacgaagtatactttttttaccacttatgtttttatttttccaaataccaaaacatttctgatgggtttgccaatgtgttcatcaagggggagattgtaaaatcaaaggttttttattattattttgtgatgaacaattggcatcggaaattattggttttgatatttggaatttattcacgaagtggttttggagatgattggatttcataggtgaatctataggatactgctgttatttcatgtgaccggtcaaaccgggccgtggatgccggttagaccggcgtgtattgcgcggtcagaccggcgcagctcacggtctgaccggccgacgctgtgtcggtttctgtttcgggttgtttgtttggatatccgtgattatttcatgattatggcttctagatggatactatatatatgtaatactgttgtttgctactgatgagtcaagttggagatagcttggtctcggaagatagtttctttgtttatttcatgtgtaggtgactcgatgcctcgggagagtatttgcggtaatggactgggagtcggcttggggataagacaacgtccgtggtggtcaaagatcatgcgggatacttaggctacagttga

SEQ ID NO: 41699 - DNA, 1213 bp, Oryza sativa
cctgaaacatgtcgctaatgttgcaggaaactaatacttttatcaataaaattgcagttttcttaaatttactctatatctaaattacttttagattttattaaattacttcttagtcataaaagtaatttaataaagcttgaaagtaatttacctatattatagaaggaacttaaaacaaaaggtaacttgttacggcattaaaagaaatctatacattcatgttgtgagttgtttattttataatcatttttagtcaatgacgtaatttgtgctgattaaatttaatttctatatagactcatgtttttacctctataacgaatttacttttaatgtcgtgataaagttactttctttttttttctaagttacttctataatatatgaaattacttttaggctttattgaatttacttttatgagtctaaaaagtaatttagtgaaatctaaaagtaatttagatatattataaaagtaatttataatttttcatcaaaatataatcatgtgagattttgttataaagattcaattcttacgaacacaatagtgtaatcggatcgtagatcggatgattagtttaagacaaaattatttttgacgccggcgtagcatagagcatcacatggcttccaatttggattcctcttgatgatgccatgtccgtaaatcaccaggccatgtacggaggcaccagcgcttgtgggatcggacggccgatgaacatgtcgcatgatagggcaaaacagagagcgcgcgcgaattagattttgccttaaaaattggtgaaatttaggatttgctgcagtctcttggaatttgtaaccttcatagaactgttggtttcagttggttgtgaactaatattaccacatattttttattaaggtagctaagcttagttttaccatacttttgtggcaaacaaaataacaaactaagtttaggcaaagttagacaagaaaatagagtgtatgacatgtggcctaggtggctaagagttaggcaaagtagacttgtgtcatgaaccaatcactacatgttaaagtatggtttacctaaggttagatgtgacaaatttagttgccgaccaaacatgccgtctcttggagttttgctttcccctgcttgtcacctaaattattagggtgtggtcattttcactgtaatgtgtgagcttcatttgtaaagttgtaaccctagcaaaca

SEQ ID NO: 41700 - DNA, 1501 bp, Oryza sativa
caccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtacacaactaatcaccatatgtgcaccacttgaggcccaaccctaaaatccatgttttccaccattttatttatcaaatacttcatttattcatatctgtccagaacttaataaaatcatttttcatgttaatatgagcccaagtgataagtaaaactattctaagcatggctaagcaatatagtgaactagtgacaatgtaactcatattccaagtagtactaggatatgattcctaaggttaggaatgagggagatggatatatatggggttaaggtgataatgcaaataataggagtttgtctaacaagtttaacaagattttaatgtattagtgtacaatcgacatgcaagatttgcaaacattttcaataacctccaaaacataggttcaaagtgatcaaagagagggaggtgggacttgccttgaatcaggaaaatgtcagcacctaaatcacttcttcaccgattaagcaatcatctatacaaagtacacgttatgcaattaaacaccgaaatatgcgaaaaatccaaaatgttctaaaatgcatgatttgtgcagagagaataggtactggtataaaatgaatttaggtgaaagaatttctattttatctcattttatttgggagttatgaattttagaagtttcgtcggtatagtgtaggatttacttaggtactattgtgaaatgctgttgtaaggtgattcttattaagtttatgtttgctggggtgaagatatttgttttctaagactaacacatttggtttcataatttttagagttaatatgaattatttatgtattttacaagttttaacgtgttctaggcatatattccctatgtgtacatggctttggagatttaggtccagaacttgctctaacttgctagtgttgtataaaatgagtattttagttaactaatataatcttagtttataaaattttagtgttcagattactttacttcacattttataagctaggggatgttctatgttagaaacttaacatatcaatctagagagtattatatgagttaaggatactaagttttggtggaaggggatggatctatgccttcactggttcaacaagttttatttggatttatttggagctaccat

SEQ ID NO: 41701 - DNA, 1501 bp, Oryza sativa
acggtaaattgtatattaatagattaatatcaaaaattagtctactaaataccttaatacgtccggccggttctgggaggaggttgagaggggagcgctcactagtacaaaaaccgtcataggtgccggttgggaatcggctataagtgccggttttcgaaccggcacctattggtcggcaccaatacaagaaaccgacaccgatgtagaaaatagaaccggcacctttagctttactcgagccaaaaaaacaaaggagagccggctcaaatcgagccgaactactccccagaaaaaatcgaatccaccgtcattcctctctctcgcccagatctactccccttcttcgccggctctcagatgcgagatcaacttcaacaacaaaccgtattcatcaagaactagcgaacagtacaaaccattaaccacaagtttggaacaaaaactcaacaagtttagaactagaactcaacaagaaatcaaaaagacaaactcaagaacctatgccgccggccgccacctcgccagcaccaccggcgtccctcaccacgctcgccgtcattgccgcatggagagggcgtcgcccaggtgcgccgcacctaccttcgttaggcagctgccggacgtggaagcccgccgcctcccctcccgctggatctggcggatgggagggtgcggccacctccgccaccgccgtctctccaggcaaccgccggtcatgggaacacgctgcctacgactgctcgccgcctccgccaggcagctgcgaccacgggagcccgtcggccgctgcctacgagtgcagccaccgcgagagagagaggagggaggcggagggcggaggggagcccgtcgccgcctacgagttctcgcccccgccgccggctgcagagcccaccgcctcgcctcccgccggatctagcggaggggagggcacagctgcctccaccaccgccgcctctccaggcagccgccggtcgtgggagcccgcctcctacgagtgctcgctggctccgccgggcggccaccgcgagagagaggagggaggcagagagacgcacgagagagagggacagagacgcgagagagagaggtggataaggcacagtcgttgtggccacgagtagagaacgacgcggtgcgctgcgctcgttgatgggcttggctcgtaggctcggctcaaagttataggtgtcggttttttaaaaaagaaccgatacgtataatatattataggtgccagttgttttaaaaaaccgacacctatagtataagtgtcggcttttttcactagaaccggcacctatagtgttttatataggtgccggttgttttaaaaactgacacctataatataaatgccggttttttcgctagaaccgacagatatagtgtttaaaggcgtcggttttttatttttccatcacagggtggtgggaaaagctctataggtgccggttttaagtgaaccggcacctatagatcgttccctttgagggtt

SEQ ID NO: 41702 - DNA, 1501 bp, Oryza sativa
aacaatgaaaaggttgcgtatatggaattatgacagctggtcagccgccttctctatataattattcctagccatgtgtgctcaaataacagccagaaggctcacggagttgtgatgttatcaccacttttatcattagagccttttcttaaaaaatagattcagcatgtctaattgatcaatcatgcaattgcagtaatcaccactgtgattctaactatcgatgaattcacatattaaggtctcaggtgttgatgacaatatttaccaatactatccatagatttactcggcataacacaagtgctgattcaataccttgcacccaaaacattcaattcgtaggaaatatgtgaaactgggtaattcccggcaggaactctcggggagacttggttcagaccaaccacacgtgcagaccgactttttgagacaacagctccatcatatggtggatgggcatcatagacggtaaactttgttccgagaaagtttgacctgttaaaacaaaggtggttagctggttcttttaattgttattgtaggctatatttttagatctgtaagaaacaaacaaaaaaaagatataactgaagattaagtttgagtaatgcacttgacatccaaatacatacagttttgttctaagttgaatgaatagtttagatgtgaaatgcatagcacttcaatttcttgtactttccaaattctaacacttacagcaaaaggagagggggaaaaatgccatgtgatgcttttatatgaaacagcctatagtacatctaaagggccttccttacacatactactaaagaaactaggaacaaatttagctttagcttttcagtgatgaaatctcaaaagatcaccttagcttgccaatataggtgttgctcccctttgacatatcactcatgtcaagggaaatcaggtagtctgtgcatgtgggcttcctgcatttgcgtgcagcaagtaggaacttcccatcatcggcaagtgctgtaaaaagaaacttcccgaaaatagtaagcatatatccattatacgccagcatagctgtacttaatttggcgtaccaggggtggataaacagcataccttctgtgagcccaatatacagataatatgtctgagtagtccggtttcttcttatgaaacatttaagagtgccgtctcttgggccaggctgcacatcacgtagacttgagtaaattaggactaagatgacactaaaatgaacttgtcaaccaaaggttacagtcaatgaagtggcgtcaatttctacgaaaatgacagcagagaaatggcatttgatactggaatatcatgctaaacatgtgaagcaccgcaatcaaaagggaaacggcttcatcagatagcatttatgcatccatcacattttcttgatatgcagtttgttttctagcccaaaactagataaatcacataagggagacaccttccaaaaattaaaacatactagaatgccatggttcacaac

SEQ ID NO: 41703 - DNA, 1501 bp, Oryza sativa
ggtcgatgtcttgttgaggacgtggaggatgaagaagggtaagctgatgtcttgagttcgccggcttctcattcgagcagagcatcgattgatggagtagcacatcgaggaggcgagaaggtgatcctaacctcgttggtgtcttggggggagaggaagaggaagagggagttaattaggagcagcggactttgccaatgctgttgatgttagatgaaggcaaggaaaagtggcacgtcgaggttggatagaggttgggagaagtaatggcgaactagaagtgggagcattaggaggaggtgaagcagagcgataggtgtggaatagatctatttaagaggataatgtgtactggaaaaaaagaaaagaaaatgaggaatgggttatccacatggatctactagacctaaagccttcgccgtagtgaagctgggccaaaactgttcacgattttatttcatagcgcgcacctacaaaataggaatcttgtttaatatactcctttattatttatctgggcccaccttacaactcacttctaaacttaaccattgtgagaaatgaaaatagctaatgatcacttctcatggttccacctataatgactagttgagcaatatacattggcacattgcttatgcccgaaagcgcaagagactcgggcttgtttgggaaacttgaaattataagaagctgttggtatcaagtcaaattatgagaatctaaaaaagttaggtttcccaacttgtgatttttttgtccattttctggattctacgactacaatttcttagtatctagacgaaaaactaaattgattaagaaagccttctgattcggagagaaactagttccgtttgagaaagccctccatctcccgttgcaagttgtccccatccctggtgctcttggtctcttggcagctgtggaaggaacaaaactctagggttttcgactatgcactctcttcgatctcagtggttctggagtccatccactcagagggccatctgtggtctttagctggcattgccgcttttggagacttgttgggagtatagagtggctcggccccttcccgctatttggagtttgtttttagccgccgtagttttttaagctccagtttcttttttgcttttttcccccttccctttgcataagccggtttggctgattgcatcgtgcaactataactcttttcttctaatatattgacgtgcaattcttttgcacgttcgcgagaaaagctgtccccatcccattgacgattgggacccacatgtcagtatcccgtaaggcccaaaataacccatctccgtttcctacggcccattacgcagtgagcccacatccaaagcccacgacgaacaaactgcaccactcaaatcactcctctcccaaatccccgaccaaaattatccaatcttcacctcccacaccccgagctcgagctcgcacggctgccgccgccgagctccgcccgccgccatggcgtccg

SEQ ID NO: 41704 - DNA, 1501 bp, Oryza sativa
gcctcgctggagctggtcatgctactgcctaggctcgcaccaccgcatcttctcgttcttcctcgcccacagcgccttcgtcacctctgcgcatccaccaccaccaccacacacggatttcagattaccgtgtcaacaaaaatggcgaatcgaagcgcaagaacggatgggtgctgacattgggaggtgatgaggtgatagacctggatgaggagtagctccaccggcagcggccttgtcccctgcagcggcgacggccttgtccccacagtggatccggcctcccagcggcgcggcggcggcagatccgacctccccgcccacgcccgagcaccgccaaccgccacgcccgagctccgccgccgctaacctgaaagttcaagtgccattattttggttttgatgattaatgacaaatccaattacatgagactaacattgttataagcatttctttgtctactagtctcatatggatatgaaagtggaatatgtgagaggtgatttctggacttcatatgagttaagagaaaaacgttcattgatggtgtacctaaatcacaaggatgaaatgtatggagatcaagctatatgtaccactctttttatccgtgcacatattgatatatttatatataatattttcatgtgattacataagcatgtgtcacgccccgaactagccccaaacggaactagcccgtgacgctccaaattaacctgttaatcgataccagtcccaggaaacagtgttggtatcacaggaagacagaatatcacagcaacagagatctctttattacagagtaggagtacagtcatgttgggctgcggacagatcccgagctcaaaaaaaaatgcattacaaaagggaaagcggaagccaagacttggaccaatcatcataggcgcgacttgggaactaggccgaaaccctaaaactcatcgtagccgacttgctcctggaagaactcctcatcagcgggatccacttcatcttcttcagcaactggggggattatttatatagagcaaggctgagtacaggagtactcagcaagccatgggaattaagtgtttaatgcaggattcaaaggaaaggctgttgtttttacaattgattttatttaaactcctttttgaaacaactaagtgagtgcttctcaaacgacacggatgagacagtgcgtcttgtccggtcggagtatgtgcaatgtatcagtctttgaattggttcaaggttggcacccggccaacagctttcaaacggccacccgggcctggctgatcccatcagccgcagattttccaaacatcgaacccattccacaacagtaagttcacaagctgtagtcaaacaaaactacgctaggaatcacctcacattggcccatgaccgtgggcacggctattcgaacagtttaataacctctgcagagggggtacactttacccacatgacattactaacccgaatcacccagcccgtgcagaacggcca

SEQ ID NO: 41705 - DNA, 1501 bp, Oryza sativa
tacattgctgtcattcaggtaaatttgccacaatatcaatgactacgcaaacttataaacaaagatgtggaccaactaggtatcaaatgaaataaaccagaagcatcacataattatgtaaaatgctcaggctaacaaaaacgagaagtgaattcataaaaacaatccacaaaattgttagccatatcaaactttctgcttgtgtatttacagcactaaagttcagtgacatgatcagctgccggcaacaagaagtcacgcaaaattcatgaccatgaaggaaataacacattctgaattctgataggctgtgagcaatacagctgacagttcacaaagaaaaatacaggcacattacaataaacaaaggattgcaatgattacctgagcacggatgaacccagagagagcaaaggtggtgaagcggccatcgtacagcccattctcatccacatgcccaatgttgatctggaccgaggcgtggtccttggcggtgatgatcctgttcgtggccgagctgcggtaaaccaacacgacaagcattaagtacatctcaacaatcaatcgaattagacaaacaactcatcaggaatgacagaaacataccacttcctggggacgtagaggtccaccatctgaccctcctcgttctgcatggtggcggtggatgaagcaaacaccacaacagcgactgcaaagcaaagcaacaatacacacaaagattaggagaagatacatggaacaccaaaacttatcccccctcaactaaaatactcaatagaactaggcatacagttttagtttatctagctccatatcaatcaaacgggacgatataagcgacatatcatctatgtgtacccaagaattaggatgttaaccttacactagacctcgacaacgagaagtaaccggatctgagaaaaataaaagcacttccttctatccaattcgacaaactagccacgaatttaaccgtacagttgcaaagcgtgtactaaatttcatctgctagacatggaacttgaccaacaaaaacaaaaaaatgctactcgacatgataatgctaacacacaccgattcctcgcgaatcgcaatcagaagatcgtagaagaatcgtcctgctaagcaaccgcgcatgcgaatgggagaacaggaagcagatcgggaatcggggggcgcacctgaatctcccggagaagggaagcgagaccgaagagagcggcggcggcggcggcgtttgaagggggaagaagaacacgaggagcgagggcgatatatattatggcttcgggagagaaaaaccctagcttcggcgtccatgggcccaccgttattgggccacgttcgtggggaggcccaaaacgactcggccgagaaagcccacgcttcccccgaccggtttccctccccccgagtcgaggcgagctgagacgaagcgcggcggcgcggggaagcggttgcggcggcgaccggcggcgggcgggcgggcgggcggcga

SEQ ID NO: 41706 - DNA, 1501 bp, Oryza sativa
aggaaaatggttttacccctacgattgattaccgccagcaaaagggacgtatttttatggggcaattgcaaatttaccactactttgaatcgttattgcaaaactgccactagaaaattgcaaaaatgtcattagaactgtcattcaagtggcatccttgcaatattaaaaaaaccggtggtaaatttgcaattgcccctattttcattgggcacaggtcgcttggcgccacctttagccgtcggagaaaactcgatgtggccattagtagtgatggtctatcgatactttgcaatgagactgtcaccaaaaaatcatcggtagaaattgaaaaacattttcgctggcgcacatcattagctggacacgcgtgaagaatattttcgcaggtgactgggctatatttgtccagcaacgaaaacggtttcacccctgcggtcgattaccgccagcaaaacaaacgtattttcagtagacattggtcgcttggcgccacctttggccgtcagagaaacctcgatgcggtcattagagcaagtttaataagtttaatagtatagccaactactaactccaaatcatctatagccaatctaatagctcattcatacaatagttattacctactacctccgtcccatattacttgtctttttgagtttttgtttgtcaatgtttgatcattcgtcttatttaaaaaaatttggaattattatttattttgtttatcatttgctttattattaaaagtactttacatatgacttatctttttttatatttgcactaattttttaaaaaaacgaatggtcaaacgttacaaataaaaagtcaaaaacgtcatctattatgggacagagggagtataagtatatatatactacaacattgatatatatccaacctctcatacacacataatgtccgtgctgcattccttctctcttgttttccgttattgtactcgctattagtggtgatggttctatcgatattttgcaatgagactgtcataaaaatcatcatcagaggaagctgttgaagaacaaataatacaaccaccaccgccatgcatggcgcgccattgatgcgttcctctggactcctccgatcccctctgtttatccagctcaccccgtccgtaggaccccccccccccccccccacattgaattgacgggtcgccctccccgcacatgcatattccgttatctgtattatcctctcccggtgtccacgcgtgccattgcattgcatttcattcataattcatccattcattcggtcaaccggtcacacggtcccagaccctacctgcctgctgccgtgccactgaacctagctatgctttactgcagtcgcagccggcgatcgacagcagcgtcatcgtggtggtggtggtggcctatataaaccaaccacccccaccccagcaacgttatagcagtaaacaacatctctcacgaaaacatcgaaaaaaaccgtgtgagttggatggcgg

SEQ ID NO: 41707 - DNA, 1501 bp, Oryza sativa
aacccctccaaaagaacagagccgtaatgtcgcacaccacggaagagaaagggcaatggcggcggttgcttgtaaggcattccacgttgggcaaagggcgacggtggtcacgccgctgatgatggcagctagcagcttgtttgacgacgacaactggcagcttgcttaacgatagcggcagttggtggcttgctcacgacggtggattaaagggagctacctgctaggtaaaggcatgagtagaacttatctagaacatggaataagatagaacttgtcttgtgtccagaataggatttaacatatatttctttttttcaagcgataatgcttagtagaacgaggagatggggaacgagaaagaggagatgaggaacaggaaagagatgagtgtatgtggtgtggaaaacgaatggcaaatgagactgaggataattttctctaccccgatctaacgtcgccacctcaaaatacaacagaagtgctataggttaaagaaaaactggtagtctatgcttttggtcgaagaaaaattcttatagtaccaagttatttttggtgctatacatcgaatgttcttttaaatctttttctcctgtcatcaaactcataaatctttttctcggtaacaaaccaccactggatttggctaatttggctaatttcaaccgggtgacaagttctgtcttcaccggattcacccgggaacaagaaggatgatatgaaattaagtcaatgtgtgacaacaacatgaacatggtgagaccagcgagaaaagaaatgaaacgaacgtcaaaatggctaatgcagttgttagaatgatactaatgctttcatgcaaacgtttggatttatgtgtgaatttagatcgatcgaatatgaacaatcctatgggatttacgtttagatttatgttaccatgaacggtaggtactctgatatcctatgggatcgtgtgaattttctatatgattgtttcaaaaggtcttgtatgattttaattttaatggacatttttttcctaaacggacctttgaaataaaggactgcacgctattggatcatatgaaatccatataagatgcctcaatccatacatcatgttttcatgaaaagttttctttgagtctttttctctcctcaccatcctatatttttcctgcagtctaaccaagccatcattcctatatttttatgcattttgcaattctctattttaaacctatttgatttgtaggaaaacataggaaattaaagaattttaatcctatgggaatttctagggagaccttcaaacaaagaattgaacaatcctatagaaaatttctaggaagacgtttgagttctatttgtatcattataatactctgttctgcacatatatttttgtcaaaatcatgtattttatacaataccatagcatggaagataccactcgataatcctttcactattcaaattgtatttcaatcataaattttgaacctgatcgcacaatgct

SEQ ID NO: 41708 - DNA, 1501 bp, Oryza sativa
gggctctctcctgtccgtgcgcgtggtccagattctgccgtctgctccgcggggagggggggaggcgtggggttcttggcggttggcgcgaggggagattgggggggggagctcgggaggagggcggcgtcggcggcggtggcggcttcgcgtgcgtgcatggacatggacatggaggcggctaaggtgattctctcctctcctctcctcgcctcgctcttgttccctccctccaatctttagctcgcctcgcctgctgctgctgctttgcttgtccgcccgtgttcttgctttgaccgtgggtgggtggtttccttccgtgatcacgtcatcccttccccccgagattttcttttaggtccgtgctagtcgttcgtgcgggttcttggagcgccatggattaggcccccgttgctgctccgtgtcgtggtcgcgcgtgggcgtggctcgcctgggtatctcgtgctcgacgggatgcggccgccgcgggaggtgggattgggtgggttggtcgcgggtggtggtgtgttgccaccgtgcccgggccttagatttcgcggaatgcaattgttgaccctgtatctaccaacatggctcgaattttactcgtgttttgggttgtagctgtgtgccacgagaccctcgccgatgccgcgagcaatcttgataggttctagccatggtgcactctttgatgcaatgttgccagtgagcaatttgtgttgatgtcgagtaattcaatctgttgggtggctggtaaaatttcttttcttttcgtcaatcattctgcctgtgggttatgtccaacgatgaaccctactcagccagtggttatacatgacagacattgtgttggtttgcttcctgcaagccatattgctgccggcaatacgatgcgaatatgcgcacgagtctccgaaagctttggggctcggaaagtaagtttggtggtcgtctgctatgcggcattttgaatgcattatggatgtttgcattacaggggaactttgctgcaattgtgagagtagcaaggtttttccaaatgagttgtggttgctgggaaaatttaacccctttttataaagcattgttttctattatcaatctttcatgagaatgggtaacttcagggactttgtagaactgtagatacagttaggtatagtacattattgatgccatgtagactatgtttctgcttcagtttctaactgccaagttcataaattagtacttggtcattttctgttgcatacagtatattttagatgccaaaagatggtgcatcatagggaaaaatgtaagtatataagagttctaggagattagacttgggcttaaaaaggaagaagattttacatgcgttgaacttactgcagttagctgtttttgtttttccatgtgttaacaaagaagagctgtgttgatgatgcatccttctgattcataattcgaaagtacattgacaatttaattatttgtgctgatggtgaagtgataa

SEQ ID NO: 41709 - DNA, 151 bp, Oryza sativa
gcgagattggctccggataaggtattactcgttcttcttctccctccgccaccggcgtggcgaagattggagacgcagctcgaattaatagcatagttttttttcccaaagaaagcaaaattagctgaacccagatgcacccacactaggt

SEQ ID NO: 41710 - DNA, 1501 bp, Oryza sativa
attctttgctcctaggaggtaattttcacaaacgaacagaactcatcaaatgttaagtaagctgtaagccccaaaatttgctcaccgatatgactgaaactgcaaaaatgtcttattacagttttaagacctagaaaataaccttcagctccgtgatggaaacaagacgctgaaccagcttctctcacggtttcgcctattcagcggacttgacgatgaagttctggcggctgatgggattcatgatgaccggtggtccagcggtccgaggccaggcctggaacttggtgtcggtggctagccaccactccttctcagaaacagtctttggaatgctacctgtttacaaaaaaaataatgcagctttagatacagacaagaggttaagcacaggcatttccgtaagaggacagtcacctccaaatgccttcttgtccgaaacaaatgtgtcacacaggtaagcaatggcaaatgatccaaccagggaaccggcaatgtatccagccgtcattgttgctgcacaaccatgaaatggaacaaattcatcaagactgataaatactcccaagtgttacagaaagtttctcatttgaacaaaagattgaataacatggcaggctaaatagaaaataagtcccccactaattgcagaaaccattgcctcaccctataacatcagattcacatgaacacaactatacagataaacaagataaactccagaacagagaaactcaatcaatatcaaaaaaggaagagagctgaagtggaaatattcggtgcaggcagttatctgtgacgcagaaatatgcggatgaatgtccagtcataagctcacattattagtgctaaatctactacttgccctcgtaaaacatgtgacgttatgtatcttcctattgctatttaccgcaatgatcataaagctcataacaaattagtgaatgtagatggagaagtccgaaatgaaagaacaaactgtacctcaagggtttgggttcgagtagcaggttgatccaaggaagggatggttgggcaaaatttctaacgaaaaattaccagtattttcaacccgcagtgcatactcaccaacaaatctggccgttctaactcgattcaaccgagcgagccattttcactagatctagccaattcacacagggcgcgcagacgagagatagcagaaaaatcaaaaccagaacggagaaggtagggaggtagggggcaggaggcggtggtcgaaccttgccgcgccggaccaccgatcgccgtgctcgcgtcgtcgtcgtcggaggacgagaagccctagacgagggaaggccgaggggaaggaaatttttttatttttaattttttttattaaaagttttacaaaaataatttttcattttgaaaattgacagaagtggtcgcctaccgctctctgggagggcgatttttaaaaatcgccatcccagagggcagcgaaagtgacgtggcagacggccgttcgctcttgggc

SEQ ID NO: 41711 - DNA, 446 bp, Oryza sativa
ttaatctgggggaaaaatttctagaaagaaattacattgtctacgcttcgacaatatagtttagaaggctgggtatgcctttcacagattctagctactactgattattcagtcagtttaggtgaaaggagcatatgtcatgctattgcaggttcatggatgtcttctttcttagggaaccgctattgtatctgtttttactagtttgagtatgtaaaattctgttagttactattgctaccctactagcgtcatgtgtctgacaatatagttcacaaaagaagctactttctgtttctgaattctgactttgatgtcctgtgtatggccaatttaatgtacaacaatatatgtagtttcagtgccttccatcggttggttccatcatagtcactgctccttcctttctatattccaactactttaatgatatgtttgtttacagg

SEQ ID NO: 41712 - DNA, 1501 bp, Oryza sativa
tcaaaatgtttagagacggagggagtataaaagagtgaagtgtataaaaagttctagcacaagggactaaaaaataattttcatatatacttgaggtatcaaaagttgtgatagctctcgtcgtacctatcgaaggacgtaaaatcgctcaagatttttagaccttggtttgagatgtgtgtagtcaagtatgagatcaatttcctgggtctgccaacctgagtagaaacaaaaataagcagaagatgaccggccagcccggcacatcaatcaaatttaattaaacttatatttatattttgtgtgcataaagatttttttttaccttctctcttgagatatttgtagccacatatatgaaaaaaaatcactcgatccgcaaccatagattgatactctcttcgttcatattataaatttattttaactttttttaattattatgttttaagttctgaacaaatttatagataaattagcaacatctgcaatattaacttagttccattaagactaccatttaatatattttgataatatatttattatgtgttagaaatattgctatattttttataaaaaatcaaatctacttataatatgaaaccggaaatgccagcgatcgggcgctcgatcagctgcagaaaaatcatgcgcccaccgcttcccgcgcctatgcacgcgcgctcccgcgcctccgtgccgtccccaccacgcgtcctaccatacgcgccgttgcaacaaatcacccacatattacggaaacgctctgttaagggaatccgtttcattttttgttccaccaacaatgtttcaccaattgtacttgtaatgttttactatatatgaatcaaatgttgcagtgaattgaaacatcctttcgctatttgctgaaacattgtttttatgtagggtgaaacaacactcgatttttttggaaaatgttgtttcgtacgttgtagcaaaatgtttcacgaggtgatttaatttggttgtgtttcagctttttaaaatattgaaacaatttcgatctgcttggtgaaacaatttcgatatacttggtgaaacaatgtctgatttttttttaaaaaaattggacgtccgatttataggtggccccatatgaaacggtaacggaggggtagtataacaaaggggtgtagctatatttatggcgccatatttttcatcaaaaaatagtcggcatgtatttacattgtaagtccctaaattacatatgtaattttagtgtatttacaatgtaagtctcaaaattacatatgtaagtactaaaattacatatgtaaattcgaaaattacatactaattacatatgtaagtgaggtgtaaatgatatgtaactactgtgtaagtggctgaaaaaaatcaactagcatatagcgccatatttctagcaactccgtaacaaagagggtactgatcgggaataaaaaggggaagcagctgactggccggccggctgcgaggcagttagctagct

SEQ ID NO: 41713 - DNA, 515 bp, Oryza sativa
ggccgacggcccatctagagaaaaaggaaggaaaagaaaagaaaaagaggggaaggattttcctgggattaaaattgcactttggtgatttttaattggttaaaattatttccaaggctctgaaaattccactaaaaatcttgttaatgcattggagcatggggaactcaagaaaaattccaccacgccgaattcaattattaattgcatttattaattagggaattagctctaggttaaataagataatttcttcggacgatttatttagccaatttttaaagcaaggagagggggaaacttcagggtgtgacaaacttcagggtgtgacagtgtgaccgtcctttgtgcgattgtggggatggatgcatactcaagtcttccctcatgatacaaactcggggcaggagattcttccaatgcgtgaactttgatcaggtatgcttcatctattcgaagttcaaatggataaaaaaactaacttcttcgtacacaattgtaacatcttacgcaga

SEQ ID NO: 41714 - DNA, 748 bp, Oryza sativa
tgtgataatttttcacgctattgttgtagcaaactgaaacatatcgctaatgttgcatcaaactgatagttttgtcactaaagttgcagttttctgaaatttactcttagatatattataaaagtaatttatatttttttcataaaaatatagtcatatgagatcttgttataaatatttaattgttatgaacataatggtgtaatcggatcgtaaatcggataagtaatctaagataaaattccataagaagaaaaaaaaatacatgcacttttgagtactccctccgtcaaaaaaaagacaaaccctaggtttctatgtccaacgtttgactgtccgtcttatatgaaatttttttataattagtattttcgttgttgttagatgataaaacatgattaatactttatgcgtgacttgtctttttaatttttcataattttttcaaataagacggacggtcaaatgttggacacggaaacccagtgtttatctttttttgggacgaaggaagtatactagtagcaactagatatgagattgaggtagttggttatgaccatacagagaacggtctctgttgacacgtccattttttaagttgagagacatatttcatccgagtttttaaattttacccgaatttgtgggagaaaaactaaaccagagtgaacaaacgagacagagattcccatgagtgaccatggcgacgaaatgacctgccgccggcagcggcggcggcggcgga

SEQ ID NO: 41715 - DNA, 796 bp, Oryza sativa
attcgcccatccatcttgctggcgccgatcaagaccaccttgaagtggcaggaccggaagccgccgccgtgcacgtggccgtcgtcgccggcggcacaaagcaccgcgccgttcatgacggatctctccccaccgtcgagctcctgcggaacggccacgcggcggcgatcgccggaaacgggatcccacacgaggaactcgcaggtgttgtagttgaagatgaggacgaggccgtggcggcagccgaggaggctcgcggcgcggtagtcgtcgagccgcagcgcgaagcggtcgggcgggatgagatccggcgggtcgaggacggatctgaagacggggtggtggagctcgtccttgaagacgccgaggagggggggatcccggtggcgggcgcggaagcggcggaggaaggcggggtcggagacgaggcggcgccactgcttgcagacgagggaggcgcgggggagggaggagggatgcgaggggaggcggaggaggatctcctggatgaggtcgtcgttgtccggcggaagcaccggcggcggcgccggcgccgccggggatgtccgccgccgccgccgctgccggcggcaggtcatttcgtcgccatggtcactcatgggaatctctgtctcgtttgttcactctggtttagtttttctcccacaaattcgggtaaaatttaaaaactcggatgaaatatgtctctcaacttaaaaaatggacgtgtcaacagagaccgttctctgtatggtcataaccaactacctcaatctcatatctagttgctactagt

SEQ ID NO: 41716 - DNA, 1501 bp, Oryza sativa
ctcaccttaaaacagtggccctaccatgcatgttggttgcaatccaagttgcagttgtccaaattatcggcttttcaagatcatgttttgatttgcaatccaagtaagacttctgagtctaccttggaattccacaaggtagactgattttgtggaatattgcccattggacatccacaacatactacataggcctcatcgtcaggctgaagataaatgctttgtatttcaatccaaatcttgacaattgttcacacacttgctgggttatgtgaattctcctcacagaatgcatccaaatattattttctagttctttttgcatggctctatttttttctgatagctggtaagaacaataggcaacaggtaaagaactttgttctgggtggataaatggatacggaagcaaactcctgctgatgcctgatagctttcctaggttatataagataacttctaacaaaaagatctaaatggcagaggtgatgaattgtaacttttggaagaacaaggcttagaagaactcttgtaggagaaacccagaaaatgtggattgatttgatagatctttgttctcatctaaacttgtcagaaattgtggattgatcaaaattttcctctcgttgttctgcttagtactggttggaaaggtgacaaagatgtcaaatttatgggacagatgaaatcattgactgtcttctttacctgttctttggcagaatttgtgtggagggtggtttgtaatatctcttccacccctactcatagtgatcaacttttttaatgcttggctgaattcttctccaaatcatgccagataccttttttatattggagatttggagtgacaaccatgctgtggtcaatgcacacaaccaggaataatgcttgtttcagaaccaagtttttttttttttttttgaccagggtttcagaaccaagttgatttgtaaacgcactgaacggtttatatgatgtgctgctgactcactcattattctatttgcagacaaggagatagtcagatagacaaaggaacatatactctgctcccaactactagtcaacattgactggtattgttttcactttgatcgccagtaacttttaaattagtagatttgatgagcaaaatttgtttggttttattttacatgcagcatacttttgcaatatggtatatttaagaaatatgctgaaattaaatatggatagtttgtatgtgttttgtttatatatatatatatatatatatatatatatattatgatttgtcataagtgatgatactatacttcctaattgttactaatcggcatgtgctttatagccagtaatgaaaagtataaacatgcaaatctggaaatgcttagtctttatttttgaagagaaaattctggttcagatagagccagcttgcgtgaactgccttcagcacttgttactatttttttgttgagttgtcattgactcttatagctagcttctttttcacctc

SEQ ID NO: 41717 - DNA, 732 bp, Oryza sativa
aaaatcttaccacttctagcacaacacctaacacaacaggggggtgtctagaattatgagcataaggattaaaacctaaaccacggttatgtgtgctaactttagattgatccaaaatcatgttgaggttctttttaccatcagaaaatctttgcaaagaatttttcaaataagaaacctctttttctaaattagcacaattttcacaatctaccatgacacctttgcttttacgacacttggggcaagaaagcacttcattgtttttcacaacatcttccatttattcaacacgacctaaagcatctttcaatttcatcttattcaaattgcatgttgagcaatccaaaacatcatgaggttattttaactttttagcacaaatcatgttaaacatcaaactagcatgaaaagcaatttgatatttttgcaacaactttttagttaaaaacaactcatccaaagtgcgtgtgtgcaaagcaaaactacaagcaagagaagatctatttttcaaatcatgtgcaacattaatctctctaatttttgaaatatcattcattaaaacctcacaacttttgcaatcatcatcattaggaataagagattttaatctagcaatttcagaattaagagattcaatgataaattcctgttttctatacatcttctcacacttcatattttttgcactcaaaatattaatagcttcttcaaaagcacttacctcatgat

SEQ ID NO: 41718 - DNA, 1501 bp, Oryza sativa
ccttgtttatctgaaaaaaaaaaagacataaccaaagctggaaatgactaaccccacaccagcacaatcgcatccgacaccataaacaagctaccaataactatctccagcaatgtaccgaccaacagggaatggggatcgcttgtctactacatgaaccgatgaacaaatcgcaaccaacctccagtaatcaaatcaaccaatacttgatgaaacaaggaaggtcagaaatcagagccacaagagtgcgcatggtcgcgtatcgtgcgcgctgaatacctctcggatgagttgaagcagcgagtcctcgcaggagcgggaggcgtccacactaagcacccctccggccgtcggcgtggcctcgtagtcgccatcggaggcgagggagacgacctcctggaggcaccgcagcgcgacgcgctcccgcacggcctcgggggcgcccgtgagggaatccggcgagacgcccaccagcgctgcgcaacaaccctaggtggtgagaggaggaagaaattgaggaggcgagcgcggaggaggaggagggggaccccggcgtgatgaaccctacccttggtgagggagaagtcgagggcgtcgtcgccggcgagcgcgtcggcggcccagtaggcggcgtaccgggaggcggagcggcgcggcattgcggtggtggcggagtccggccgggattcgggaattcaaagccggcaaatatactacccctagaattaaaatcaaattcgaatttaaaatcaacgctcaaaatagaaattttaaatttaatttttggatacgagttattaataagttaaagagcatatgaatatatgttggagctaggcggagggcgacaagtattggataggtataaggctgtgttctttctcatgggttcccaacccatctcttcgtggagggtcgggtagaagaaaaaggtagagacgcatagtaaaatgagtttgttgttacaatagaaaacagtgatttgcatttttttttcattatagcttacaatttttttgactggaatctcgtagttacaattgtgtataattacaattcacgaatcactgtagcgatcgatctcggtcgttcactgtgaaacggacggctaaaagcctgaaaacacctcaatccgagtagaggtgccacactgatgatatggataatattatattggagtataattacgaatgtcattagataaaccaactttgagttgtattgtcaaaaaaaaaaaactttaagttcgtaagagaagaactgaaattccgtctaattttctttgtttgatataccttgatataatcatgaataagtgaaagaaaacgaagaaaagaaaaaagaaagagaaaaaaagtagtatttgtaagtagcaagctcaatgtccgtcattgtagcccccatgtatgttggctagacattgtatatggttgggaactcgatattgagttaggacagcgatggaaaaaattgcaagaaagacggtaaattagcatcaaga

SEQ ID NO: 41719 - DNA, 1501 bp, Oryza sativa
taactgtagttttgtcttgaaaggttcattctcaatattattattctttactatttacaagtgtacaaattaattgttaaggttatatttaagttgtttttgctgcccaaaatgactacattttgtgacggaggttatgctagaggaacaaatcattctcttttaccaaaagtgttacgggcattgggccaggaggtcatgtccacgaccaacccaagatgaagcgcggtactgtagcagcggtaccgtaccaaatagaattaacttctagagatgtatctggacaaacacttgtctagatgcatctctagaagtttgattttttctgggacggatggagtaagatacaagtcgcccatctacaaggatggattgtatctctgtttggttaagcaatgcatcaagattagtctaatatcgctcaagttctcctccccatcctataatctctcctcatcccatctaagccgacgccgtccggctattttcctagctatatttccccaatgaaaccttgtgcataacagttgatatgaaactgttcatgagtacttctcaccttgggttggtcgtgggcatggcctcttggcccaatgcccataacaaaaagctatgttttatgatgaagcaaatgctatgttaaaaaaattgtgcttattatgatttattgatgtgtactgcctgtactgatggtgaagattaaacaagtcatagaggtctcgcctttcttttttcttataacacttactttagagagtgaaattgaaaattatgaactcgaatgatccaaaaatatctaaattataacagtttgcttaatttattctcatgcatgcggttctgtggactggataaatcttagactcgtagtcctaatttggtataggatgctgggtggtaaatttgtattatgtactttcttgatatttcttcatgaaagtgtatatttgtccatttaattgctgactctctgtatgcacatttgactagtattatttaaatggtcagttttgttttgtggatacagagatgccatagagtgactatgtcacttcttgtaagggaagagtacagtaatgtgactatggatgcccttcatttgagtttgatggtttatgacgtatagttgggggggatttggcctgactttgatgtagcatatgacctttctctaataatgaaggaaaatgtagttttttgggcacaaggcatggatttattccggtgattcatcactcatctagtcatgcataattcgtatgtagtatttaactttcgagagaatctattctatatcactgagtttgttcgagttcaacgatttgccatcgacattgtctctttctataatataccgacgacttcatcaattgttctacaatatgccattgggctagacattcttttcaaaaatacccaaaatacccttatggacatacaaggttaataattgatttatcctattaaaagtttttaaaaaaatgaaaacttttatatggcc

SEQ ID NO: 41720 - DNA, 352 bp, Oryza sativa
cccaactatgcaccggcgcaacatcccatcgtccgtaacgcctcgtgattcgtgcacccgaactacagctacaggtgtatatggaccaagtttacccatgcggggacggatgcaacaaccatttcacggcgcggatattccgttcttccgtggaccctcctcatagaccggaactcacttatacggtccattccgcctcgagattcgtgtaagtcggtttggggtctatgcaccgggtccacgcaggagtgggggcctccgcttcctctagtcgagacccattacctacccgatcttcctcttctccgagcagcgacctcccaaaccccagccacttcgccgccgcagccgc

SEQ ID NO: 41721 - DNA, 1501 bp, Oryza sativa
gtttggattcaataatttgccttcgatattgtctctttctataatataccggtgactttattaattgttctacaatatgctattggactgggcattcttttcaaaaatacgcaaaaaaaccttagatacatacaagattaacatttgatttatctaattagaagtttcaaaaaaatatgaaaatttttatgtggcctcgttacacaagtatacatgctttaattttttctagtatatttagattttagaaaaaaattttgtatgtggtatataatgggaaaaaaatatgcttatacgagggataataacacaaaaaaatatcttatgtagtatatgaaagatgatttatattaaaaacatcaataaaaaatattttataaagcatataacagataaattatatttttttaaaaaatataaatgtaaaaaatgtttcaggccatataaaagttttcatttttttaaaaacttttaataggataaatcaattattaaccttgtatgtccataagggtattttgggtatttttgaaaagaatgtctagcccaatggcatattgtagaacaattgatgaagtcgtcggtatattatagaaagagacaatgtcgatggcaaatcgttgaactcgaacaaactcagtgatatagaatagattctctcgaaagttaaatactacatacgaattatgcatgactagatgagtgatgaatcaccggaataaatccatgccttgtgcccaaaaaactacattttccttcattattagagaaaggtcatatgctacatcaaagtcaggccaaatcccccccaactatacgtcataaaccatcaaactcaaatgaagggcatccatagtcacattactgtactcttcccttacaagaagtgacatagtcactctatggcatctctgtatccacaaaacaaaactgaccatttaaataatactagtcaaatgtgcatacagagagtcagcaattaaatggacaaatatacactttcatgaagaaatatcaagaaagtacataatacaaatttaccacccagcatcctataccaaattaggactacgagtctaagatttatccagtccacagaaccgcatgcatgagaataaattaagcaaactgttataatttagatatttttggatcattcgagttcataattttcaatttcactctctaaagtaagtgttataagaaaaaagaaaggcgagacctctatgacttgtttaatcttcaccatcagtacaggcagtacacatcaataaatcataataagcacaatttttttaacatagcatttgcttcatcataaaacatagctttttgttatgggcattgggccaagaggccatgcccacgaccaacccaaggtgagaagtactcatgaacagtttcatatcaactgttatgcacaaggtttcattggggaaatatagctaggaaaatagccggacggcgtcggcttagatgggatgaggagagattataggat

SEQ ID NO: 41722 - DNA, 1501 bp, Oryza sativa
aagacgtaatgtgtgtatgacaggtgggaccaggtattaatagtatagtaagcaactattgtatgaattggctattacattggctatagacgatttggagctagtagtgggctgcactattgaccttgctcttgtacagtatgttgtctacatagggggttttgaactttatgccactctcgctctcctacaccgataatgttttatcaaataccaccttcctaaaaatttttgattatttaccatctaaatccactaaattatttttattgtgccattgttgtgaactaagtcaacaaaccaaaggataaatgaccattgcccttatcttccgtgaaaagagattgaggaggagcttagcctctgggtggaaatggttgccctcccgtcatagccacttcgaacgagttaaagccacactagcaaccccctcccttcttcacccctccgaacgagctagagatggtgtatcctctgtgactctgtcgtccttgccgcaccagaggtaatcgaggatgagccacgtctagcttaaaatgtcgatctggacgttgaccgccacgctgccaactgatatgcttttggttgcaacactgtgccactttgaaggcgccatgcccgtttgcgacatcgcgttgccacccaatatagagtcatcggagctcagttcataaccactggccaacatgtgacgacgtcgttccttcgtggcttctcctccatgaattgggaagaggaagaagataagggcacctaggtcatttttatccattctgcttagtttgctggctaaaatggcaaatttgaaacagcttagtcatcttaggtggcaaataatcaaagtcttttggaggagtgacatttgagaacatgccatccgggagagtggcataaattttaaaaacccgtatgtataacactagtactagatcaacttgtattcacttagatgtgatacctaaccttatgtttcatgttgacgttaacattatgtcactaaaatagttcgatttgagcttcgtatatcggcaaaacctaacagatataacatgttgtacccctcacatttaaggagtgggcaaggaagtcaccaaacctccttgtcattagactcgtcacacactcataactcctcatcggcatgagcattggctctctccttcaattgagccccatccctcttacaattgttgttgcctatatcagaagtactatgtcaccagattcgacttctatttcttttctttttgtcattgccgactgatgcttaatcacattgttgcgccccttcttatcctcttcttgatgctaatttaccgtctttcttgcaattttttccatcgctgtcctaactcaatatcgagttcccaaccatatacaatgtctagccaacatacatgggggctacaatgacggacattgagcttgctacttacaaatactactttttttctctttcttttttcttttcttcgttttctttcacttattcatgattata

SEQ ID NO: 41723 - DNA, 1501 bp, Oryza sativa
tggccagcaacaacacacaaatgttcgcttgcttctacacatcggagaccggcagatggagcaatctcatcttcactcctgctccattcttggtctttgcttttgttgatcctggcatactcgttggccattccctgtattggttccccactggtcttggcagtgccattcttcagtttgatttggataggcaaacccttgctgtgattgagtggccttccaatccaaattgttatagccactacatgtctcagatctttctggcagaaggtggttatcttggccttgtcactctgtcgtacgacagccttcaaatatgggagaggaaggtctgttctgaaggtgttaccagatgggtgctgcagaggacagctgagctaaacaaggttcttgaactgggctctggggtcaagacaagtcatttagtgagattgggttatgctgaggatgttaaggtgatgcttctatgtgctgattccagtgtcttcatgctacaaattgattcactgcagtccaggaagctttgggaaaccaatattatgtcctcgcttcatccctacgcaagtacttatgttgcaggtacttatgtttttacaatgcagtaaaattaggtgtgttttcagcatttgactgcagaacagattaattcatccgacatatcaaataagtaatttactggctcgtttcagagagtgacactattttttttcattcaatacctgtttctgcgagatgaccttttagaagccttgtgttgtggtccattctttttttcttaattttgaacattgaaagatgtagaagtatttactatttagattggccactgagaagagaaccacagttagatttgtcttggaaaatactaatatagtatttagttgtcgactctaatataaggaaactaatgttctatcttgtctagagactgtagaatgtctggagtatcactacaaaagaacaaagggaatacttttttttcttcttagtcctgctgcaagcaatgtattaatttgcacaagaagaaatcactatttatatattttgtattggtcaatgaagttctattttttactagattatgttagcttcaggatgtattactctagtccatttacatactagtgattacttgcacagaataattttagataacttatgcaccccctagttacaaggtttatgaatatactgtttggaggaatattgcttccttttagaattttattcagtttacatatatttatcttgtatgtgtgttttttggatatctggagcctttattattttaggtgctagtgtgttacacaggttttggatggcgatttgtgattacagaagtatttgtctgattatgatttgtcagatgtccactaaatttccaaaataagtgaatttcactttagacacatttttattaccctagctgcagtattactaactcacaaaagttcccggatcgatggatcgaggaacgtgggacgtcattttctaaaagcat

SEQ ID NO: 41724 - DNA, 1501 bp, Oryza sativa
tccggccgatccaattctacaacaagcttgcagttgatcattcagagtcccatcaacatcggctagcctcaacgactacatcggatccttcagccgattctacaccaagccatcggctatcgtttatgggtcggtacacgcttttggcacacttgagactagagcctacaatcatcatcaacgtccgggtctccaattctctaacagctgattgttcaacttatcgtctaatcgctgctacatcgacatattgtcagttgcaggttcagactgactggcatgtctatacctcatcaaagtttaggtcatgcactggagctaaacagatatcctaggccttcatgttttttcgcatgaaagggatgcaacattggacatccgaggacatgccaaaaaagtacgaatatggcaagccgttcttaccatggcttgtcatggaaaatcaaccctggtagatgaggttgatacatgattagtacatgcgagcatctagaaagggttgatgcatgattggtgtacatgcactacagtgtgaaggtccaaaacaaaaatcacaaaaaaaatgccaaaacttcaaaaccctagctcaaatccactctagtatagacactgtcattgtcgagactccgccgcgcccaaggctgaatccgcccctctcggggccggggtgttaaccccaaaatttgataagattctttactaattcggttaaggaatgagaacaattaaccgactgaaacttatccagaagagaccgagttcaagaaggaatcgtgaagactctcgcatgacggcttaattctatctattaatttggcaagatttagtaatttcgttctatctttaggaagtgtttatttagtgtccgatcaggacttgtatatttccttttatctataagacctagggtccctataatctatctctcgatcaaaacaactactctcggtgcatcaccatcttctttcatgaggtttttacttatcaactggcggagtttggcacctgacgcgggctgcatcggttcagttcgatcttcggcgaaggggtaagtcctacattccgccggcggttcattttgatcttttggatcgctctggttcggttgatatatttgcgtacctatttatcatatatcttagttaatttaagtcaattattcaatttacttatatcggttagatcttttctagggttttgccagtatcggctaaattgtttttgtcaatctagattagctaagatatccaccaccctgaaaatcaatcaaaggcttgattgtctaatattatatttttttttcatacttagtgctgtatcaattgggtttgacctcctaagttgtgcttaaaaccataatctctagcctgcgttttgattgacaataagggttttatcggaatttcagccaatgagttatctgaacgttgcatcggcttataaggattacaacaagttggttttagctagttgcaataaaagttttattaattatctaatc

SEQ ID NO: 41725 - DNA, 1501 bp, Oryza sativa
ccgccggttgccgccgccacaatccgccgccgtcgcactccctccggcgaatccgagccgttagctcgtctcctctagtcccgcgctacctcccggtgtgttcgccctcgcccgcatccccgtatatcgccccgccgctcgccgccgccatccgccgtccgttcgcggccgcgtcgtcgtcttcctctcgccggtccgcgtggcagccacgtcggcgccagctcggccaagaccgggtcaagcagaccacggccccccgctccccttcgccacgctcgcgcgcgcggtccaccgcgagccgtgaggctgcgcgtgggcccgccgcatccgcatcccaccgcgagccgcgcgcgtgcaccgcgccccctccgaaccctagcgccgcgtcgcgtgctcctcgctcactgtgagccgagccgccgacaagcgggtctcactcgggaccacgcgaggtggacccagcccaccggttccccctccctctctccccgcgcgtgccctttggccgccttctcgggccggccggcccatttagctcggccaagccgcccttttctctcgggccgcgccctagccgcccgagggaagtctatttcccctccctctctcttttctttttccaaaagggtttaattaaatcctttgtcctttagaccaaaaatccaataattttagaaattcaataacttctcaaccgtacatccgtttgactccgttcaacttccaaaaatcctcaaatctcgagatctatctaatggcacgcctataggtcaataatagggttttattttcgccatttgttgagttgtcccgtttcacgtgtagttttggagcccgaagacccgcagtgcgaggatttcgaggatcaagctcaagatctcgagcaaggtaagtcacctttgatcatcttgcacctataatttaaatctaagtatttcttttccgcaaatattgcatgaataggtttaacacaagtaattcggccgcggcttgcaagatagcctacagaccccaatcctaattgctgcaattaccctccttgaattattgaacaattaaaactcctttgtcgacttttgtgcttcgatgcacgggctttcgggcacgcgcattgaaacacctcccctcaaatataaaatatccaacaatgggtaaaacttggggttttacaaaagacttagaaaaacctgacacctgggtcggtgtttgcgaactaaatgaatttccaaaaccgcagaccgggggacgtaccgggagtacggtttcccgctcttgcacttaaggaccgtttccttggaatttcatccgaacataagacaagtgcgaccacatgggtgtaatggaacgcccctggctgagtaattagctaatcgggggagccatgatgccaagagacatgtggattcaacggggtggtgccggggagaacccccgggtttcctggcacagtatggtctgggacctaacctggtgttggtctgggacccctctcgttggcata

SEQ ID NO: 41726 - DNA, 1501 bp, Oryza sativa
gggccgctgttgacgcattgaccgaaaaggagttttcgtgttacagccgagtatatatgaacctacagggtcgcacgcttaatgggccggaacatggggattggatagagatccaatatgagcttaattcggatatggatccgaataggagtcctacgggccttggaggcaagagtgatagatcctatatattcgtgaggggcgtgaccagcggaggcattgtatcacgtgagaaaccctagctaccacttccctccccgagcaaaaccatagccgcgcgcgggtgctagcacatctgcgcgtggcgttcagtccttgtatgtgtggataccggtggaggtgccgttggtttgcggtgctgatcggcgtgggagtacggcgaggagaacgcatgaggaggagaaggtcgagccggtgcgatcgactacttcctctacatcgacgcgcgctactttgcgagagttccttcgacttctcagcgtcttcttttgctgcacagcgcgtcgagtggtaacgatctatgatctaatacttgcatggttcctagtttacgcaatagaaaattttgatttatgctatcgtagcctacgcgtatcccaaaagtggtatcagagccgccttgtatagtttatgatctagatcattgcatatagttagtatgcgggtgtagtagatgagatctattatgttgtatataagtttttaggtgatcggaacatgagatgaaccgatagacgcaagggttgatgagatcaatcggtatgtgtgttggtgacttcactgaaatgtttagtactcaccaaggccgagcgcgattgtgttcatcggatagtccgatgtccactggaaccgcacgccaatgagaaaaaacgaggcaataagattgactcagtttcggcataattcgattacgccgttaaagttttcacatagcgggactgccgtgtgcgttgtcccttagatttcgcttggggtttttatatctatcttactttattgctgttatatatttgatatgacataataggatagattccctcagaaaaattaagtgtaatgtatgctcttccaataattgcacctattacggttgtgatcataagtgataggtttgccatagcaaagtgtcactttttatcatgataaaataggatagatgtcggatatctatatgcggagattattggtttacttgacaaggttatcaaaacagttttggaccttggggcataggttgggttggacatggagatgtcaccccaacagcacaagagtcacgtatgatgtgattagcaaggtgttgcttacctattttgatagttgtctagctgtgataccaaagctcactagacactaataaaatgaggatcttggctcactatgttattagagggaattttgtttcacaatacatagtgggagtatcttttgttaaattgtttaatgaaaggttaaatgtaaacatggtgctgattttgcatacatatatttctattgtaga

SEQ ID NO: 41727 - DNA, 1501 bp, Oryza sativa
ggtttacgcgatagataattttgatttatgctatcgtagcctacgcgtatcccaacacgtcggtccagctcctcgcctcctcggtggatgccacacgcggtagatgggagggagtaaatgaggggaagagagagaggggggagaagagaggggtagtatagtaaaatgtgcttttttggtagggatactcattgggctactaggggtatcctacattgtgacttgtgaggggagtttcctagagagtactctcagttagtgagggcacccatagagtatccctgattggtgatgcccttagtactaagcagagcccatgttatttaaaaaacaagtaccgtatccccactctcccatgtatataagtaccgcatcctctctctcatatgtactccatccgtttcacaatgtaaatcattctagcatttcccacattcatattgatgttaagggtatccataatgtagtaaagaagtgggtattagggattaaaatattcttactactaggtaagatacattgtggaaatagtaaatagctactaccaagccataagcttactattaggttatagcactttgtggtgggtcctacctattttttaattgtggcatggctcatgtttggggttatttttcagatgggtcccaccttattacccactctacacatatatacattgtggtgcatcttcaatctactattaccatcttacataggcccaccttactacctacttttgcaacatacattgaggatgccctaatgaatctagatagatgctaaaatgacttatattgtgaaacagaggaagtatatcattttcaaaagaaggcaccatgcagttcataccccattgcactggtatttttttaataaaaccacttatattttttaaatcgtatgttattttaaagatttgtttaaaccattttactccactcaaaacatgtaaaaaaacaagtctaatattaaatatattttgaatagcaatatagttactttaaataccatcaagagttagtaccgtgaagagtacgatggctcaaacggaatctaaaaataatacatggtttaaaatatgttatatttggtacatctagatttattaatattaatattaatgtgggaaattttagaatgacttaaagtataaaagggagggagtattataaaagaacatgtctacttcaccgagagaaaaaaacaacacgagaaaaacctggcgagcacaccaccaccgcatcaccggtccaccgctcttgccttcccctttcttgcagtgcaggaaagaaccccacgccctcatccaatcccagccgtccatccaccatccaacgtctctcaccgcgccgctcacctcctcaagaccaccacccaccactcccctcctctctcctctccattcctcctcgcttcgacaaacaaaaccccccaaaaccctagcctccgccgcccgccgccgccgccgccgcgcaacccccgagctcgagcggcgcga

SEQ ID NO: 41728 - DNA, 1501 bp, Oryza sativa
gacttgtccggctttctatggagttaatcaacacctgatatgttcagaattgcatgaaatggcaccccatgaatagctattgttggaatgcctggctgcagttacctcagcatatttacacggtgcaaaagagatgggtctactaagtctgcgtgagctccataggaactgggaccggcttgcctggtttatgtacatttagaggcatccagcgctttttcatacaaataggatcaccacttcggattaatcttatacgttttggaggcattcagtgtttttttttttttttgggtacagtttggagcatcttcgattaacctgttccttttggaagcatattgtacagtttagagcatcttcttggcagttggtacgcaattactgtgtgaacggatccagctgaggtagaaccggattttcatgcgtgatggtttgaactctggcaaccattctgctgtaggtaggcaaatgtgttttatcgggaacatatgggctccatatcaagcattcccctgccatggttctatagattaggtgaatctttgactgacgcttacttatactaacttcgaagcagcataataccttttattggtgttactgtggggcactgatgatgtgccagcactcaagaacaattttgtaattggtaattggtaagttccacctgagtataaaattctgaaggctaaatggttagtccttctcgtctttccatgacatttggtacagtcttgagcaggggggatgagagaaatgagctgtgctaaccaagataagtattctccgtctcctcaagcaggtattggtatttttgaattagcaattacaatattatcatcatcagttcatgtctcctgctttaagcaaagcatatatttttcatttcattccgaccttataattgcccacaaaactatcgtagactgacccgttatttgaaagctaactattttccctgtttggagatgctgcctgaatttccacttatttgtgagcaacatatgcctgcagataaaataatataaaaaggtatctatgctcattaattggtgctgaattgcacttatgtagacctacctcttggaagcctccccctagtacagttttcttagtacaggttaagattgaacttggctcataacagaaatcctctaacaagctttagccaaccttatacttgattgatttgtcctgcttcgcatttgccacgaagtgtgaaaccctattgagcatactggaaaatggtgatactccacctattaattactccctcccccaaaatataagattctagaattgagtcttgtccagaatcatagtattaggatgtcttatctggacacagattcttatattttgagacagagggagtagtcatgaattgccccttacatgcgcatagcttctgaaattcactgtgttgaataaatgcattaaaatggtgaagtttttgtacttatacgaaatctcctgctgattatggattgtttgtttc

SEQ ID NO: 41729 - DNA, 1501 bp, Oryza sativa
taatcgtcgaacttaatgtcgaaaagctcacatcgctatattttaaaaaatgggataataaaaccaaataattaggacgtcgcagggtccaatcagatgtcaagaaccgggaaatttcaacaaagtttaatcgaatttatgggtctaaatttgaatttaccaaaaacattcgaattctcctcaagatcaaccatagaaccatttcacgatttttgatcgtttgtgtttgtgtgttgtggtggcaggaaacctcaagagatggcgaagacatgcagcctatcggcatttgctctgtccttccattgtatgacacgaataaaacttttgcgcaactaatcgcccgttaagtaagtcgatcgatcatcctctgtcattccagttgtatgacacgaaatcaagaacttgtcatcaccgcataaactttcagtactaatgcttactcatgtcttgccgtgtctcattgacagatcaaaatgaatttgtacaacttaaagaacattacaattaaacgtgtgcaaaagaaacaaaaaaaaaagcagcaggcagcattgcatcatcgggccactgaatcactcatccgacaaggtaggtgacgacgagagccacgatcatcagaatgtacgcgatgccctggtcgatcgttttacctgaaaaaaacaacaacaacaacaaaaaagaaaaaacagagcacattcaggttcaccaagttcagaaaaacaatggagaagaagaaatcgagcagctagctggctatagctagctctcttgttaccgtcgctggtctgggcctcgaggagagacgccgccggcgagccctggcagagcagcgggtggaggaggacggcgaggaggacgtatgtgaggatcacggcctgcaccttgatggaacccatggccatggctggctggctagctagctcaatctgtccaagaacggacggtgaagagaagatatatatatttgctgctcaatttcttcttgttctatgtaactttgcaagaatgaactgaactgaaccgagctgagctataagctgttgctgataccagtgtaagaaatctcgtcagaatttatagttaaacggatgcaagaacagtaggggggtgatttctgatttgggttgtttattgctgcctgttttgatcagttcaaacggtcctgcttctacatgttttgaaggtctgatattggaggctgtattctatcataaaacataggatatgatagtgttatggagtggtactaagttgaggcgttcctcggcgagtcttttttgtcttgacttttgattggcagtggatagtcacagggacataaatgagcacaaaaagggttgagagggtgaacatctcaacatcttcagaaaacgattaagccagtgagagaaaaaaaaagatagtcacagcgggacagaggtgaataggtgatcatcttcagaaatgagcacagaaatatggctgactaggtgaacatcttcagaaaacgattaagccagtgata

SEQ ID NO: 41730 - DNA, 1501 bp, Oryza sativa
ggtaatttaagatataaacattgtgaaccatatcttatacagagtcagtgccacaaatgatttgcacctcacatggcaccaattcaaccagcagggggcagcttttagaccagaagaataacagaaagccattgcccgtgcaaatttttatggcagaaagtttgttcgccctgggatccccacacacatacttcaaaattgggagataatcttgaggccagcggtatgatgagatatcagaccaaagtttagattcaaccatgctgagataaggtgacaacaagagcatcacattgttcatcacaaaatgccgcttgaggttagcaagaataacaaggtcgatcgacgataagcatttctggagttttacactcagtttattaattgaagctgattaatgttctactcatggaaatgaccgagtgtaaaaccgtacattaagctcagatgtgagaatagttcagttcctataaaactcctgtgttccaaaggagacattattagaagaaaaaccgttttatcacttgagggataattgctcttattatttgcaactctagagcttataattgatacctagctgctgtcacgtcctgatggagtagtgacggcactcgacagaaacagcaatttaggcgatggaatttggcaacattccctgtatttttccctgttcattgttcttgtgccactttgatccatatatatatatatatatatgattaatctttttccatgacacatttggcatgaatcggcatgattggagctaaccattttcccttccggcagttcttaccctgcatcatcagagtggtcattaggagagacaagaagcaactgcaggaaagcctacatgatgcgcactccccccccccccccccccaactccttttttcagattgtaactcatggctcatcaatccttcctagccaaaatgactctgcagcagcagcttgtgtgccctcaccatcatcatcatcatcaagatagccaaaatgactatgcaaattgcaatagcagcagtgtttttgttattttgtactactactactactactactagtagcaacttttgaacagagctagcttagcccatcagatattcagaatttcagatactcactcatgcagagtcacagcttgtatagttgtaatgcatgcatgtagctctagctttacgcacgcactcccacaccgcacactcgccagttagcccttaaatcctaattataagatttaagacctttctcttcacttcacctctctctctctctctctctctctctctctctctctctctactctctccctacaagtttcttgacacccaactgcaagtctgcaaagcacagaagaagcttagcacacgcttgcagctgaactaggagacaaccaaacaagccatccttttgcactgatcacacttactgttagtactccattgtgatttgtggagagagagagggagagagagagagagagagagagagagagaga

SEQ ID NO: 41731 - DNA, 278 bp, Oryza sativa
tgagtggtggtggagcatcggtacatcatccgtggattcgcaggtggcgagcgacgggtgaaaacctagcccggccttggccagaccgacaacgatggttatttccccctcctgagggcgttgtcgtgctgtctcacccctcaagggcagttgccgggcgaaagtccagtcttggctcctttgagctctaacggacggtggcgtcgcttcttgaagacgtcgttttggcacccccttgctgtagggcgatctcgtctgtgttcctttgttggtctagc

SEQ ID NO: 41732 - DNA, 1501 bp, Oryza sativa
ttgacgaagaggagcagtggcgatggcttgacgatgaggaggaggaggggcaacagtgttagggtggatttggcggaggctcggctacggatctagtggcgccgaggcacgcacgcagcggtggcgggccttagtggggaggcggtggtgctgcggggagggagggagcaccggcggcggcggctcacagagaaagggagcatcagcgcacagtgaggcgacaatggctcgtggagggtgggagcagtggagccggagggcggagggagtggtggtggctgctgctccgcacggatgggctcgggagtttgccgtcggcgacgtggtgtcctgctgcttgacatgttttttttctttttctttttctttttgtttttggtggacataaatttgtgccatgaaattttgtttgattcagtttaatatatactaattgcacaaaactgaataaaaaactttgagaaactaggttaaattcacaagggtataaatgaaatttttgtcttgagttaacaccgtcatgttgccttcacagaatagggtcaagccccattttcgtttctaaaaaagagagtcaaatgaccaaatcagtggttagtcttcaaagtagggtaaaaaacgcaattgccctatcatataaagtcacccgattatctccaattagggcttttctaaaggagacatcaagtagtacgtttgtgaacacattggccaacacgacatttttcttgctagcaagattattcaacgaggtaaataacttatcaaaagaaatgtctcccaaaacctcaaaattgagttccattatgaatcacaaaagatccatgtgagagaaagagacgatcgacatggatgatccctccaagcagaggcgttggcatagtacagagaacaaatcggagggaaggacgagacaacatggtgaggggttgagaactatacatgcttacgattgtggcaaatggtgagtaaataaattgatttcagctctacaatgtggtattttttcttcacaaaagccagattctacttctcatcggtcttcacaaaccaatgtagtgacacgtgccaaaagcgagatgaaaagatagcttgtgtcttttaccgttgcaaggcataactgaaccatgctatacaccatacattgacctatcaatcactttcggagattaattagtagttggtaatatatatttatttgtaaaagatggaaacctttgagtttggaaaaacaaaaagagaatcctcgccgaaaacaaaaaacaaaaaaaaagaaaagaaaagaagagaacgaaagatgcatgtctcataacaagacataacctttttttttttgggaaaatcccagacataacctgtgtccatcgtgattctcatttaacttagcttctctggtgcctatataaacctctccatggtgtccatctgcagtgcacacacagtttctgtagttgcaggtcagtcacaactaaaacagaaaccagttagctgcagacaaacc

SEQ ID NO: 41733 - DNA, 1501 bp, Oryza sativa
gttaatgccagctttgactttcaaatcttactaatctattatgtataaacattatggattcatattaagtacttaagaaaatactacctctatcccaaaatatcaaatttttggctgtgtctggacaaacgtatatccatatacataaccaaaaagttgtcatatttaggacggaataagtctacataacccccaacctattgtcaggagattacttaaccccctcaccttacaagccaggtatttaacccccaatcttactaaaatcatttaattaaccccttatggtggttttgctccctagttttgccttgctggcatgccacgttagacagatggattgacaggcatgctgtgactgtcacctgattttctcaggcaaggccttctactctacccggtcctctatttacattgaaaatctataccatttttatggttcataacattgccattgaagtcggaattgcatacatgtgcaagaattcagtagcacgagcaaaacaagagtgcaaaaccaccgcaaggtgttaattaaacggttttagtaaaggttagggagttaaatacctggtttgttaggtgagggggttaagtaatcacctggtaataggtcgggggttatatagacttattcatatttaggagagagataatagttgttatgttggtccgttgattgattattgttttttgtccattgtatcgctaacttaatgttgcatcgattgtatatatacgcaataccagcaattttgattcgtttctgagtggagtctgctttgactctgcaacattactgacataaaaaaacaatctgttatgcattcacatccgcaacatccacattcgctatgaattaatgctcttaaaaaaatatggtatatgatatggtatcatcactatccgaatttgcttaactttcatcctaaaaaaattacaagattcatattttttattgtgacttaatttatcactaaagacagtttaaacatgacttatattttttttagtaaaattttaaataaaacactttaagaatattcaaaaatagctcaaaacttcgtatgtgagggttaacacttaataccaaggtttcatgtttaggaaacttaccgaacggttccaaagtaggatagtctttcgacataatatattagaaattattttatatagctgtaattatagagatggagaaaaaaatttgagctctgcccccttcccgctatttgaagtcatagtaacctagtttttttccttgtcttttgttttcctcctttcttgacataactcggtataactgattgtgttgtgtaacaatattcttttcttttaatatattgacgtgtaattcttttacgtgttcgagaaaaaaattatacagattaagccgaaatttgtttgagtttcagtttcattttctatcattcccctttttatttccttaattaacactcgacgagaaccaccctcagttccatgattggactcctgaaacggt

SEQ ID NO: 41734 - DNA, 1501 bp, Oryza sativa
acgtcttcttcacccctgaacagctcgaaattttgatgagaaattcaggagcactcgccaaaaacagcaaaaatggcggcaaaactaagaaaagcgcgccaacggcaagaaaaatgttgcgcgcaaaaatcccccacaaaattgcaaaaccctagaggacggagggggatcggcgagtaccgttgaggcagtggagggtgagctggagcttgggcgcgtcggggttggggagggaggcggcgatgcggtcgagcgcggcggtcggcgtgcggagcacggagaggacggacttgaggaggacgctgcactggagcggcgtcgacgacggcgccgagtcggcggcggcggcggcggagaggctgaactcgtcgaagaagtcccgcgccagcgagatggacgcgtacgccgaccgcgagctgttgagcgtgtgcagctcaagctgaaaaaggagaaaccaaatcacccccaaagaaaatgtcagaacagctcgccgccggcgaatggaggaggaaaccgcggcggagaggcaggcaggcggcggcggcgaccaccttggcggggtgggcctggaggacgaggtcggagccgacgcgcgcgaggcaggtgacgcaccgcgtgaacgtccgcagcgcgccgccgctcatagacagctccatcgccgcccgcccgcccgcccgccgccggtcgccgccgcaaccgcttccccgcgccgccgcgcttcgtctcagctcgcctcgactcggggggagggaaaccggtcgggggaagcgtgggctttctcggccgagtcgttttgggcctccccacgaacgtggcccaataacggtgggcccatggacgccgaagctagggtttttctctcccgaagccataatatatatcgccctcgctcctcgtgttcttcttcccccttcaaacgccgccgccgccgccgctctcttcggtctcgcttcccttctccgggagattcaggtgcgccccccgattcccgatctgcttcctgttctcccattcgcatgcgcggttgcttagcaggacgattcttctacgatcttctgattgcgattcgcgaggaatcggtgtgtgttagcattatcatgtcgagtagcatttttttgtttttgttggtcaagttccatgtctagcagatgaaatttagtacacgctttgcaactgtacggttaaattcgtggctagtttgtcgaattggatagaaggaagtgcttttatttttctcagatccggttacttctcgttgtcgaggtctagtgtaaggttaacatcctaattcttgggtacacatagatgatatgtcgcttatatcgtcccgtttgattgatatggagctagataaactaaaactgtatgcctagttctattgagtattttagttgaggggggataagttttggtgttccatgtatcttctcctaatctttgtgtgtattgttgctttgctttgcagtcgctgttgtggtgtttgcttcatccaccgccacca

SEQ ID NO: 41735 - DNA, 1501 bp, Oryza sativa
aaaaacctacttgaaaattaaactttttcacgcgcatttagataggtatataccaaactacaatatgcaatttttaatgggtatatacctagtatgtgtgtttagaccggtatatacccaaatagaatctggtatgtcacacatacccaatatacgtgtttaaatacctaaaaatgtgtatcctaaatggtattatacccaattaaatgtacatctgaaatgcatgcatgtaaatacctagctttgtagtacgtttgaaacgcatgcacgtcacatacccaaaaaattaaaaagcacaacacacgagacttatatacatacatctacatgtacctaattacatctggtcagctacctagcgagagtataaaaaaaacttaactaaaaggcctggctagtttcaaatttagttcaagaaaaaaaatgtaagctacttgaaagtcaaatttttttcacgcccatttagataggtatatacctaactaaaaatgggtgtccgaaatatgcaatttttaatgggtatatacctaaatcaattctgtttaccggttatattgtacttattttttctccggtatatgctgatattttagatagtatatactagatttttcaagtatccaagatatattaaatcgaagggctaggcggcgtgatgcacaactgtacataagtttttttcacatactacgattaatttttgagtatatatcatctccgtacatcatataattacaaaaaaatgtacttctaatacctagttttttttgccataaaattaacatagactaaaatcgaaattttttcattgcatgggatttttttccccgtttcataccaaatttttgagtatacgacccattcgtacctaaaaatagaaagtgactcgtagtgcatattttgttactcaaattgctaaattaatggagtcatgaatgtaataatttggtacggatacattaccatataaatttgttgcgatattatccatgtttccaaatacatttgaatataataaatttgctgcgatatatataataaatttccaactaatttgtttccatgtttccaaaaaccaacaatcagtatttagtgttacatacttagttcccattttcacatatacttactttccatttttccaaaaaattaatttatttttccatatacttagtttccatttttcacaataatgttaccatttattcagaccccaacgtgaagcaagtaagtttccatatttacaagatattatttccaatttcacggttatttaatgtttccatttttgaaatgtacacgcaattatggaaattctctcatccgcattgcatgcatataaatgcatttattccttttttttactgtctattcaaatatgtggaatccattcattattaaatactatactctaaacgggtgtatacccattaagctatgtacccaaatgatcaaaaccgatcagtaagcatcctacggctcctaacattggagccccatc

SEQ ID NO: 41736 - DNA, 1501 bp, Oryza sativa
agaattcgattcatacctatacctatcaacaaaacaaactcaagtttaactttgtttcacaatccatgattacatatctaactaattatatgtttggatgctatatacgtagaatcaaaatctaacaaaaacaagttcaaattcagttcaaacttgctttgaactagttaataaagtagttaatgttaatacctaaatatttgaaaaagtttcatactcatttgaattgggtatatactcaatttcaacaatggtgcccgggcaccatggagcaccaaacaaatttactaattgtgagtatatacctagttataagaattcgattcatacctatacctatcaacaaaacaaactcaagtttaactttatttcacaatctatgattacatacctaactaattatatgtttggatgctatatacctagaatcaaaatctaacaaaaacaagttcaaattcagttcaaacttgaatatatatagcatccacacatatatatatatatatatatatatatatatatatatatatataggtaaattaactggtgctacatggagtatgggctccaagattcaaattgagtatatacccaatttgaatgagtatgaattttttttaaatgtatagatatgaacattaacttctttactaacaagtttaaacaagtttgaactgagtttgaacttttttttattagattttggttctaggtatataacatccaaacatataattcgttaggtatgtaataatgaattgtgaaataaagttgagtttgagttgttttgttgttaggtatttgtatgaatcaaattcatatacctagatatctacttacaatttgtaaatttttaaaaatttgagagaatttgtgtgttttataccttggagcccgggcaccatggagtcccatatgggtatcctatatatatatatgtatatatacatatgtatatatatatatatatatatgtatatatatatgtatgtatgtatgtatgtatatatgtatgtgtgtgtgtgtaaaatcaaagtgtgtttgattattgtttcgtgatgaataattggcatatgagattattggttttgatgttgagatattattggcgaagtggttttggagatgattgatttacaggtgatggacaggattgacaagtctgacggttgcggtcagatcggctgggtaaggctagtcagaccggtgttatgcgagcggtcaaaccgaccagcccgcggtcttactggccgacgctgagtcgtggataatttatgtttataacttctagatggatactatgcgtatgtaatactgttgtttgctaacaaatgagtcaagttggtgagaacttgtgctcggatatggtttcttggttgatgcatgtgtaggtggtcttgcctcaagagagtgttgccggtgatggatcgggagtcaacttgggaaaataagacattcgaacgatcaggatatcatgtggaatactttggctaaacatcat

SEQ ID NO: 41737 - DNA, 1501 bp, Oryza sativa
atgtccacccaagcgttagtaagtgttattaataactaataagcttcataagcacttctttctcctgttgtactcccatttactgcagtctgcacatagccaaaagcatagtaaacataatttatatgggcacaaaaatgtttgagttgtggttaattttgaaccaaatgacattgaacactctgtctgatttatacatatgacaaataaaactgcactatgagagagttggtgggatagaacattaagttttagtgctctcgcaagttacaacacagtttccatgaatattcatagttcattgtcttagactgatagacaacatcatgcatcagcccatatggtttaaaaggccattagctttatcatgtaataatactgtatgatggaaagcaaatttgtaggaatcattaatacctagaattcataggagtgtgagctcatgaagttatatttacgatagtgaaatcaggctgtacttacatatggtcctgacataggtaatgcacggtattctctgttgcgtgaaaatgcaagtatttacaacaaaaatggaaccatcaacgggaatttcgactcattttccttataggacttcggtgtttgctagaatggatacctattcagatgcttcatttgttgtgattttttttttcactggaactctaagagtgtcgtacatggtagtaccaagaatttaagcatgtcttttcttgcagctctaaccctattgtaccggctggaaggcgcacaaagctctgttggacagaaaaggaggagataacgttgagggtgagtgcacctgatctgaaaaagttgttaccggcactgatgaatcttgcaccatcttctgttgcctagctagtaatgtgcatggatgcacctcttgtatacttacacttctctcgtgttctattcaggaagcaatggcaaaatttaccccaagggacaatggcccaattccatgggtccagatactggagcacggtagggacgtgttccacaggacacgcctcccatccgacctgagggtcaaatggaggaacatgaagaagaaatcaggctcatgacagtcttaacaacctactagtgcaggctgtgcagcttttgttctgtgtattctaaccacttactcttagagcccattgtgtgtgtcatcaccatcttgtaaggttgtaaattctcgttttcgagaaaaaaaaagtaaggttgtaaattctccttgatgtgtagaacacttcaattttatcgttctttcttggtatgtagaacagttcagtgaacttagtttgatgtcccgagttcaacacatctattttctgcagatggctcccttctgttaaatgttaatgaaggcgaataggtgcaatgcagaagtgaagatggaaatttttgtgttcatatggacaaaatgttcaggacaaatgatcaatagggagaacagcaatgttcagacagttaagagagagagaggggtggggggagggatgtttgatgttta

SEQ ID NO: 41738 - DNA, 1501 bp, Oryza sativa
ccatcagaaggtcattcggacggcagccatacaaatctccgtccattaatgaagagaagtcaagttggagggaagagaggatgagtccccacacaaaagaaagagagagagagatggtgcatgtggtatccccttgagatataaaaggaggaccttgcccacttagagaaaaaaagaggaggagagaacgatcccggaacgatcgggggctggctcgcactttgtagcttcttcatacacagatccaccaaaacacaggagtagggtattacgcttctcagcggcccgaacctgtatacatcgcccgtgtcttgtgtgtttccactctcgcgaatcttccacactcagaccaggagcttagaaaaggaatacattttaaaacttagctaaaagggtttaaccattagattggtgatttgatgatttgcctaacctgatccacatgttactgattcgaagtgtcatcacgtgtcacagttataagagcatctataatgtgtggttttttacaagaggtactaattaagataatcttgttcctttggagccataatgtgtttcccttgagaccggtgcaatggcaatggcaatcaatgtgtatagtgatgctctataagatggcaatggcaatcaaaagagtagcaaattgtcaaaatcgcccctttagtgtcacttgctgacccctcgtcctcgtcatcgtccgccctatgttgctacccaagcatagtgacaaatgatgatagcatgccgtaaggttgaccactagctatttcgttcttaatgcatacaagaaacaaatgaaacaatgtggtgcatgcaagtcttaaagcccaagtttggtctcttggggagttgggaattctcttccatactactccctccgtttcacagcattttccacattcatattgatgttaatgatataaatatgaatgtgagaaatattaaaatagcttacattgtgaaacggaggaaatagtacgtagtaatacctagcaagacaaccacatgtgaggaagccataccaacgcactaactgtgatggtgagaactaatacttcctccgttttacaatgtaagtcattctagcatttcccacgttcatattgatgttaataaatctagacatatgaatgtgaatgtgggaaatactagaataacttacattgtgaaacggaggaagtaccattcatgaccagaaaaaaaatgtggctaattaataagcaacacataccagtaaaaaagagatacaggagatccaccatgagcaaatgaagaaatgactcctgcctaaaccctcactaatgcatgtcacattcatggacacaccaacaacccattactactactccctcatgcacctgtaattctgaattcaacagacaaaaagaagccactacaagaatgtggtgttaccaaactaattaaacccagtcgcagtttctacaaagtttgactaaatttttcaccctcaccaaccaaaaaccactcaagtttcaag

SEQ ID NO: 41739 - DNA, 1501 bp, Oryza sativa
atatattatatgtataataaaaaattttagtgaggacgctcatgatcttattaatattgctagtagtgaagagtcgagtctccgtcgtcccaatgcttgatccgccctaagtccaagagactgaactgttgattgatctcttgtgacagtaacactcccccgtgcatggattagtgtgtgtaacggtgtgtataatctttgaaagggacatcagtgcaaattaatcggatccgggagtaagcatctgaacttttctcactttgcaagagaagagaacacacctagctagctaggcatacgtattgcatttgcagattcagaatatcaaattgccattcagtgctagttgctcctagtaacaactaacaaaccgcggcgagatgacttttgctctatcgcttggctaactttacatgagcagcttgtgtaattagttgggctgttactttatagtgaagttctacgtatggaattatgccattacctctgttttttaaatatacggcagtgttaacttttagacattatgtatttatgtttgccgatttgttttgttattaaaaactatgtaagtgtcaattattttacttgtttttataattaaagacattttaagccgtacatattatttttgcatacctacgctaaacttttaaataaaacgaatggtgcggagagagttttttttttctcatgtcccagcaagtatataccatcggtcgctgccggcagcgtgcaccggccatcgcagaaaacgtaatcgggccgccagtgggtctagggattctagactattcataaattgtgactaacacttgagtcatattcttgaccaaacacacatattttagacccttcaattcttggagattttgttatccacatacgcatttttgaagttaattttccaaaggctgacatttgaacaaagatgtgaagcgggccttctttgggctaaatcctctgcccaatgtgcaatgtgtttgtgtcggtttagaggcccaaattgaatatatttcgtcaatcagctcagaccatcacaaaacggctagtgcaaattttcagaaaaaagcttaacataattttcccatgcgtttattcttgcaaagttcttactactaattagtatttgtaatttttctttgtgtagttttgtagatgttgggtatcaaaagttaagttgatctgatgatatgtgcgaaagtaagtacattgtttgcttgcttgcttatttgacatagctccagctccatgaaaaccttttagcgaagctagttgaaatggttttacaaaatatactagagaggtactacctccgtttcacaatgtaagcctttctagtattgtccacattcatatagatgctaatgaatctagacatttgatccacattcatatagagctaatgaatttagacattgtcatatataaagaatcattagcatctatatgaatgtgggccatgctagaaagtcttacattgtgaaacggagggagtagc

SEQ ID NO: 41740 - DNA, 1501 bp, Oryza sativa
ctccaaaggaaaaagattatcttaattagtacctcttgtaaaaaaccacgcattgtagatgctcttataactgtgacacgtgaggacacttcgaatcagtaacatgtggatcaggttaggcaaatcatcaaatcaccaatctaatggttaaacccttttagctaagttttaaaatgtattccttttctataagagcaggtatagtagggtacaatcagcaggcggtagaactgttcatctaagagtaaagcctacatggaagagtgagaaaacatgagagagagagagaagccggcccttaatctatcgttgggctacagccattaaaaaaacagcatgaccaatcggtcatccatgcatgctgcagctgcaagctttttccaccacttaaacgcttcccaatggcctcaatgagagagaatagagattgtgagagaataatttttgctgagttggactttttatagcccgttgctggctatactattaaacctgctctaaccgttagagagactaaggatcgtgtcataatgattctatatcgatgcctctaccttaaaaaattatgaatttcactagactgatatttatttagtggctgttagagcctatgtgtttgagagaagtaaaaaggagaagatacatgaaacgagaagagcaactagtacatctattaattattttaaatttaaaatatagattaatataattttccaaactaacctttctatagattttttttttttacaaaaacacatcatcacttagtagttgggtaaatgtgctcgtagagaatgagtgaatttatctcccaatcagtatatgtggaacgcatggagtactccgtaacatttccgttataatgttagtggataaaattataaaaaaaagtaataattataactctgttacaaccatgacattcccaacacgttgggcccatataacaacatacatacgcgcgcactcttttttcttaaaaaaaacaagccagacattggattttctattcgacttatactaacaaaaactcttgaaggaaaaacgtacttggtaaataaaacataatctacgaatccggatcataatctacgtatgagactgagagggacacgagtgatttgacgggtaggtttctatatccttaattagtacggagtatgttcttattattctaattaattttgattttcctacataataatactgcatagagagagagagagagagatacaggtggccccggcacacagttcatttgcaacgcaacggctgtttcatcttctgacgagatcacatccatgcaaacgcaagcaattaattaatcccctaatcccccaaatcctcatctccaaatccctcctcgtctcgtcctccaccgtaataatctctgaccaaatcgccaaatcatccgcccagaaagccgccgatcgatctcgtcggagagggcgcgcgaccaatctcgaccgatcgatcgatgatgcctccgaagccggctgcg

SEQ ID NO: 41741 - DNA, 1501 bp, Oryza sativa
aatttctctcgccaattgagctgaaagtgtcctctattaaattaccagttttttaaacgtctttcagccgttacatatttttatgatgtctaccagtaaattacataaattcatgtagcaatttttgctaagtttatcaagataatatgaatattgatccagtgagtaacagttatgctatgtacctttgttacttcgtaataaagttagagcatcaccaacagcattttgatatcattccctatgtggtattttggggatttttgatcaaagattgcttccaacagattccctaccagctctcccaatccttctggtacccaagtcctggtttttcgttctccaattctagcaaatcgatttcgctcccaatcctttgcccgcggctatctcgcgcgcgcttggtgaaacgttcccacgcagctcctcttggcgacctcatctaccgacggcgtcctcttcctcgcaacagatcggaatgcagcaggtgcttccccatggttgccgggcgtcggctttcttccagggagcggtgcatggtatcgcgcgtcgaccgcattccaccgatggctggaggaggacagccatcgccgctcccccaaccaccaccgccgcctcgatttagagcgcaaccatgatacgttgtgaatcggcccgtgctctgcctcctggccaatcgtcgacttccggtgttcaggcgacagaggccatgtaccagcaggtgcccaggcaatcactggatcccatctcccacaacgcttccagcgccattttgtccatggcttggtttgttggtgaagaagagttccttcgtggaagcaatttcaataagtcctgtccccgattctggatcattgttgcatctcaagtctattgtaattgtgcattatcttatcctgctgccgaatctgatgtttgtggttaagtggtacatctgaactccacattgataatcaattaataatgaaatttgctagcttagcaagttagcagtaatcaattataaattattacaaatcaatagcgataagtgtatgaaatggaaaagttgcccttttttatatctgtagtttgtaataagtctgcaaaaagctcaatgttcaggtgttctgttcttactgtgaacagagagaaaattatagtgtcaaatttatataattcagaaattatctaacccacttgtgttatatgttattcataaactatgatgtcagggctgatatgaactgtatatatttgaatttggacagtagtgtcaaatttatacaattcagaaattgtatgaaccacctgtgctatctgttagagcttgcattttcataaataacagtagttggacatgttttcagaaatgagcatgtattcatagtgaatttggtgctatgtattgctgtggctgcttgctgcttgctgcctgcataggaggcaataagaaaaaaatatgctcttttaactttctgggctgaactttgtaaatccaaactacttctgatatatgtta

SEQ ID NO: 41742 - DNA, 1501 bp, Oryza sativa
acgctccgcgtaacttgaagttaaaattttcatatttgaaggcctggtcgcggaaatatcaatttataagttaaaaacattaagcattattgcctcaataaaattcatatatgcttaatagtccacgttaattcccatgcatatcagtttcatttgttttaacctaaagtcacaaaatatagctgttgctctatcctgagagtgaataggtaggcattttgttctttactggtatcgttgatgaccgctgtgatacaatcggaccatggtttgatgctagcaaggggctattttcacttatgttctgcctcctaaatgtcctttcgttcttacatctagtaccgtgagaaaaatctagctagttctataggcaaatcgttgccaatacgtgctagccgaactgttgtgagaagcaatgcctcctaagtcacgatttcgttccctttcgtgattttttgtttctaacgtgtttttttaactcctctgcaaaataaacgcaagctaatctttcagatttttcaccaaagtggtcataaaattgatgacgttcttaaaggctatcataagatttttgtcacggaatgtctaaactgttgtagtattagacatattgtcgtaaaggcactttactacatatctcatttgaacgtatgcagttattgataactaatatatttgtcataactcactttacacatacaaatatatgtctagatatatcattaaagttccacgcgcccttgacatgtaaagtgcatttgtaaaacaatagcttacaatacataacaaaattagtttgaaaaggacagcaatccatgtcactgtcacgtcctgataaattcatcccgaaataaaaatcattccctaaaaggaataatagaataaattaaaattcgaaaagaaattggcaaacactaaaatacgtacaagaaaaattcgaatgtggcccggagaatttttgttaaattctccttgctctaaaatgagccctcaaattttacttgaattttcagagcaccggaaatatttattaagcaacaaaaacaattatcaaagtttaataaaaagaaaacctaaaaataatcctccttttcctttgggccaagtctagcccaaagcctccctctctctcccccggcccgcggccgaagtccttccctcctccctttctttttccctccccctcctggcccactccctcctcctccctctccctcccgggctgcctctccctcctctcctcctgggccgcctccgggcccaagccgagaggcgccctcccgcccgtgccgcgcacgtgcgagcgctgaccgcgcgcccgcgtggggcccacgcgccaggtcgttgtcctcctcccgcccagcctcctcctctctcctccgtgaaccctagccatttcctccctcaaatccgcgcgattcaaaccgggaattccaaaattgattagggggaattaatcccctttccctcgtctctctttccccctcaattcccccttgaa

SEQ ID NO: 41743 - DNA, 387 bp, Oryza sativa
ttgaagtttatgacaaaggtgccgttactctcaactgtcaccctaatatcacgcatatgaaggggtctgttaccagtccaaccactgcatacacatcaaattcagacaaaatctgtgcatcaatcaaaagtcaaattgtttagctaaacctgaaaataaattgtgatacaaaattaagagtctcatgaatactgtgtttgcattttcttcttgcacaaggacatcaaatgctctaattccttttggcccgtaagtgttcactatctcagcaaatgcagatcaaagaaagtctccaggagcaagaccatcgattttctagctggaatttccatatcgaactgagtggtaaagcaaaggatagtcaccacttcaaactatatcctcaga

SEQ ID NO: 41744 - DNA, 1501 bp, Oryza sativa
caaatgtctctctggttactcgcttgattttcttttccatcagcaggttggttattaactcgaggttagaacatggttcctctgaaatgagaccctaggtctcctttgacagtaaacacataatcccatatcagcatcttccgaaagagtcctcatagaacttgtttttgttacacatttctcccttattacatgaatacaaggccctaccttaaacaaaaagggaaggtgcttaacatcggtacattgcatcctcaacatgaatcatccataaacatagcaaactcactgtttataaacatgaatatatttatttattacatgattgctgcaaactcccgattacagtgataagtagcgaactgaaaatcacaaacatggatactcattctgattctggagagatatagctggcattgttctagtgactgcatccttgattggttctgtgatgatgtgataggactgcatattgctatcattcacaggagaagcttccttctgattgctgtttgaagcggatgacggtcttctgcttggtatcgccctccggaggttgattgccctttgctcggcctggagtaggtcggggagagacacaacttcttccatcgacgacaattctttgctgaggctgtcggtgcagagaatggttggtgctgaaggtattattgctatgatttattgcagagttaggtggagcaggaggaacattggtgctatggatgatatcgtcgatgttgctgttggagctgactagctgatgagacaatcgtagggttgttcgttggatttctacggtcttggtcaacaacacactgagttggcaatccttgggcacatggtttgtaccttcgcacagaaaacatgtcatcttgcgggtgggacactcccctggtggatggtcttcttcacaatgagggcagagtgtgagacacatgctagcaacgtgtccaatttctccacaacaggtgcatgcctttgattccatctcttcctcgccgagatgtcggggagactcatcttcatcatccgaggagacttgatctgacccttcactatcagatactctgccaccatggcttaggaggtgctgggtcaactgtcgtgcacctcgaaaggtatttcctctttgacgtctaggaatagttatccctactggaggccattcggtgttggtaatagtcatcttacgtacttcttcttcagttcgcatcggtgcttttctcttctgattcttactcttcttgcctttggcttgcttagtatgtgaccccacgtggtacgaaaggctaggaggaaagcatttcccgggattcaatggattctctccattgggctctctactttgcacactaggctgcaagcttgacttggtgcgaggaggctggtttagcgatgtctgccctgctaaaccaaaggaagaggcttgtttggcatatacccatggacaattcagggcatagtgtccttgttctctacaatcatgacaaaaggggac

SEQ ID NO: 41745 - DNA, 1501 bp, Oryza sativa
aaaaaaataaccagcagcggactagcgggcctacggctgcatcttcacaggcgctcaactggggtataagccaggactccacctaagacttcttctccaaagcttctcttactgaagggggggggggaagattgagcaagaatgagtacaaccacagtactcagcaagccacaccggcagatgcatgattaatgcaagagggtacaaggggtaataatataggggttaagttttgtagaaaacagcatttaaaagtcacttagttacccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcacattttaagaattaaaacactaacttgggtacattgctaggcttgcccataaccgagggcgcggctattcgaataggttatactctgatcagaggtgtacatctttacccacaagatacatcttcctcacgtgtaaccacgtgccacataccaccacggtatacggacggaagacgtgacatagttcccaacccatcctagccataaacaagagtaccgacccaaccccacctacggccggaacctctgggacaggcaggcaggattgagcccctagcagcaggacaccagccctgtgccatgacatctcgactaccgggccacagctcgtgtagccttcatttgtcctagagatgtccatcgacccccgacttcgtccatctccatccgtgtacttttgtttataaccagactgagccacaaactaagccttacccgctagacatgtggaagtacggtagtgctttgcaacagaggcctgagcttaatccttatagtacccgaggaacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaaagttgcctaattaatcagcgaagcatctacctaaattcatactagtggaaccatgaatagagtacccactagttggggttttgtttatcctagggtgaacaagctaataataacaatagcaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcagagataacggccttccgaaccttcggcgacgaccgcaaaccacgcttcgggaacctccggaacgacgaagactacgcgaagcacacaagcaaagctacaa

SEQ ID NO: 41746 - DNA, 1501 bp, Oryza sativa
acaccccgggttcgacccccctcggggagagccacatgggtttgagggcggcctcctccctctagctgggagggggtagccaccgctccaccccgggcttgatcccccctcgcggggagccacgtgggtttgagggcggcctcctccctctagacgtgatacccccgggcccatatcaccgacaactggttagaccacaaccattgacgtcttcaatcttacaagttgtacttttcttttggcttgttttagtattctccaaaatctcatagctcaacaaaaagcacggttaagagggattgagaaaaaagatgcagcattgtacacagtatttactgaaatataaatagggttgggaagcaattcgaggagaaaaaaatagttttatgaataaggtgtgtttaagtatgaatctatcattctatagggatgattgtataaattacgagcggtgcggataattaatccgattaacagttaggaagtcgtgaaaacactcacatgatatacatgttgcttatctactagatataaggaaatagtcatgcaagtaggatgccataacaattgcagtgtttaacaatgaacctcagtggtgcagggaaatatttctgttgattgataactgaaaattgcaaacccgaagtggcacactcaaaatggcatctgggaactgggtggttggtgattttggctaattgaggtatttgctggttctgaactgggtttggcgtttctaaatgtgtagtattgacattggtttagtatttgaggtctcaattattgacgctctttgttcttgatatcccctacactgaacaaatggaattttttttggttttagatttttttttaaaaaaatatttacagaaataatctatcggccaaaaaaattacaaaaatataccctgccgcccacctctggggcggcaagctgacgtggcaaacgggggaggaacgggcagtgacggagggagggttttttgcaggaaaacccttgccgccctctggtggggcggcaaggggcccgaatgcaaaaaagccagtcggggccggctattttgcaggcggccccttgccgccctctggccgggcggcaggcctccctgcctataaaaggcctgctgcccagcccccagccctcattcttctctcctcaattccagtgaaaaaaaaataagagaggggaggagaagagaagaaggggcgaagtcctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagata

SEQ ID NO: 41747 - DNA, 1066 bp, Oryza sativa
gcaaattataatggaagttgtttgaggtactggattgaactaataaggaaaaatcattgtatgtctggttaaatttaaagttgtttcatgttctaaagagttagatctgtactgttgatacttgatagaagtgagatgagagtgtcactccaattgataacccccctcccccccctcccccgaactatggtggtgtatcaaatctgttcaggggcaaggtatgccaacatggcaggaagccactccaaaggattgcttgtgagatgtaaataatacaaccactttctggtattgaatctgggttgcccatgtagtatttttcttggtttttttttcatgttcaagaaaatgcttcaatagaaggatcatttgagattaagaaatgatcctttgaagtttttggtttttttttgtcgctcttaaagcctcatatatcttgcttatttatgctataggggcctaaaataaattatttttacaaacatgatgaagtggaacatttaagattcaaagtggtacataagtatttgctgcaatttcaagtatattaagttattaactggttcacggctggcaacaaaaattttgagacatgaagatttgtggtatttgacattcctgcccctttattctattggtcaatgacatgtatcttgtcgttctgctctgttaatttgttgggatattttattagttactgcagtgtagaaaaggagctacaaatcacatatattttcttgtcaggagagttgcacatcattttattaaaacttgtgtaaccccacaaaatgaaaacttttatgtgaaattattttggttacaatatattgggtttaatttatattttgaacataacgtgcattgcacgtgcacgattactagtgtccaacaacatgcaacaataaaacagtccaacataaacacatcaataggcccaacaaaaccacaccaccaaatccaacggaagcataccatcaggtccaacatcacacatacaggcacaccatcaggtccaacatcacacaaacatgcactaaatagtaggaacatattacatgatcaacca

SEQ ID NO: 41748 - DNA, 1501 bp, Oryza sativa
tcgaaacaagatttcggtaatactaaaagggggtggctatcaagctgcaaaagtggatgggtttaaagacaaggaattttatacaggttcaggccttcttaatcaagaagtaataccctactcctgtccgaggattgatccgccgagtatattattgatcgtgtgatctgggaaaaaaatcgtgcccctagaggcacccggacccctccttatataggggaaggggtccgtattacaaactacagtccatatccctaacggaatatgtagttacagataaaatacaatcgtaaccgactaggatctctgatatttccttgacatacaagtttagaatttaacccgagtccttctaaagatattctatctacacgtggcaccccattcccagtcggactatacatgccgtgtaggtagggggtatccataatctccacagtagcccctgagacctttacagtcgacgaaatagccttctgtcggagcgcaaaatgataatccaagtgcttcactttcttctgcattgatctccagagtaccaaaatcaaagactgtgaagggctaaaaataaataattaggtgcatcgaatagataaacctaattaggtgtagcccccgactaggtgagtagctaaaggctaaacacatagtcaaagtgcaaataacatccatccgagtggttttacaaccgaatcatccaaaatattatacaactaagcatatgcgacgtttaataaaacatccagccgactactttagctttaatataccaaaaatggaaatataaagaggcccgagtaaaaaatactctaaaggtccataaatcagcacatatgacaagaatctgagtaaaaactctcaaagatccatcaaatgtggtataaatatggcagcacggcaattaatgagtcgaaatagcctaggctatgactcatgccataatcaaaataagcatataacatgctgagagaatgactgttcaaaaaccaatcatctcaacgaaacccaaacagcctttgcagcctaaaaagacttacaagaagaagtataacacctttctgtcgggtacctttttatttgcatcgtagtaattccaaggaattatctaactgcatcaaaaaggattttaacagcattgggccatactattgtgagcgaaaattgccgaagcaaaaatgcctaagtccttacggatcacaacttagccacgccgataacaaaagggggttgaagtactgttttaggcccaggcccattagtactcccgataccctaataacaccaaaaaaccaaacgccgtttcgttttccccaccgaaactttcgccattttccccattcctcgctacagtgccaaaccactccggcggaactagggttctccgattcgctcaaatcccccttccaaaactccacagaaaccatccgcgcatccaccgcatcaatcccccatccatccccagccatttcgaaagcaaattgcatcatccaattcacatcca

SEQ ID NO: 41749 - DNA, 1501 bp, Oryza sativa
tgcaaaacgtgtaccgtttagcagtttgaaaagtgtgtatgtggaaaatgagggaaatgggttgggaacccatgagaaagaacacaacctaagtatgatggaacgaacatcagcctaaccatgattgctatgctagacatacatgaccaggggaaaattagtatatctaaaaataagtgctgactcacggctaaacactccaccatatttatggttgtcatggaagtgctatgagtcaaataaaaactggtggtctgtgcttctggtcgaaaacaaaaggttctttttttttgccggattgttttcttcttacgtatcaaattttctccaaattagaggcatcgcccgtccctcaccctctcgaccacatgtcgtcttagatagttgaattgcaggggccatcgttcaacctgaaggtacatgagtgctacaatcaacaagatgagacggaccctcttaacctgtagggagaggccacatcaatagttgccgttgctcttggcactattccctacccctttccttatttcattgtgatatgaagaaaatataagacaatgagcgaaatgatagtgatactgttctttttggttaagatgtagtttctatctcggttttcatcggtacttatttcaaaaccgctaaaacggtgtgttttgtatgaaaactttctatatagaaactgctctaaactatcaaataaatccatttgtaataattaaattttagtaattcatagggcgttaatgcttttcttgttgtacgaatcatcagcttcgaacagaacccacgagcgtcgattttcaatctgacgccgcttgtagatgcattgactgtcctgcagtactgcctggcgagcccaacccccacggccgtgccaagtcgtcgcatcgcaccaggcgatctcgtcgtccctttccttgtcgcaaaccgcgctggcccctctgcaaactcgtctcgtaccgtaccccaaaaaagcccaaatccctcactccacccgcgtgatctcgcaggggcaatccggtaaaactcctccctgcctcctcctcctctcctccgcctcaacgcaacgcgcgtgctgctgcgccgcgccgcgcctcgcctcgcctcgcctgtgtgtctctctctcccccacagtgcgcagcacagcacaggttgtgtgacgcagggaaaggaaagcgggggacgaggagaggggaaaaaaaaggaaggaaggagttactactccccgcaccaaaaaccaggcgccagcagcagcagcaaccagcaagcggagaggagatggagactactactcctcctacttgcaccgcagccgcagccgcagcccaccaccaccgtccgcgcgcgcggctgcctccgcaacgcaacgaggagaagagtcgaggagcccaaccaccacccgagacttgacccccacccgcgactctcattcgatcacgcggcgcccacccacgcttttaccccttcctggtttcctctcccctcctcccccttcccc

SEQ ID NO: 41750 - DNA, 1394 bp, Oryza sativa
attttttttctcctttatttttcgttgacgaaagccagcagaaatgaaaaatgggtgagcagtgagctcatttattgtacaaaggaaaggaaaaaaaggggttgctttcctctaattttaaatttgatttatcatatttgcaatagcgtccaaggaccaagaccataaaacattcccttccttttttaaatgaggataacctaaaaaaaatgtcattgacaagcgtccaaatacaaaaaaatatcatcgataagtgtgagttctaaaaaataccattgtacaaacaattttatcaaaaatgtcatcgtcattatgattcctttcattccgctatgttaagtgtaataggacgaacaatgtatttaacagcgtagaatagacggaattttaacggtgatggtatttttaggataaaatcgtttgttcgatggtatttttttaaaacccacacgttgatggtatttcttagatttaaacgttcgtcaatggcattttttaattatctcttaattaaacctcatcaatcaaagtgttgtgttaagcatacatgtggatatgcaacgatgtccacatgcacgatcaaacagacatgtaactacagcatttactcctacacacatggataaatagacatgcaactattgcatttacttctgcataaataaacaaatagacaggttagatgatgatcaatttgaaaagatctcttaagagtgtggtcagaaggaggggttgggtacgtattattgcacaattaattaaatattagctattttttaaaaaaatagattaatatgattttttaaaacaactttcgtatagaatttttttaaaaaaacacaccatttagcagtttaaaaaacgtacacgcggaaaacaagataggtgagttaggaaaactgagataagaactctgtgcaaaggattaaaatgggatggagtactgctgtgcgcagtttcggtttccaattatggccaaacagagattatgacgagtgggaccctggataaggtgtcgcaggcgtggtggttggtggggccaggtccaatattttgttttttttttgcgaatattgggcctcattgggaccgttgcatgagtagaccatcttcttattctacatgggccaccgcataacccactaactaagtttcctgcaaagtgagctgtagccccgtgcactgtgccggcccatctcgtgtcagatggggccgtcagtcacgtgtacatccgaaagcgaattttttttatttttaatttttttattaaaagttttacaaaaataatttttcattttgaaaattgacagaagtggtcgcctaccgccctctgggagggcgatttttaaaaatcgccatcccagagggcggcgaaagtgacgtggcagacggcc

SEQ ID NO: 41751 - DNA, 1501 bp, Oryza sativa
  unsure (1)..(1501): unsure at all n locations
atgtataagcaaacatattggcagaaaatatgtactattaggtgggcaaaatttggtggggagaatactaaattctttcatgctatggctactgaatcctttaggaggaattctataacatctttgatttattgcgcataaggacatattttttctttgttgatggcatagcttaagaaacctcacacacttcttacatatttttcatcaattgcggcaacaattctaggattgatatatgtcttgaaatactcaattgcatttatctcatcaataatatttgctcgacacatggaagaacacaacttgccataataagcttgagtagatttactaccttgcttgaccatgcttcaaatggcgaagtgaaattagcgcatactctcttgggataaattcttttctcatcactttctacaaatcttcctaagacttggtaaagcacttatgaggaaatcgtttccaccaagtacatgcatatttttgaaattcaatagtagcttgttgcaactactcttcacaaaagcattggtagtcatgttcaatctccatttgatttacccattcaagatacacctcgagatcagttcttttttataaaatgtgtgatcagtgtaccttctttctgccattgttagtacagcaagtagcaaagtagatgtgaaaactctcacatcctcaccctctctgaccaatcaaagcttttatgtattccctatgggttacaaaattaatatgtgagccggtaattgtgtgatgtggttaagcaaagacaatatacccaaattaacgtaaatggcgatttctttatggagcttcgtgggataaacatacactaagaaatttgaaatatagttgttgtaaagatagataacaatttaaagtagaagtttattgcctagtattgatccaaaatgattggaacagacacaacaacggcacgcacaaagaaatattgagtntntgttgtacggtttattctcagaccataaaaaatgatgtgaactagccgccaacccatgcattgcatgggctattactattgattttgtggatttttttgtgctgaatatgttggtaatgagaatccatgataggtacaactccctatttattaatgctaaatttatatctatattatagcggattatgaagtagagtgaaagaagagtcgtgtaggttacaatttgttaattattaatttttaatttcgaaattaaattaacgaagagccatattgagaaaccaagatagatatatagaactccatatttcacaccagtaaccaaaacttatatggcatgtttaattatttaacaggaactcttagtttgaaattatttgattcttcacaccttttaattgatcgatctgcataaagtgggtagatggtcgattattttggaagacggttctatgtatgtattttcacacatgctattaaaatttcatatatttgtaaagttaacattagtactaattttaatgcaagttatatatg

SEQ ID NO: 41752 - DNA, 1501 bp, Oryza sativa
ggttgatggcaggcctacagagaagagaaaacctccttggcttgggctgaaggatttttggttggcaataatgcataaatagacaaactactgtaattgtgatcactctagattttttactatacttcataaccaaattgtacattttcattttggaatgtttattatgttatcttcttgagatactcggaggccaaatgatctttgagcaatttgtgttggtttcaaatcatggacttgattgccgtttactttgctactgtgtattgcgttaggtttgataactgtgaaccttatgcatcgtattgctgagtaaacattctcacctcttcaccgtatacggtaagaggttgatcctggacataatatttgaaccttcagttgaaatatagtttgagctgaatctatagttttaaaatcaagttgtatgattttgtaagaaaaaaaatcaaaattaagtatgattgtacattacaggcacccaaagttgtgcaacgcacgactaattggctagtgtctcatgaaaatgacaggcaaacctaaagcagagtcatacacacagagagaaaacaagcaaatggtcatcgttggtttatcagatcgatcgagatccaatacatcaccaagtgtattttcttgatgaatttaaacactgaactcacttgtttgtggcagacttgttacaccatacagatcatctgaatgtggatggcattgcaagatgatcataagtggcgaaaggtgaaatatgaaaggccacaaaggtggcaactgacaacctgatagagctagcctgatatcaacaagggttcctgaaaaaagttaaaagtttggggaaagttagaagtttggaaaaaaaattaggagtttatgtgtgtaggaaagttttggatgtgatgtgatgtgatagaaagttggaagttgggggtgaactaaacacggccaagataaaatgttcagacgaagcaacgttgaactatagggtagattgggatcctgacaaaagccaacaattccaagtcaactaggggtgtgtttagttcacgccaaaattagaagtttggttgaaattggaacgatgtgacaaaaaagttggaagtttgtgtgtgtaggaaagttttgatgtgatgaaaaagttagaagtttgatgaaataatttggaactaaacacggcctaggaatattctgatttctggaggcatgcatcttcttggattctcattggaatattccaacttccaagtccacattgtgaagaaagttgtccgcaaatagaattacatcatccattaacttcttcagaataagaaaagacaggtgacttatgtgcatggatgtccatgcatggagaaataaatcattgcaatcaaacctaatgccaacaaaatggaaaaaaaatattcaggaaaacactgcaatctgtggattcaaatgtgcctatttgcactgcactctactgttatagaacttgagttttttggttcctgcagggtgaagcggc

SEQ ID NO: 41753 - DNA, 1501 bp, Oryza sativa
accgggactaaagatcatctttatctttagtcccggttggtagtaccaaccgtgactaaagtggtgatctttagtcccggttattgacaccaaccgggactaaagatcctcgaccccctgacatacatctgacaagggataaaccaggactaaagatcgtctttagtcctggttggtagatcaaaatttttataaccgggactaaaaacaatctttagtcccgattctttttggatccgggactattgtgaattttgccggaccgacgaaagatggtttttccacccgtgtttctgacggtggcagtggctaagttagctgtcatctgtcatggccgcacaagatttttggaaaccgatcaattaatgccaatgtcatgttgataagtctatctttaatttggtactctccgttttctctactactactcccttcatccactaatataagagattttgactttctcttacactgtttgaccatttatcttattcaaaaaattttggattattatttatttcatttatttgtgacttactttattattcaaagtattttaagcataacttttcgttttttatatttgcataaacttttcgaataagacgaatggtcaaacagtgtaaacaaaaaagttaaaatcccttatattatgggactgtatttattggtccattcccgtgtcagttgatgtaggcagtatggcagccccagcaagccacatggtgcagttgatgttgggaactcactagaaagaacacagccaaaatgtcctaactactccctctgtccataataaatcatagctagtcttgtatccgatgaaaactctagtggtaaaaaaaaatattaccctgcccattgttaataagaagtagtattggtgggtgagtagctttgaagagataaaacagttaattgctgaattgaggatagttgagaggataaaaaatgtaaaagggatttattttgagactaactttaaactatagtagtaattgattaattttgtgacagaggtggtcactatatggctgagtttggtaatctaggtttctcaactactactccctcgtttcctaaatagctaaatggtgtgttcttttgcaaaaaaaaaaagaattttatatgaaagttgtttgaaaaaatcgtactaattttttttttcaagtttttcaagctaatacttaattaatcatatgctaacgattgctctattttacgtgcacaggggattagttcctaaccacattttccaaacacagcctaattaagctagctgtgtcatccgacatttgacatgggtgcataagattttcagaaaccgatcaatgccaatgtcaagttgataagtctatcttcagtatcttgtttggtactctccatcgtctcctctatatttattggtccattcccttgccagttgatgcaggcagaatggcagcccccagcaagccacaacatggcgccattggccccgtgccgttcaaggacgtcatcg

SEQ ID NO: 41754 - DNA, 1501 bp, Oryza sativa
agaagatttcagagctaatctgaaacgacctgacgtgagagagaggacgaacggaacacatgacgaacacgcgagagagggagaaaacctgcgtctcgccactggcgcatcgatggggactgcgactctctcgcttggaatcattaggcgttagcgggttagcgtaggccacaggcgccaattggtcatgtactcctatgcagtactatgctcatggtcatggcaggccgaaaggaaggcgtctcatcatcatcaccatctttaatttgcttagactcatcactgaactactcgatctcttttggctaaacctatcatgcattgttcgtgatcaaagctagttagttaattagttaatctgatcactagagatgatcgatctgtacatgtgtgtacaaccgctgcctgattcgctacgcggacaaaagtactccctccatttcaaaatatttaacactgttgattttttaagtacgtgtttgaccattcgttttattcaaaaaatttaagtaattatttattcttttcatatcatttgattcatggttaaatatacttttatgtgcacatatagttttacatatttcatatttttttaataagatgaacggtcaaacgtgtgctaaaaattcaacggtgtcaaatattttgaaatggagggagtattatttactacttgatgatgatgatctgtgctgctgggtacgtagtaggagtacgcatttacgcaatgcggttgccggcggaaaggggcgcagtcggccgcgcgagctgcagtgcaccgcattgcttgatggagcaaaaaagggcacggcggttcggcgctttgggggctctttttataatctccccggagctaagctaagagagaggctaataatcgtcgccggcgccgcccggctgtgcttgtgcatgcacatgaacgaatgatatgatgcaacttttggccagcacaagcctttggaaattggagtttggaacgtgggggatttacatatcctctggtttccatgaaaactcaactgatttttctgtaaatccccatgtatgaattttcggttaaaagtgatttgtttagggatgtcaaacgagctcgacgtaaagttgagggataataaggccctctttgtttgggcttaggcttattagcttagacttttaagtcagtttattggcttatatgatttataagccggtggatttaatgttctaagtttaatggtggagtcatgcatctatctcacataagccaaaaaagcttctccaacctagcttttggcttaatagtgttagagtggcttatggcttaaaaaaaccaaacaaaaaagctgtttgtttgtttaggtttatactttttgacttataagttggcttataagtctaaacaaagagggcctaagtggacttattccaaaagtaaaatatactggtccaaatcggcccaaacccagggagaaattgcaccatagcccacagggcccaacatcctcgccggtcgccg

SEQ ID NO: 41755 - DNA, 1501 bp, Oryza sativa
ttactcataaatgcttacgaatttttattgtgatttttgtgttgaaaatttccattatttctttgcatatatgaaaatattgttgaatttcagtcaggaccgagaccgagaccgaatttgtcggttctgatagtttttcacataaatttggtcttcacttttcaaagaccgaaatgaccgaaagaccgaagaccgagaccgaaattttcggttagaccgaatgcccacccctaattacgctcataggttttctagctagctccacaaggtggtgggctagacaatttagactcgaagccttaccacttttaattatttgatattaggtcattcgcgtcttttttaaaccatctagaggtctttctgctacaaaatatatatactaagttctcacgtgaatgtatattaattacctactagcttattatataaaagataaaaattaaatgtgcacctatgctggtgagaagatcgagctaagcccgacaaagctcatgagcttaggcctcggctcgttaagagctcgagcggttcgcgagtctcgagcttttttattatcctactgacaagtgcacccagaaatgtgaaatagtaataaccatgggtcgaggctgggccagtgagaatgtgagacccaccaaggcatcgaccgcacggtccgcaccattgaaacgggccactgcttgtttcttttcagaaattctttcatgttcttatttttgcagaaaaaaaaaatcatggcattccctcgttatgagttcatcactagattacacaatacctccttggaataaattacaaattctcacggtctaaaccacccctccatttgtctactcgccaactcacttcgtacgcatagattccccacgttcttttatgggttttgcattgattatttttctcggtccaatctatattagcatcaaacatgagcagtgcactgaacacccgagcaatcttgattttaaagtgattgcgaaattaatggtaccaatgaaaatctatggataacaaatgtaagtttgttttcaacttagtaatttgactttgtttaattttctgttcgcttggaatacatccccttgtttatggtagtgagaatggacgtgtacacctgcaacctgctttttgatgattaagattttcttttctagccatttttaaccatatcgctcaactcttcctgctttgagattttaattctagtacctgtgatggttttttttggaagaaatctgctaattttagacaattaaattcgttgcaagattcgtgcacaggcgcacgctggtggggtgagaatcgaccctgcaacctccctattgcagccacacataagtgacagaaaacgctctctcgttggtccttgacctctcatgaatactcattatagtaaagttcacccctttccaacccctctctctccccaccatcggctcatcgctggtgaaggttaggatagggactaggttccctgctcctctagtacttgtagtag

SEQ ID NO: 41756 - DNA, 1501 bp, Oryza sativa
agaagaattaagctgtcgatctctcgcgtacgcgctgcttcagctttgtcgtcctgagcccggagaaggatgcaggcgtgttgaggcactggaccgcgcgcccgcataccaccgctggcaaggtgggggcagagagatgaagaccgccggagcacgtgatttcaccttcactgactgtttgggaggagttttagattctgagaagcagctgtttgatagtcagtttctgagaatctggaaaaactcaaacccagcttctccagtttctggcttcttagttcatttttcagaatatgtaactatagattctcagaagctgtgaactgtttgggatagctttttccaaaagctgcagctgggacaagctcccccaaacagggtttccaaaaactgcagttgggacaagctcccccaaataggacccaagtatccagatcgatcgatcgatggatcgcgtgcgcgaacccgcatgcgtgagaagtgcggacgctcccggccgtttgctagcaaagatgctttctcgttacatatggcccgatttgcggagaccaagatcgatttgatctacgtccacgatattactctcgttacggggtcttacggccgaatttgcggagatggatcgatttgatctacggttgagatgttaacctccattgaatcgacgatcagatttttctaattaacatggaagctcataaaaagtaaccgattaatatagatatagatatagatatagataaatagatagattgatatattgcagcccacttctattccacgctagaagcttgagtaggcctcgcgtgaaggagagtgttggaaaataaagtgaattgtccgtcttttctcatcagattaagcttttaggttaaactgctcaataatgtcgccgccaacgccaacttcgattccgccaccaccgttggaatttaatcttgttgccactgccgattcgatcaatttctccgctctgctcgattttgatttcttcgctggccactgcctgattcagcctaccactgcggcactgcctctagcagtctagctacctctggattttggccccaacatagtagtatctccgttcgatttgattttatcgccactgtctgattttgattctgcccgggatgttggagatagagggtagattgaggaatgttagactatatttggcatgtaccttgattggctcccttcaataaacctctcgatactgtttctataaattggttgagtgtgctatggaaggttgaggcctatatgtactgatctccgcatatcaatatgattatcgtgttgattcatattcactctcatggtatcagactactgatcactcgcttccgctctctaacctcccctccccgccggcgaacatcaccggccattcttccttctccggcgacatgtcgtccgcctcctccaccccaccgacaacttggagaagataacatatgatcatgatatcatgcgggatgcttagcctaaagaacag

SEQ ID NO: 41757 - DNA, 1501 bp, Oryza sativa
ttagttaatcttggttaattagcatatccaatactcaactggttaagaacatgaagcccctagctaaacaaaaaagatgaaaagcagcccagtgtgtttgtgtaatggcgagactacgtgtgtattctcttgtaattataaaacagaaaaatattagaaagggaagatttagatacaaaaccatttggcttcaatttgagataagtgtactctgcactaggtaagggaatagagtgtacgagcatgcatgcctgcaagggttgtggttcatagttgataaagaagtcaccccaaactgtggggtgaaactcaggtgctgccttgggagctgtacaacttgaagaggccatgaatttgtgtgtgtggtttgtctgcagctaactggtttctgttttagttgtgactgacctgcaactacagaaactgtgtgtgcactgcagatggacaccatggagaggtttatataggcaccagagaagctaagttaaatgagaatcacgatggacacaggttatgtctgggattttcccaaaaaaaaaaaggttatgtcttgttatgagacatgcatctttcgttctcttcttttcttttctttttttttgttttttgttttcggcgaggattctctttttgtttttccaaactcaaaggtttccatcttttacaaataaatatatattaccaactactaattaatctccgaaagtgattgataggtcaatgtatggtgtatagcatggttcagttatgccttgcaacggtaaaagacacaagctatcttttcatctcgcttttggcacgtgtcactacattggtttgtgaagaccgatgagaagtagaatctggcttttgtgaagaaaaaataccacattgtagagctgaaatcaatttatttactcaccatttgccacaatcgtaagcatgtatagttctcaacccctcaccatgttgtctcgtccttccctccgatttgttctctgtactatgccaacgcctctgcttggagggatcatccatgtcgatcgtctctttctctcacatggatcttttgtgattcataatggaactcaattttgaggttttgggagacatttcttttgataagttatttacctcgttgaataatcttgctagcaagaaaaatgtcgtgttggccaatgtgttcacaaacgtactacttgatgtctcctttagaaaagccctaattggagataatcgggtgactttatatgatagggcaattgcgttttttaccctactttgaagactaaccactgatttggtcatttgactctcttttttagaaacgaaaatggggcttgaccctattctgtgaaggcaacatgacggtgttaactcaagacaaaaatttcatttatacccttgtgaatttaacctagtttctcaaagttttttattcagttttgtgcaattagtatatattaaactgaatcaaacaaaatttcatggcacaaatttatgtccaccaaaaacaaaaaga

SEQ ID NO: 41758 - DNA, 1501 bp, Oryza sativa
tactactcaatgtcacaatgtcaagaacactaaatttatgtttttcagtgatgttgtccttttttcttatataatttctgtttttgtaaattagtgtttggtccctgatgacatatactcccatcatacataattacacatggacttcacatgttgaagtttgtttatttcagggagttatgtcttctgctccagatattattggcaatgtatcgcatgctcatcatagccatggtagcagtgggcatcaccatggaatagatttggaacatccaatccttgcattgagtgtgacagcttttgcaatatctgtcaaagaagggtaagtgagtgttttctactgtactcatgctgcgaaaactgtgtaagtttttcttttgttgttctaccagattttacaatcttatcttatgtggtgtacttcttgctgttttcagctactaagtgttattcgctacccttcttgatattatttttgcctaccatgattttaaattttatggtctcctgtaatataatgcttgtaattcaatggcagaagtgtttctttgttaactttgttgatagtagaatatatgtagctctgaacacctgacattatgtttctatgttttggctaatgattatttttctatccgtttatatccatagcaggtagcagcatctccttaaaactcttctgttttaatctgaatttattttgtttattaatgcacagttaattatcatgcgacaaatcacataagaagatctgaaagtgtaaaattaagttacggtctggaattacaggctctattggatcacaaaaagagctggagaaaaggaagggagcgggctgatgaaagctaatgcatggcaccatcgctcagatgctatttcttctgttgttgccctattaggggtaggtaagaccttaaatgaaggcctgaactcccattttctagtaggcaagttttcttcatgttttagatcctgaatggtagaatgatgcattatgaaccccgagctagaaatagcatccattactccctgtgtacagtgggggactgttggctttggaaatagttgtatatgtatttgacctggagtttttatgcaattgatatgagagcactattttatcttgtagttagcagtattaagaaaaatcacctggtttataaatttcaccttgaaggtcttacagaaattacagtgtttatgttaagacattgttttgtttttcaggtggctccattcttggagttccttatcttgatccactagctggacttgttgtctcgggcatgattcttaaagctggtgttcatactggatatgagaggtaactctctttttattgtcaagcaggattgtcaattgaacttgttttgtcagtcagggttttcaatttaacttggtcatgatgagttcaatgatattttgtcaatctcaaatcaagaattgttttctactcaaggaatattttgttacgcattagtgtttcttcttgtctaattaa

SEQ ID NO: 41759 - DNA, 1501 bp, Oryza sativa
ctatttattcttaactagtaccggcatactacgcattgatactgcgatcgctcactgtactggaaggtttagcactctatgctgatcccaattttaaggtgctcgctgcctcgtacccttactttgcgaaaaggctactcactgatcccaatccatatctcagagatgctttaattgagctactattcaaggatggaaaattcaggcaagtttatgtcctcatgaagtagttaatgaggagttttgactactcttgtcagtaattgcatcttgtactgattattctactgctatttaaccctagtattgcttctatacagatggaataggcttgaaaatcttcttgttcaagggagccaagatagagagtttgcagcaaaagatgctttgcaaccagttctaaagcttctacttggtcctgatggggaggaattgcgagtcctagttgtgaaagaagcggttcgtgtcacagaagccatcacttttggaacgctgattgattcgtataatgcagctccagaatttcttaaaccattaatatccagtggtaatccagccggaccgttcaagataagcgacactgaaagggaacaaatgattgagctgcgggacagggttttcagaatatggggccttctgagatcctcggatggctttgacccaaccatcttgcaaccaattgtgcaggtatacttcagcttcatttctcagtacgtgtgaatgtgtgattcaacctctatgaagaaatattttagctgataccatggagcaattttgatattcattcaggtgctacaagagccagaggcccgcgttcttggctcccgggttgcaggaggtgttacgcagcgcctcgcggcccgcctgttgcagcagctgctgagaactccacctgctccaggatctccttagcagataagacatgtaaattcacacggtactttccacaggaaagagaaaaggaaatgtaattcggaaatcaagtataaagttgatttcttcattcatgccggataaaaagatcccctagatgtttgtagattgttctcaaagcctggaaaattttgggtctacgaaaatcagaaactcttctccactgaagccactagggtttgccaaaccgagttgggaacccactcacttctttttccgcgcgcacgcttttcaaacggttaagcggtgtattttttgaaaaaaaattctatatgaaagtggcttaaaaaattatattgatctatttttcaaaaaaatagctaatacttaattaattatgtgttaataggccgctccgttttttgtgtaggagggacaagttctcagcaatagaagattaatagtaaaccacttcaatggtatgtctacatgggtatctatagctctctaatccattttctcgtttttctcattagactatctccaggttagtagatagctttgctctctttctcttcatttaatctcttccaagtaggaaaatatgctgacatggatcttttgtaga

SEQ ID NO: 41760 - DNA, 1501 bp, Oryza sativa
cttaatacagtttttttgaaatttgctcttagtagtatttcgtgttatcgcatttgtatgcatttacaggtacatgcctcagattagctaacgcccttctatgatgaggaaaggtaattttcggcctctgaatctacagaaaaacagcgattaatctctcaaaagaagagtatgtaaacgacagcacgttccaacttccaagctcatttctgacgcaagctctgagcaaaataagaaccggcgaaagcaacattgttgggctggtcgcccatcgtttctgaacacctcgcgatacaactgcacgaggcacaccagttttctcttccgtctttccgacggcgcctccatactccataggctgctgcctgctgctgatctgaattctgtctgatgcaccgcacccaccctcccgcagcggcattatctgaatctgagtagtcaagctgctcaactgaaaagtggaagcagccaaagcaggataagatttctgagagcaagtttaatagtgtagtccactacaggctccaaatcatttataaccaatgtaatagtcaattcatacaatagttgtttactataccattaatatttggtcccacctgtcatacacacgttatgtcttggagtccgtgttgcagctggctacagatctgtagcccgctgctcttctctctcttcttttatctctttaaaatatgtttatagctggcttaggcctcctttaatggttgagctagtgcactagctcatgcttgtccacctcatacaagagatagcaaaaagtctacctctccaatagattatctcatagcatattgtttaaaatgctttgggtttcacaattcctctcacattttctttaggagcttagctcttgaagaagatatagtgcattctctctccttatcttctctctcttccacatcatataaaagctgatatggagatttataagctagctgactcatccttgttggaggagcccttatagcctgctattgtacctgctatgattaatactagtactgtcacttacctctccgttaaaagggacagatataggttggtattttttttcttgacggaggaagtactcgaatctcaaatctcagttaggcccgggtaattctgctatagaaaagaaacaattaacaaaatgctgagatgaatgaatgttcaggcgaaaattaatccacaatgttctcgcaaaagaaatataattaattcacaatgtaataggacggacacgtcatgacagaagaagcatctgttgaagcgttcacgagacagatgccgcataaacaagtgagacatgccacccacgcgtccatctaatctaatctaaccaccctgcacgaatcgcgacgcacccccctgcgaagcattccgttccaagcgggcaagcgctatatatcgccgcggcgtcatctcgacaaggcacctgccactcgcccactcctcctcctcccccatcctccagtgctacggtgtcacgcagcca

SEQ ID NO: 41761 - DNA, 1501 bp, Oryza sativa
tgtctgggagcatgcgtactacctgcaggtaatctcatgctgttgtgggggtcagaggcacactcattgtttagttgctcttattctgctgttggttattattcctaatggcatgttgtaatttgcttatgttgttagtgttgctagcgccacatatgatgtgttcattgatcacaaattcacacttgaatgagttggacaacttattccccttgtagcatttgcactacgaagctattgcctttttttttaagataatggaaagaatcctgggctttacttcaaagaagctacaaccacttattacataattcactgaatgaagctactgcttgaaaatacggttcccattgttttccacaagacctaacaggagcagagtagaatgatatcacattgtttcatgggttatgtctcaaaagatcagagaaaatttaggagtagtaggatgtgactaggcatcgaatacgcatgtgcatgaatacaaaatgtgagtaccattgaagattactagtattgtacgttctgaacttctgatgtagtacatagtctgactatagaaggaatagttacctctggctgtttaacaacttacaacatcgtgcacacccaacttatttgtgcttcgaatttcaacctttgctattgctaaacagtcttcattgatttccgtggttgcagtacaagaatgtcaggccagactacctgagcaacatctggaaggtgatgaactggaaatacgcaggggaggtgtacgaaaatgcgactgcttgatgttgtctgaaggcaacgctcatggttttttttcacctagtactgccatggatctttgtatgcaataaaaatgggcctattgcacttctggaccttgtgtacattgcgtagaggtggactaatgcataacataatatgcctgagattttcttcttgtgctgctttcctgcatttctttgctcctggtgtttcactgcccatgcatttactactgcgccggtactgcctttctgtgccaattcccgttctcaaagcgaatgaataattctgtgctgatatactacctccgtttcaaaatatagtgacttttagctatgaatctggacacataattgttcagattcatagttaaaaatacttatattttaggattgcttatattttgggacggagggagggagtaatgatgtaatttaggaagaacactcgtacatatggaacgcatgcagttctttgtaaatttacaagaatagtctcgtggaacgcaagtaatggatcaaccaaaatactaatccccctcgtacctcagcacagtcctcatcgcctggtgtacatgcgtgcatctttcatataatcgcggaaaagccacgacacttgtttttaagtgctcaagttgtataaaagttggatgtgagcgatatcttttgtaatatttagaatattatctaaaaacaatatgtttaaatgtatgttggggaataatttcatcagattatattttaaccat

SEQ ID NO: 41762 - DNA, 1501 bp, Oryza sativa
catattgatgctaatgaatctagacatatatatctatctagattcattaacatcaatatgaatgtggaaaatactaaaataatttacattgtgaaacggatgaagtattcatatattaatgactcaactgcaaactccataaaagttactttaaacactctcttcaacccaccaccttcacgacaaaatgccaagcttaaagtctaagttggcccaacttctagaacagcccaagcctgctcatcttaatccaatcccttcggaggaattcattcaaaagcctaggcaagccatgtgatacacacggaataaataattaggactaaggttacggtctcaaattctcaattccacagttgtatatgacggacgacacactagcctgtggtcaactttgttcgtcgttgtgctccttctgctcccatcccgtccagagacgacggccggccagcctgaggtcgattcgaacagctaaagcacgagcactgctatggccggccacgggcgtcggtgagcgatggcggcatcgacgattactctcatctgctggtttatatcctgtaagctccctctgctcctctttctcaactccggccgtctgctctccgccaatgtagcctactctttccttatcatatcagaataaacaaaactagtagtagtactctgtctaaatttgtactcccataatattttgaatattggaccaccttttattactaagctttcactttgaactacccctttacctatgttttcagtttggactagttaatatttcctttttgttgcactctagaccaccttctctcttcatctccttcaccctgtcttctcccaaactccgatcaccaaactcctccatcagttgtaggctttattttggcaatggctcttagcagcagtcgggcttggtgagtgaggcacactcatgtactcagtggtcgattagaggaagcgaagtaaggcaaggcagtggctcttggtaatgatgaaggcagcagagagcaagaggccaataaaattattcttttgttgcctccccttggtgttaccttcgcttgattcctcttctatttccattcgaattatttctgcaaattttccaccagaccgatatcaggcgcgctgagacaggtgccaaaatcaagatcattggacgagctatccggctttacctccatcttcaccagcccttggtcgtgctaagctagcccatcacgatatcggcagcaataaagatagagctcaagcgtgtacaatgccggcaacgtgctcaagcatgacttctgccgctgctgtccgtagttgcaggagtggggaggtcaggattctcatgtgatcgatctccggcagtagagtgaagagaaagagggagggagctagaggaacaagaagcctaaattgaaacattttgggaaaaatacctagtccaaggtgaaaagcttagtttatccctagtccaagatgcaagactggttaaaaaatgtgtctcaaagtg

SEQ ID NO: 41763 - DNA, 479 bp, Oryza sativa
gctattttgcgatgttgaaatgtaaaatgaacacaatgatggatgtaatttctcttttttttgctataaaatagaacatatgtttctgtttttatataggagttgatttttttggttcaaaatcgtctattaaaatcttttttagaagatgaaaaagtaagtaagctttataaaagttatttagagaatcctaccactcatacgagagacactattgaaaaattattcaaaatccacgttagaaaaattcaattacttagttatttttcccatgttttgtattttgaatctcaaagatatgacaaacaaatccgtcatattaaccaagttaatcagttaacattagataatgacattaatgagggtgagaacaaattcatcgatttaattccagatgaaagtattgatgatgattctgaatggatacattctgacttcgctcatttggaagtaattttcgaggacaagcaactttataa

SEQ ID NO: 41764 - DNA, 1501 bp, Oryza sativa
accttcttcctagtcagcgttagtctgcgccgcccacgacccaggaggcgaaggtggcctccttagccagcatcgctgctcgggaatgggagacggctccgcctagggccatgatgctgcccagctcttggcctgcctaagtggtcgaccgccgtcccctgcttgagctcgtcggcgtcgtcactgtcatcctctcctgcctctccttgcctgaatgatttcagcacagagagtgagaaagagagaagaggtggagggagagggaggagaaaggggaggaaagatgaaaagtagtggtcactgacccgtaggtcccatgcattatttttactatttttgttactgtaatgtcacatcatatcataaagactaagtcgatgcgatatgtggatgccacagcgaaaatcaccgagggaatcattttgcacatgttttaatagatgagggtcaagatatctaacattgcggttaaggggtacgaaacagattggagctataattgagagagttaaagtatacttattcccaacaaaatgtgccagagctagcagagcctggttaccagcccagcgaaaatggaggcctgcgacccctcgatgactaggcctaaatgggggcaatgtaggcccagctgcatcagctcgatgcctcaatccatgaagtctaccagccatcaagaaaggaattgccattttgccatcaccgtgcgaatcaagaaaatccctctttcttatcgctctcattcacttggaaattattcaccgtaagatttcttgcttgtgattgtttgttagttgcatcaccaacttaatttgttgcagtcttgtataggcttttgatcggcgtaccctactggcgtgtggcattgatgattgatgaaaagatccagttccttggagttggaacttggaatgtctactggagactcttaactactttctctgtattgtatataataccggattaaacgcagaatccaataattagttactgtttaacaaagtactactactccctctagtaaaaacaaacttttaaaaattttgactgtcgataacttatcaaatgctaagtaaaaaaaatataacacatagatttaccttgaaattaactagtatgataatatcgtgaacttatttttatatttattctaataaactagttataaaaatttaaatcttgtccaagtaaatacgaagtatttataagagggggggggggggtaccgttgaaactagcgtgcgtatgactaggcccgttcttttttaattaagatacatattttaccttagtttttattagcacgttttttaaaccgttaaacaatgtgtttcttataaggactttctatataaaagttactttaaaatatcaaataaatctattttttaagtttgtaataattaaaagtcaactaaacttatgctaatggcttgcaaaagaatacttagggatacttgcaaaagaaaacataataaggattggaaatccactaaaaata

SEQ ID NO: 41765 - DNA, 701 bp, Oryza sativa
agatcgaaatcatcatcaacaaatcaatcggcatagccttgtcttcaaatcgagtccgattgccatctcgtcggctgatgcctcaatatctctcggttggatttggacaagtctcagaggaatacgagccctgcatgtacagcacgcacatgcacacaagtgctgtatgcacggctgtgcacgtggaggccaacactcagagcaccgatacatacgatgaccgaccgaggacatcccgacgtgacacatgcacgtcatccgaggtaattagtgagattgattttttaaattgatctactaattttgtagatacatccggcatatatgtacaaagatatttttcaggaacaactgagcactcgagtaggttgtggtcaagtacaccgtattatcgagaacgatctcgacaaatgcaaagtcgtcgcgcccccaacccaccaacgaagagcaacgacctatctcatagcaccggtcatgcctggactactcgaggaaaggttgttaacggataattcctcgcgaacgccgtcggcttgatcaccagacatgattgcgaacggacatccggatatgctacaagttgggtgtgtgagtcatgctggctatatgagacgcacataataaaccaactctagcacttccattggtgttggagagataactctacacgttcgctggtcctcgaaccagtacgtagcaat

SEQ ID NO: 41766 - DNA, 392 bp, Oryza sativa
ttgtggataataatttataaaagaaataaatggttaaattacgatattcaagatcgattttacgtcttattctatatccgtcctaaaaagtgcaattctcgattttaattttgtcccaaaataagtaaaacttatagtgctacttgttacttgtcccattaataacaactaatttaaatgttctctaatttacacccaactatcttcacactttcaaccaccccccaattgatagggaacagctagatgattttccctcgttgttaatttatccttctactcataaaactgtatttattctaggactgaggtaattttttagcatggagtaaagtgttacgttcttttgtccgtcatcgtcaatctcctctatttttttccttctctgaaga

SEQ ID NO: 41767 - DNA, 1501 bp, Oryza sativa
ccataaacaaggggatgtattccaagcgaacagaaaattaaacaaagtcaaattactaagttgaaaacaaacttacatttgttatccatagattttcattggtaccattaatttcgcaatcactttaaaatcaagattgctcgggtgttcagtgcactgctcatgtttgatgctaatatagattggaccgagaaaaataatcaatgcaaaacccataaaagaacgtggggaatctatgcgtacgaagtgagttggcgagtagacaaatggaggggtggtttagaccgtgagaatttgtaatttattccaaggaggtattgtgtaatctagtgatgaactcataacgagggaatgccatgattttttttttctgcaaaaataagaacatgaaagaatttctgaaaagaaacaagcagtggcccgtttcaatggtgcggaccgtgcggtcgatgccttggtgggtctcacattctcactggcccagcctcgacccatggttattactatttcacatttctgggtgcacttgtcagtaggataataaaaaagctcgagactcgcgaaccgctcgagctcttaacgagccgaggcctaagctcatgagctttgtcgggcttagctcgatcttctcaccagcataggtgcacatttaatttttatcttttatataataagctagtaggtaattaatatacattcacgtgagaacttagtatatatattttgtagcagaaagacctctagatggtttaaaaaagacgcgaatgacctaatatcaaataattaaaagtggtaaggcttcgagtctaaattgtctagcccaccaccttgtggagctagctagaaaacctatgagcgtaattaggggtgggcattcggtctaaccgaaaatttcggtctcggtcttcggtctttcggtcatttcggtctttgaaaagtgaagaccaaatttatgtgaaaaactatcagaaccgacaaattcggtctcggtctcggtcctgactgaaattcaacaatattttcatatatgcaaagaaataatggaaattttcaacacaaaaatcacaataaaaattcgtaagcatttatgagtaaagactcttattaggttgcatgcctagaagaagtagggatgtgaaaattagagtttaatcctattaaacatagtggattgtagattgtatttagacattttttgataattcggtcttttcggtctattcggttatccgaggagactaaccgaattgaccgaacaaaattcggtctttcactatctaggaccgaattgatgaccagatttctcggtctcggtctttttggtctcggtctcggtctttccggttcgctctttcggttcggtccttttttttcccacccctaggcgtaatcactccatatatccaacgtcccatgttagccacgccatcaaagcttttggctggtggctgccgctcgcaccggctgcaaacgctcgtgctcaccttgtccatggcgccca

SEQ ID NO: 41768 - DNA, 1501 bp, Oryza sativa
tcagtctcccaattctcttctactctgtgatcctcgtttgtatacggatgtgattcttggctatggtggcaggactgatacttaggtaaatgtcatgcattgttctaagctcgtggcaaaccgagggtccaatagatactaattatctaattattgactgatatactaattaatatgatgtaaattaactagaattgaataatctacctggggacctctgaccccaggaattactatgtagtaacgccacttctaagaggcatctgtctaccaatttatgggagttttgcaattagttaactgatatactgactgacaagacgacaatctcctgttcccacttcctttgttgacataggcagtttacttgcattcataatggaattgcagaaacttagctccactagaacataggctgttactagggtcatgttttatgtgttaaaactgttaagaatagtcaaggctcatatatgatgattagcctactttttgaaagaaaaaaaaaagaatatgaagggagctgaaatccgtcagttgtttacagtatggaagctattactacatgtgcttgtgcgttattgcagccacatgcatgttcatgtgtgcaacaagatataaatgctagaaaagttagtaagggcattttcttactgattctcatgttttttctaagctacctgaattgcttgcgttataataattattaaagtctacatagaacagcctccatgcctatttgatttattgtcttgtttgattgcgctaaaagtgttgaagattccatgtcttattttgcttcccttccaggtcatggaaagtttgagagtttaggagctcttggaatttcaagtatgttattagttactgcaggtgggattgcctggcatgcttttgacgttcttcaggtctattactactcaatgtcacaatgtcaagaacactaaatttatgtttttcagtgatgttgtccttttttcttatataatttctgtttttgtaaattagtgtttggtccctgatgacatatactcccatcatacataattacacatggacttcacatgttgaagtttgtttatttcagggagttatgtcttctgctccagatattattggcaatgtatcgcatgctcatcatagccatggtagcagtgggcatcaccatggaatagatttggaacatccaatccttgcattgagtgtgacagcttttgcaatatctgtcaaagaagggtaagtgagtgttttctactgtactcatgctgcgaaaactgtgtaagtttttcttttgttgttctaccagattttacaatcttatcttatgtggtgtacttcttgctgttttcagctactaagtgttattcgctacccttcttgatattatttttgcctaccatgattttaaattttatggtctcctgtaatataatgcttgtaattcaatggcagaagtgtttctttgttaactttgttgatagtagaatatatgtagctctga

SEQ ID NO: 41769 - DNA, 1501 bp, Oryza sativa
atagtttcagaaaatctagttcatgtttcttttctttgaagttggtaagctccacctctgcgagtaacttcatcagaacattatgagctccctagcttgttgattgatagcagatgcaattcaaagaacatgattcttccccctgaaatgaaagaatatttaggtgtagttgaagttttagttttggaacaaaaacaaaactaagatatgaatagactgattctcttatgagatgttaaggtggagacgtcataagtagattatacaaaagagttacaacatagaagaaaaaaatattttaagggtaaactcagtaagaaaatatcttctttagattccatctaatgttgtcaactaataatttttctaattcaacgcaactgaaaatgcttcagagcaaaattgtctcgttaagtgtagtacctcaggtcccctttcaatttttattctctcatttttttaatacctattattttatatcaaggagcaaacataattccttggcgatctctaaatgaaagtttaacgtcttgttagttttgctatataacttggttaaaggagactgtataatagcatgccacttgcaatttagtagtcttgcttctgtgtaatagcacctgaaagtatataattgaattttactgttggatggccttgaagatggaatcactacttaaagcatatgattatgtagttatgcattactaattaacttaaagaagtgattttagatataacaacatttgcattctgccttgaccattgcacaacaaataattacctagatgcgatgcctattctagaaaataaaaaacaatgaagaattaggcccatctttaaatcccacaaatccttgatatgactcacaaagcctcaaaatcctatatatgaaagaatgagatgtagtgttttgcataaatagtagaacgaatgcattctattgacctttgcttcctccacaccattactcacgatttatggtgatcctacaccagttcattatagtgtgctgacacatctatcagtgtgaaaatcaatgtacttcctccgttctgtattataagaccattacccacatttatatatagatgttaatgaatctatacatttctagcacatctatatgaatgtgggcaatgctataaagtcttataatacgaaacggaagaagtaatatttaccatgattgtagccatacagaaatttgtgcctcgctcttcatcactccatctttggcatcgtctcttttatttgagccgatctgcagtggtaggccacagcgtgggaagacagataggaggggatgggatatattgattatgtaacttattaccagatacctgggatgggatcatgggattcagtgggcaagggaggaagagatggcgacagtcttgttgcagtacttctgcttgaatttgcgatctgatttttgacctcgatccaccatcgtcgatctcgatcttgttctgttctttgcagctgtgattcggatcaa

SEQ ID NO: 41770 - DNA, 1501 bp, Oryza sativa
cgatttccccctttgcagtatcatggtgatacttcggggcatggcgacatgtgtggaatcgtgtcttgtgggtacagttgtacacttctggccagagtaaaactattcgaatagccatgcccgcggttatgggcgatcaaccagattcaccgtgattagtctcacccctagtttagcttaataaactggtgtagttcagatggttggttgggcctgttgcaacgtggtgtagcgttggacagtgtttggttaatattgattaattactataactgttttactgctttcaactactgtttttaaatgcctactttgtgcaaagagcctttagcctccttaggttatatcctgcatcatacctcctcttccggtataacttgctgagtacagtgggtagtactcagtcttgctatcttttcccccacaccagagctgaagatcttcctagtgggaggtgtcttaccgaagttggtttcgtcgctggcatcaaggattgcctgtggagtggagtcgccccgctgcagaagtcaagtttccaagtctagctcgtttttcttttgcgctgcatttgtaatcttttccatttttgtaagacgtggatctgtatgtcaacaattgtcgtttgtgtaccctggctggtcctggacagggatttaatgcacattcagcttcgaaattctggttcgtgaatttctgggcatgacaagttggtatcagagccgagactgaccgtaggacaagccaactggaaacctaagagccctctgaaccccttttcatatgcatatgcctttttcacttggatttgtttcgggaaaattttgggttttgcctctttggtttgtgggaaaaatcttggtccttcattcggatcggatctttaaaattagctcagtctagggttttagtaaaattttatttggagtttatttgacagtcagtcgggaatctatcaggtgatatgcattaggtcgtgtctatgttcgatggggcaattttatgcgcattattttctatgcatctaatttatgcattaatttattgtttagtcagttgcattagtgtctttatctgggttcatgaaaaacgttctatgcataaaaatcagtcatgctaggttatttatttgagtcatttgttgctttgtttaatttggaatttagcatgaattggttcttatcccttgtctactttagatgtcagtcctatccctcgattgcaatcgccgctccgagcttcagagtcgccgcccttagttttatcgtcttcttagttttgtttgcttgctagtttccgtgcttaggtttgttgcttgtgggttagttggcggtcgatatcatgtgtgagtggtatggctgacttaattaagagttgcgtgcctctttttcagtgttttaatcaagattaagataattgcacctaaatttataagaaatattagtttctgagccccctgtttttcttccttttctcatatttctacctatcccccttcagatgg

SEQ ID NO: 41771 - DNA, 1501 bp, Oryza sativa
tcaggtctattactactcaatgtcacaatgtcaagaacactaaatttatgtttttcagtgatgttgtccttttttcttatataatttctgtttttgtaaattagtgtttggtccctgatgacatatactcccatcatacataattacacatggacttcacatgttgaagtttgtttatttcagggagttatgtcttctgctccagatattattggcaatgtatcgcatgctcatcatagccatggtagcagtgggcatcaccatggaatagatttggaacatccaatccttgcattgagtgtgacagcttttgcaatatctgtcaaagaagggtaagtgagtgttttctactgtactcatgctgcgaaaactgtgtaagtttttcttttgttgttctaccagattttacaatcttatcttatgtggtgtacttcttgctgttttcagctactaagtgttattcgctacccttcttgatattatttttgcctaccatgattttaaattttatggtctcctgtaatataatgcttgtaattcaatggcagaagtgtttctttgttaactttgttgatagtagaatatatgtagctctgaacacctgacattatgtttctatgttttggctaatgattatttttctatccgtttatatccatagcaggtagcagcatctccttaaaactcttctgttttaatctgaatttattttgtttattaatgcacagttaattatcatgcgacaaatcacataagaagatctgaaagtgtaaaattaagttacggtctggaattacaggctctattggatcacaaaaagagctggagaaaaggaagggagcgggctgatgaaagctaatgcatggcaccatcgctcagatgctatttcttctgttgttgccctattaggggtaggtaagaccttaaatgaaggcctgaactcccattttctagtaggcaagttttcttcatgttttagatcctgaatggtagaatgatgcattatgaaccccgagctagaaatagcatccattactccctgtgtacagtgggggactgttggctttggaaatagttgtatatgtatttgacctggagtttttatgcaattgatatgagagcactattttatcttgtagttagcagtattaagaaaaatcacctggtttataaatttcaccttgaaggtcttacagaaattacagtgtttatgttaagacattgttttgtttttcaggtggctccattcttggagttccttatcttgatccactagctggacttgttgtctcgggcatgattcttaaagctggtgttcatactggatatgagaggtaactctctttttattgtcaagcaggattgtcaattgaacttgttttgtcagtcagggttttcaatttaacttggtcatgatgagttcaatgatattttgtcaatctcaaatcaagaattgttttctactcaaggaatattttgttacgcattagtgtttcttctt

SEQ ID NO: 41772 - DNA, 1501 bp, Oryza sativa
caagcttcccacatttgtacaatgtggccaagtataaggaagattcggtcaaggatatgtgttctaggcaattggaagattctttcttactccccctatcgcctgaggcatatgctgagttcctacagctggaagaaaacttggatagcttaaaaatccaatctggaagaggtgacatctggagctttatatggaactctgatgtttacacaccaaagaggttttacaaaccaaacttcactgctttgcaaccccccagacctctcttgtggctatggaagacaaagtgtgtcatgaagataaaagtttttgcatggctcttgttctgcgatagactcaacacatgtgatatgttggacagacggcactgcgccaaagaagatgatgatcttacatgtgtcttgtgtgatactggccagagagagacaagactacatctttttttcacatgaccatttagtgcaacttgttggcaacacctagggatccaatagaaccgaaatttggaatttttttcagatggtggtcctggcaagatttcggtttgtacatcggggatttctggagatcttcttcttggctgcatggcatatctggaagcaaaggaatggacttatctttgaatatactcagcccaccttccaatcatggagattgctcttcaaaaaagttcttctgcatatgtgcaaaatgaaagatcctctcaaacaactagtttccgattggatacaaactatataggaatcctgtttttctttcacttttgttcttttccctgtaactttgtaaatattctctttcattttaaaattaaactgctaggcaaagccctggcagtattcctggatttttaatgaataataaattttcaagaaatatcttaaaataaatttataatatttaataattttattatattgtatttttaaatataataaatctatgtataacatttttattttttttaaactaaacaatatatgggaataaagtttgacctaatcatcctaaatgccaactatttattactgggatgaatacctttttcatttcctttttatatataaaaaataggtttaacaaaaaaaaaataggccttgtgaagcacatgttgggcttcaagtgctatgagcccaatcgaaaaggtcaatacagtttgaattagaagcttgcaacttttgttcttgtgagattgggtcagtttctgttcagaagtcggcccaacacagcccaagaaaggcaatgcaaatttgcaatgtaaatctagaaataggtctttttggcaaaattagttctatagcatcgaaagttcttgttttcgtttttatagcattgaaagtttgtggttcactttaatagtatatctccgctacttcttttagcactccgttagaacttccgtcacttattccccctgcccctacgtcttcttcatcctccatggcacagcggtaggcgaggtgtaggatggtgtagtcgatgaactcggcagcggcagacg

SEQ ID NO: 41773 - DNA, 1501 bp, Oryza sativa
aacccccaaaatctcgcctttccagctgaaagcaaaatatggaggctcatatgtcctcacagtaacaaccgcgacaggcgaggcggaggagatgaggagactggtccagtccatctcccctaccatgaacattgtgtaccacatctccgggacgcagaagttcgagatggcgaagcaggaggtgaggatctctcaagttttccgggccatggagcatgcgaagctcaggatgaacgttcttgcctggggcttggctgacacaacgctggaggatgtcttcatcagagttgccagggagagtgacagtgcatcatcctccgtggcctgatcagtaaccatgaagaattgttcatctcatggttggagtagcctaagatgttggggaacttcttgtttttttaacgaaccagtactagatgtcctaatttcattgaataaagtaggagtaaaaattttgtataagtaaaaaggagaaccgcacaaaaagtaaaaccaaggatgagctatgagcaggggtggcaaaatgcaagggctgagttcaaaaagagttgtactaaaaattaatacattttttagctaaaaatatttaaaggctgaagtgggttgtgaaagcgcccacgggccctaattcactactacccctagcttcgagagacgtttcgctctggctaagagcaagtttaggagtatagccaactactggctacaattcatctatagccaatctaatagctcatttatacaatagttacacactacactattaatacctgatcccacctatcgtacacactgtgtcttggagttcgtgttacagctggctacaaatatgtagtccgctgctcttctcttttctcatttatctccttaaaatatgtttgcagctgacttatagcctgctattgtacctgaagctcaggtcttgacttcctccttgatttttgtcaccgtcgttattgtggagagctttttatgttggaacttggaaggctctttggctcattttcttttacaaatcccaagcagattctgtttggtataccttagggaaacttcaggcctaatctttcagtggtcagacgcagaatcaatccacttgttcgtcctctcaaaacaagcataatattagtatacattataatcagaacctgtggctgattgagcaggatttgacactacagttcgaactgtatactactctattgactgatggactgcccactcctagctggctagcaagtagcaagtagagaagctgcattgtcatagcaaaaccgcgtcgttgcgtttatcttgtatatatatggggggcaaagccttggacgtgagaactacagccgagtgatctaccagcttcagatttcagagagcgattgatcaagtgtagtagagcgagctccatctgcggccatgggagcagctcgtcggcttcgcttcgggctacgagcgccagcggcgtcggccatgtcggtcctactactgctgctgccgtcgtcgcttt

SEQ ID NO: 41774 - DNA, 1501 bp, Oryza sativa
gaaaaagaggagaggagagaaagtgggtaggagggaaagagagggtgggtatttttccgagtagttctcttaataggtcggtacgtgaaaatatgctgtccaaagaccacacggaaaaatcgatttttccatgtggtcctcttaaatggaccgcacgtaaaaataggtcatattttcctaaacgcgaccagttctgcaatgaaaaatcttttgtatagtagtgaattaatcatgtgctaatgagtttctccgttttgtgtacacgggagattagttcccaactgcagcaaacgaactcagccacaaattatttgatcgaacattgaaaaaaataattttggcaaaacttttataccagtattcttcattgtttaaatgtgtgaggttaaaaacataaaattaaaaacaataaattaattttgaaatttaaaatcaataatggtttacaaatcacatctcacacaggcctagccaataatgtctttcaaatcacattctcaagtcctcacacattcaatgctgtagatagatagctatgccaaaaccatctttattcccccaaataaaaaaagcaaatacccacccaacaatgagaccgcgtattaattcaggtcacccaaatttgcaacacatttcctctttcttttcataccaagaaaaaaaaaactcgtgatcgtcatttcccctttgactcgcgacgactgatgacgagttgacgacgacccacttgcggccactttccttcactcccaagggcaaaaccgtcattacggtgaggcaaagcttgcccccgtattaacgttgccgcctctctccgagggcaaaaccgtcatttcgctgaggcaaagcttttcccccgtattaacgttgccgcctcgctccactcacactcaggccggtttgagagtgtagcgtctgcgtctcttctcttgttgcttcggcttctccgaggttggaggaggcgagctgcgagctgcgagcgccatggcagccagctgcctcgcgcagaccaatgccctcttcaggaaaagcctcgtcatccaggtgatggcctgatggcctctcgatcgatcttgctcttcgtttttcgggctcgatttcgtcgagccgtagagtttttatcagcagaattatgcctttctttgaaagaacatttttgtggcttcttcgttatcttgcttggatgattcagtagtcagaaacttagaatcagtgaagaaatgcttcttgtttagtggtggttttttttctgctcgcggatttgggtgaaaagaagtcgcatgttcaggggattagttctcgttatgttcaatgcggtgattccgatgctgcacgattttttgtttttttttctgattccaagattcgatttcccacccattttgctatgtttgttcataccaagattgtttttcttcgtcaagattagtcacccatggagctcgattttgctgttcttgtgtgcagaggcgggcggggaagacgaactgctgcatcgtcc

SEQ ID NO: 41775 - DNA, 1501 bp, Oryza sativa
tatacaggttcaggccttcttataaaagaagtaataccctactcctgtccggggatgaatccgccgagtgtattattgattgtatgatttggagaagatcaacctctgcccctagaggcgcccagaccccccttatatatgggaaggagtccgggttacaaaagataacctatatccctaacggaatacacagatacagattaaatacagtcgtgaccgactaagtttcaaggtgtttccttgatatacaagttaggaaacaaacccaggatacacataagatattctatctatattcggtatcctatattcagtccaaatatcatcgccgtgtagatatgggatatccataatctccacagtagcccccgagacctttgcagtcaaccatcgtagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatatgcggcgcctaaagaggcattctagccgactgctttttagccataacaaaagaaatccgagtggttaacactctaaaaggttcacgaatgaacccacttgacaggcatccgaataaaaactctaaagattacccaccaagtattataaaaattatggcaataaataagtctaatagcctaggctatgactatttaccataatgaaaacaggcatataacataccagggaaatgactatggtaaaaacaagccactccaagttaacacagacagcttttgtagcctaaaaaagcttacaaaaacagcataacgcctttctgtcgggcaccttttaatttgcattgcaataattccaaagaattatatgaccgcataaaaaggattttatcagcattgggcaacactattgtgcgcataatattgccaaagcaaaatatgcctaagtccctaaggaatacaatgggccacgctgttaaaagtattgggctgaagtactgttcaggcctaggcccattcgcacctccgatacccttaacaagaaatcccgagatccaagcgacgcttcgtcttccccgccggaactctcgccattttccccactccttgctacagtgcagaactgcgccggcgaactagggttcactactccactcaaatccaccttcgaaaagtgcatcaaaatccttcccgtgatccaccgcctcaatccctcacttctccccggccatccctcgaatcaaatcagcgcattcgggtaaaatcgatgacggaggagaaagaaagctttgaaggccaatgggcgccgtccgacgtaacggaagagaacctgaaggagatggtggcgcacggcgttctccctgctaaggagatcatcgggtggcggc

SEQ ID NO: 41776 - DNA, 1501 bp, Oryza sativa
gtcgtttccggagagttcgttttcgccggagaagagtttgaagagttccaaggccagcaaggcaagtcacacagatcccaaacaaccctttgagcatattgatcctatttaaagctattatttctattcaactattgcatttattttcgaatgtcattgggtggaattaacctattgtttgttatagcccttttgttcttgtttaccttattccttgataccttgggttattataatttgactagttgagctttatatattggttcaactagatattaggtataattgcttagccctgcttagaaacattagctcactattgggataacttatgattcactattatttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcgtggttcattgcggggcaccagactgagaagtggcggagataagcccacgggggtcgctgggagtccatgccttgtttataagggggtgattatgatccaggaaggtgcgctgcaatggattgtgttatgcgaggggtattgtcacaactcctttccgagatatcgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtttcacacttctcaccatagtaaatgatgctataattggtaacaatttgattagctcctggtttggaatggaatggtacattcctggtttggagatagaactgtgcagccgggatggttgttcagaatggttgggcctatacaacagggtatgttgtatagtgttggtttaatattgtttaattattacttaactgttttattaaattctgaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggagtaggtgtagccttggtcaagctgcctgtggagtggagtcgtctgcgccgtttattttattttccgctgcttagatcttttttgattgagaggaactatctacctctgtaatgacattttattcgcttattaattagagtaataattgtactctattatcaatttgttgttgtgtgcctcggctgactcctggacgagggttcacacacatgtaagcgtttggaattttggatagaaattccgggcgtgacaagctcaga

SEQ ID NO: 41777 - DNA, 1501 bp, Oryza sativa
cggcaatatgatgaacttatgcagagacttgtgttgtagatagagtaatcatgaataaagaaaaccaaaaccatgatatatgatatatctagatcctcacactcatggaaatgaaaaatgcatgtcaaacatcacaattcttcttgtcgaacaagaactaggattggattgcttgagagataacagcaaaaatggcaacaccttgaggtattttctatttgttcactattgggcaataatcacgaagcagtccgagtgttgcttcggtgtggtatgaggatgaaaatcgcttgtggttgtaggcttgtagctcgatattcgttatcatgtcgttcttttttcattcttaatttttcaataaatataggttaagtgcatcctaggtagagaggctagaggtagtcttggagtatttatatcatcttctttaagatcaataaggtttccttttatctcatcacaagcagtgctgtatttaccaagcagtgagctcttgttatttcaacttttatgatgtgtaaactttaatatgggacccaccagcatatgatgggaacttagaagagaatattattacttttttattcttatggtctgctcatatacatatgaactgctatatgtggctcacttccacagtacttgagcaagaccatatagagatatggatcactttttcctcctatatggagtattgatgatgtgaaaacaacaaaacagttaacgctcactcccagtgaagcaaaacaatagccatcctgcacccttaacttacatctgccacaaaaaagctacagtactaagggtgtgtttaaagtttttgaaggatccggacacacattaaaaatattaatcgtagactaataacaaaataaattacaaatttcgtctgtaaactacgagacaaatttattaagtctaattaatccgtcattaacaaatgtttaatgtagcatcatatttttaaatcatggcgtaattaggctcaaaagattcgtctcgcaatttacatgcaaactgtgcaattagtttttttccccatatttaatgccctatacatgtgtccaaacatttgatgttatatttttttgccaaaaatttttgaatctaaacaagacctacatcaatttctagtaggagcaggcttgcagcttacagatatgtacagtgtcacctcaccttggcaatccacaagacttgaaaagtgaaatggttcaggttgagttaggcaagtttgagctagcaaactacccttaccaactccatgcactgctgctccttgcaagcaagtaaaacaactccacaaaaagcgcgggaacatttttttttaaaaaaaaaaactctagctagtcctcacctagtataaaaatctagcgagctccaaatcacaggaagacacaccaccaacgacgcgagcctgaacgatctctcgcacacgagaaaattgcaattagctagctagcaatggcgcgccaccacctcgtcctgcacgctgcgacgc

SEQ ID NO: 41778 - DNA, 1501 bp, Oryza sativa
ttactaaaaatgatcaataagtagaaagcaaaatgattattgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgatttggagaagatcaacctctgcccctagaggcgcccagaccccccttatatatgggaaggagtccgggttacaaaagataacctatatccctaacggaatacacagatacagattaaatacagtcgtgaccgactaagtttcaaggtgtttccttgatatacaagttaggaaacaaacccaggatacacataagatattctatctatattcggtatcctatattcagtccaaatatcatcgccgtgtagatatgggatatccataatctccacagtagcccccgagacctttgcagtcaaccatcgtagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatatgcggcgcctaaagaggcattctagccgactgctttttagccataacaaaagaaatccgagtggttaacactctaaaaggttcacgaatgaacccacttgacaggcatccgaataaaaactctaaagattacccaccaagtattataaaaattatggcaataaataagtctaatagcctaggctatgactatttaccataatgaaaacaggcatataacataccagggaaatgactatggtaaaaacaagccactccaagttaacacagacagcttttgtagcctaaaaaagcttacaaaaacagcataacgcctttctgtcgggcaccttttaatttgcattgcaataattccaaagaattatatgaccgcataaaaaggattttatcagcattgggcaacactattgtgcgcataatattgccaaagcaaaatatgcctaagtccctaaggaatacaatgggccacgctgttaaaagtattgggctgaagtactgttcaggcctaggcccattcgcacctccgatacccttaacaagaaatcccgagatccaagcgacgcttcgtcttccccgccggaactctcgccattttccccactccttgctacagtgcagaactgcgccggcgaactagggttcactactccactcaaatccaccttcgaaaagtgcatcaaaatccttcccgtgatccaccgcctcaatccctcacttctccccggccatccctcgaatcaaatcagcgcattcgggtaaaatcga

SEQ ID NO: 41779 - DNA, 854 bp, Oryza sativa
acttgcatatttgctgcgtggcttgctgagtatgtcatatactcaccttgcaatcattcatcagaggaagagttcttcaatgaggctgatggtgtggaggagtaggtgtagccttggtcaagctgcctgtggagtggagtcgtctgcgccgtttattttattttccgctgcttagatcttttttgattgagaggaactatctacctctgtaatgacattttattcgcttattaattagagtaataattgtactctattaccaatttgttgttgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaagtagaactgttctcctccctttctcttttaattaaaccaaactaatggcacatgcacttcataatcccttttaatggctctcactcaaaatttattccagtgttattagtactgtacatctattactgtactaatggctcatttatcagcaaaagttttcaatattgttttatttagtcttgctgcaatataataaatttagcatgatgattttataacttgattttatttcttttgaaacctgttattcaaaagtacaaaacttgtgacctcgttttcaactatttcaactcatcttgcaagcttggtttattttatttacttaccttttacttggattttctaaactttattcaaattaatccaaaaacttgtgctattaattggataaatgtcttaactccctcctttcacttgtctttaga

SEQ ID NO: 41780 - DNA, 1501 bp, Oryza sativa
ggcatagtggggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaattatagcatcatttaccatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggctggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaaaagtgagctaatgtttctaagcagggctaagcaattatatctaatatctagttgaaccaatatataaagctcaactagtcaagttataattacccaaggtatcaagaaataaagtaaacaagaacaaaaggggctataacaaagaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttaaagattaaatcggattaaaacacttatatcgatttaaattgaattatgacgcaataatgaattatttttgaaaaggaaaagaaggtttattgcgtcagcgggctagggtttcggtggaccgggcgcacgggcggcggttcacgcgaacggacggccgagatcgaaccaatccaagatggacggccgagatcgatcgggtccacggcggctcacggcggacgaccccga

SEQ ID NO: 41781 - DNA, 1501 bp, Oryza sativa
taacatatggtcccacctgtcatatacacattgcgtcttggagtctgtgctgtagttggctacagatctgtagcccgctgctcttctctctcatcttttatctcattaaaatatgtttatagctggctaatagcccgctattgtacctgctctgacacggggtggccccagcacggccctcctttggggacaaattttttttaagactctttagagtaacattcactttttgagcatttaaagtgaccaaagtgatacattgaactaagactaagggcctgtttggttggcaactaaatttactacacctaaccttaggcaagccaaagttttaatagatagtgtttggttcttgtcacaagtctattttgcctaactcttagccacctggcccacatatcatacactatattttcttgccaaacattgcctaagcttaatttgtcattttatttgccacaaaagtgtggcaagactaagcttagctaccttagtaaaaaatgtgtggcaatattagtccccaaccaaacagaccccaagactaaggctgtgttcttcccccttttctcaacccacctctttcgttttccgcgcacacgcttttcaaactactaaattgtgtgatttataaaaaactttctatatgtaagttgttttaaaaaattatattaatccattgttaaaaaacagttaatcatgtaataatacgagtttcgttttgcatgtcgaagagaagggttcccaacctaagcatatattttcagtttgcaacatgtatctttaccatccatttgcaaattagactaggcttgcagttttgagtcacttgggtggcttacgctcgtgtcggggacgataccaagtggtcattaatttaacttttttccacttttaaaatgtggtaattaaaaatttgctactcgcagttttatgatatgtgagtctaatggcaaatatttaattaccacttgtaagagtggtaaatagttaattattccaataccaagtgcgtgcatcacatcagcgacgacatacataccgtacttgttgtttagagataaattgaattcacaactttttaataggtctaatagttgaaaacaatggatccaccaaattaaatgataaccgatggctaaatgtcttaaatttttcttagaatttctaagatttattagaacaccatgtgacgatctatgagtgtttgtagggatgctatttgaaaaatatgtttatttgatttttaagaaatttctatggccctgtttagttcgtaaaaagaaaacttttgagtgtcacatcggatgtttgaccgaatgttgaaagagtatttcggacacgaatggaaaaaccaatttcataactcgcttggaaacgacgagacgaatcttttgagcctaatcatggactaattagacttaaaagatttgtttcgtgatttctcccctaacgttgtaattagttttttaatctatatttttttgccctatatgtatgtgtc

SEQ ID NO: 41782 - DNA, 668 bp, Oryza sativa
ttctgccatttgccttctatcccttaatcttttgacattaaatggttcgtgaaaccaaaaaggatgcttccactacagtttggagtacaatacactgagtgtcacatttcctccctccctttttatcctgcatgcaacacatagtttggggtacatgttcttttcagtttcaaaaaaagaagaaaaaaattcagtaggagataatctaaagtaatgaaagaaacaacctttcttgaaaggacattgggctacgcaatgtgaaaaacaatgaccataagatgaatgtttcgatgaaagatggacatctgatcattaacatacatgcggtaaaaaaaaaaatgcactagacacttccctcccgatccttcgagtgtctcccctcagacatgtggcaagcaagaaaaagattactccatgaaaaatagataatgggctattggtttgcatggcaattaattggcatactttaatgggctgcactaattaagatcaattttgagatgtcaaataagtaaaataaacatgaacggttgttgtgaagaaaaataggaatacatattacggtagtactgtatgtaacttacgggctacttcagttgtaacaatcaggaaaaaataccactataactacaaggaaaaaaaacaatcttaagatctttcaacaaaga

SEQ ID NO: 41783 - DNA, 1501 bp, Oryza sativa
atcatgccctcaaccatctttccatcctaattttcctaaccgtaaattatttagtaaaaggcactataatcttttttttcccaaatcttaatcaatgctatacaacccagaatgacaagtaatgtgcgagggaggaagtattctttgataatatgaaatctttttagatatttagaaaatttctgcaaaaaatataaatgtttagagtttaaatgtgaatagtatttggtgacaagtataaaggaacggagggaggaaaaaaaacaaatgatgttatttatggtctatctacccgaaaaaattgaagtctacactcgacccgtacttcgctgaaaagaatctagttagaatttgaattttgtagaggtgtatatgtcactttgttagttcttacagatatgtcatatgtgtggcatttgagagatggaagtgggtgaatatatcccagaacatatatattactagctaattaagtttgatctggcttgtctacaacactgtagatgatcagtctagatgtgaatcaaacagttagtcccaattatcggtgtaccttatatctcgctgcactgattagtgtatcacttgatatgcatgcatttcacatgctgagaattctaattgaccaaattcataattgtgcactgttctagcaacgattcgctgcatctactgaccaaaggctccaccccgtagtattactgatgtcataagtttcttgttttattattgaaaatacagtgtaaaccacataataatgtagtgtaaacatggaactaccatacgatcgaaaaattgacctctaggttacgttcaccttacccctagtacactttttactcttagattttacatatgtagagtaaaaattttactttgagtaaaaatggagctgccatgcaggagattaatgggctagacccaattaaatcctaataaattttattgtcccacattaagtgttatgggtaataatatcatcttgaaaatctaagtgaagaggtatcaacttaaatacggagctaatgaagagtctctgttgaccggttgagatggtgggcgaacaaccacgcgcgcggcgtggcggggcgaggcgaggcaggcaagcggctgctgctgctgctgctctctctcgttttgtagcagacggtaataaacacggagaattgattctgtattaacgaatgcgtcagttacagaattaaatgtcatgaattgattccgtcgtttacggaattaaacgccgtgaattgattccatattaacgagcgcgtcggttaccaaattaaacaccgcggttgatgatctgcacgttactcccgtgctcgcatataaactccacagacggacaacagacgaatagaagctccgttcttcctgatgtttcttgcacttcgagttcctcctcctctgttcatgtgttgcagaatccttccccggttctcttcacctgcttgcataggtgtacgggacgagcaggtgcctccggaacttcgtccgc

SEQ ID NO: 41784 - DNA, 203 bp, Oryza sativa
taattaggattaactgatccctgtcaaacaagcacatatgaaacaaggaaatgcttaattattccaaaaaaagataaaatccttagatgattctgccaaataaacaaaccccaaatctagcaagcaaagcaatctgacaccaagatcagcccaagagcaaatcagaccgggttaattttccccttccccctcctccccataga

SEQ ID NO: 41785 - DNA, 1501 bp, Oryza sativa
gtgcggccgccgccgacggcgtgcttgtaggcgagctcgacaagcgataggatgagtccgtgcgtacagagtggcgacgccgagggtgaggaagaagcccatccagtaattcccggtggtcaccctagcgcgtcgtcgtcgtcgggtctgaacttttcctttcctgccctactcaacaacactgaactctgaatctctctctctctttctgcttgatctgctgctgctaccaccacttcctatagatggccaaaaggcccgcatggcccggcccggcccaggcacggcccaccagccatcgggccagcacggcccgatcggcacttcatgccggcccatgggctgcgcctcccgcccaagcacggcccaccagccatcgggccgtgtcgggccggcccgaaggcgcgagtggcccatcgtgccattttctaaataagtctattttttgtccctcctctttgggctgtgacatatatatagcgaaaataagtttattttctgtccctcctctttgggctgtgacatatatatagtgaaaataagtctattttccatccctcctctttgggctgacatatatatagctaaaataagtctattttacatccctattctttcgaccgtggcatacaatatgtctatttttactcctcattgtttatgtctcgggcctggcctgtggcccatcgtgccgtgccggtggagaggcccaggcacggcccggtggtcgggccgggccggtacgggcccgacccctgacgggccgtgccgtgcttgggccgggccaaaacgccgtgccgtcgggcctcgggccttttggccatctataccacttcccaacgtctccagcgtgctcaccgtcgatagcagcagccctagcttccccgcgcagtagatctccacccgcgtgttgcccccctccttcctttccacctctaactgcacctcacaaactccattaatcccatcatcctcctcattatctagtaacagcaacaacaattaatggatgcagctatgtactttgggtgtgttcctggccagcatctcattggggttgagctccctgaagacgctgagcaccccgggcatctcctgctgctccggccggcctcgacgcgccccgccacgcctcgccttgccggtctagagaagactgagagagagtaggaagaaagagaagaggggaaaagagaggtgatgacgtgtcaccttgacatgtgggacccatgcaggcccacgcttactcagctgccacgtcggacaaaaccggggtaaaaaccgcctaaggacccaaagtgatccggttttgtaaattgagggatgatatatatccggttttgcggttcaaggacgatttcgtaactcgatgacaagttgagggaccttcggtgtactttttcctgctgtgtctgcccacaggctgcagccatggtccatgcacggcccaataagtatcgggccgtgccgggccggcccgaaggcacaacagcccattgtg

SEQ ID NO: 41786 - DNA, 1501 bp, Oryza sativa
ctgttatttcgccttagtatttaccattattaatcatttttattgattacattttagaggcgaatgacaaagttatccctagcattccctttaaatcttctgaagatgaagataaagattaagtatttcacgtaaaacaaggtggtaataacgtgtgattaattgagttttaattattacaaacttgaaaaatggattaatatgatattttagagcaactttcatatagaaagttttcgcacggaatgtatcgtttaatagtttgaaaagcatgccacgagaatctaaaatttcatcctgcctctacataagaaacgaacggggcctcactttccatcctcctctgtcacactcttttgctctgatgttgatcctggctgtcgtctctccctgtgcgtctggctactggcatcaccacacttccctagtactgtataattaaaattgcatatatttgtttatttaaggatggaggagacggatgaagagttttaggtcaatggtgtcactgtcaactctcatcaacaatcatgtcttcaagtgaaccattaatgcatatcgacagtaaaaaaaaataaatgagaaattaagttttcttttaaaaaatcgtttcatcgtatcaataccatttgtctaattggtaaattaaattgtaaagcactacattaaaattagtgctacataaacatgtgtatatagcaacatcactatttttttaagggtgaaccttacactgtggaaggagattaggggcttgtttgatgaaacttttagcagctgcaacttctttggaatcaaaagatctcaagaagttgtaactccaataaatgaactagaagccttctccacgtattctgatggttagcagcacccagcctgctatgcaccataacaaagaacatccctcgagggcacaaaatatatagaaatagtgccaaaccaaagcaaagtacttcatattagagaaattgatcaagtgcccaactcaacggataggtgggactaaaatactcgcttatccattctactgaaatctttctgggcacgctggatttggaatgaacacaaaaatgcatccttcttctgggacagtcagctcggagtacactgggattccctagtagcatttctccctgacctgcagaatcttacgacaattaaggtgggagatgttaggcacacttctttttggcatgatctttggtaccgggagaacaccatggctgaaaattatggcccctctactcgcactctgtggacaaacatgctttcagtgtagcaggcgatgtctaggaagttgagaaatcaatttgtgtcaaggctctcgatgatggctgaagatcagttgctccaactagggcttttactccaagatcagatcttgacatcacaattagatatcagggacatgaatggagcaacaggtctgctgcagaccaaacaaatttactacgccgtgtgcgatgacatagacctgtgcagctgtgcaacaactggaagt

SEQ ID NO: 41787 - DNA, 1501 bp, Oryza sativa
aatattagagataatcccttatatgccattgaaaattggtctgatcccttatatgtcactaaaaattggctcttcccttatatgccattggtctaaatttgcgcatcctctcatgctactaccgtcagttgaccgtgtgttgaacgttagctttcaagtaaaaaagacatatttgccctctctgagttgttaggcatgccctataatcaaaagggtaaatatgccttttttccttaagaattaacggtcaatacacagtcaactgacgggagtgacatgagagggtgtgcaaatttggattaatggcatataagggaagagccaattttcaatggcatataaaaggatcagaccaattttcagtggcatataagggattctctcgaaatattaagttggatatggatattgtcagataacaaatcacttatcctgtaacatattctatattattttcttcaaaatggattcatgaacgaatatccatttgtattttcaattgatagatattaaatatagacaaacaattaaagtgttaaaagagattcatcaaggaaaaaatatacgatattatcaagttaatcaatcttttattatggttgttggtgaatttataatatatttttaagtatgtttcataatatgggacataccggctataaaactcttattgtattttaacccatatttcttaacggattcggattaaaactcggataataacgaatatcctactttctcttctatattattttccttagagttggatcaggtgggtggtcaagaaatatccgttccgttttcgatcctgtaatggtaaatttgtgcctgttcttttctccaacaaagttagataaacttttggatgctcgtggcatgcttttcaaactgctaaacgatatatttcgtgcgaaaactttctatatgaaagttattctaaaatataagattaatccatttttcaagtttgtaataattcaaactcaattaatcacacgttattatcacctcgttttgcgtaaaacacttaatctttatcttcatcttcaggagattcaaacacctatattttccattttagcctcctttaactgcgacgttggtctcgcaagagtcccactgccgaacccagctacgtgtcgcccaacgcctctacctagtctctagatttttcacttttgatgctttaaaaaacttattctacaaataaaccccttaaaaacttattttaggaatgaacccttttcacggcgcattaacaacattggcgtcgtcctccttcaaataagtgacttagcatttagtgagggcaaggggaaccgtggcaacgtcattagcgttgtcacgttggaccatgacgctgttaatattagcgtcatcaaaatgatcaatttcttcgaataagtttttaggtatctattcgtggaataattagttttctaattggataaaaggtgaaaaatccacgccagttcctcctccctttctccaagcgccaccg

SEQ ID NO: 41788 - DNA, 1501 bp, Oryza sativa
acaaacttttgggcatgaatttctagctatgtgctatttttttaataatgaaaatagattatatctccagtctttggcaatggacacacatcaacaagtttcagaagaatttaaaatagatgtgatctatgtgctacttaggccctgtttgggagagtttgtcccagctgcagcttttcctaaaagctgcttctgctagaagctgccccaaacagtctaagattctgaaaaatgaactaaaaagccagaagatataaaagctaggtttcagagcttttccagattctcagaagctggctaccaaacagctgcttctcaaaatttaaagctcccccaaataaacccttagattggcttgctatgtcctggggcctggccaacgatacattccacgtcgacctacggaagcaaaagcaattcagtttataataatgctgctataaatttagaggggaaaagtgaaggaatatttacatatacttttatgggtacaaacggacgattttcctaccatgttttttcgaggattcttaattatcaactttaaaaatagtaccaagtcatggtactatttataacctaggaaaagttctatgattaatatttagacaaataagttcgatacatcttattagttatatgtatataggattatatcttgtgcacccaagatggttaaagtgtcgtacttgaaaagaaagatggttaaaaggctcttcttttttctacatgtaactacattttctggtggaatacacttgcctgtcggcatgtattggttgccatgcacggacgagattggaggattgtgagccccgttgggaccactaccatatccatctccatgttctacaaagcaattatgtaaattttaaaccaagttgaatttcgtgtattagaatatgttatatttttccttaactaatagctaaccgatgttatatgtagatatttcctctggttctaatatgcagtacagttgagtagttttacagcttttatacaccttttctatttccattccatgtttattaccctttccaaaatgctactactttcaaaaataaaattgtctcatattttaaagaaaactcttacatatttttctagattgataaactattttttctacaagtagctaaattttcaagtgaaatacacttgcctataggtatgtacgggttgttgtacacgtaagagattggaggctcgtgaaccccgccgggtccaccacctccggctccacttccatatccacctccaccttttacaaaatcaacatctttaaataaatttatgcagtaaatttttaaacatggttttgttttgagtattaatatattatttttttcctttacccaataggcagcatatgttcatatatgactatttcctcttatccgaaatgcattgcaagtagtttcagaacgtctatacactattttaccttttatttcaagtttatccttttcataaataaatgtcccatatttctatagta

SEQ ID NO: 41789 - DNA, 1501 bp, Oryza sativa
tatactaacctcttgcagggaatgacactaaagtggaggagaatcgatattaactcagacgataaatcaatcggacgatgtcgagaaccagacttgtgtgtgaataggccaagaattcagaattgacacgatgaattgggccaaaattcacaagtctgcggagaagaacaatagaggaggccagcagccgagccatgggctggttgggctggccccaggttcggccgaactagggggttcgaccgaacctccctcatcgccgctggatgcagggtttcttctggacggtgtggattagctcccaattacggttggacggtatttccgaccattccaaccgtcacaaccgtcattgggaggctatataaacccctcaccttcccacttcactcacacacctcaagcaatagttctctcattcctctcaagtttagtttagtagtatctagttggtggaatagaattagaataggaatcaggagtccggaagcctttggaagagttcgggtatggctctagcagctttcctttcctcttttgtaagctttgtacttttattagaatactcttctatatacatttatggtactgaaatacttttcgagtatatgagtacctactttacattatgttcatgttatactgaatatacggctagcttatctagaagatgctttggtgcgggtataatgtttgcttatgcatttactctatgtcgtgacgatgatattagagtagtatctggtagtttagacgtggtgtctagattatgggatatcattatttggtcatgacaggctgtcgtaaggaactcggcagtcaggggtggcttctcgaagtaccaggagggcatcggatagagggtattagctagtatatcagttaactagaatgtatgtatactatgtatattagaagtataggaatagattctctttctcttttctttccacttagcttagatgatatattatgaggatgagtaattaatgcttgtgtgtcactctacccttggattatcttaacccctgcttagaatatgattatcacaaataatatataaattactagttgagttctctctacatgattagcttaatgtttttaaattataaattgatatttccgcgaccaagccttcaaatatggaaattttaacttcatgttacgcggagcgtcttgtttcggtgacaaggtaagattgaattaacaatgatatggaaaatggtcccatcgatacttatattttgaatagtggatttataatcgctataggttgggcatgttttatatggtgtaggattacgttgtagggtatatactatttgccacatgcgttttgactttgttctcatcgaaatgaaaagattgacctgcttaacacactccgttcacgtcgagtagccatagtagcttagaaccgaatgtaggcatgcatcgtaaagttgtaaatgcaaccatagtagacggtgatgataattaatttcaacaatgtactagg

SEQ ID NO: 41790 - DNA, 1501 bp, Oryza sativa
aaaagtgtcacaaaaagtcacacatgattcaaataaactggtgcaatattcataccgggaaaagaagttccatagtccatacataaggaagttgccctattaatgaggatatatcaattggcctcattggtcgagctgctctgggcatgtctttgacaaaatcaaatgagatcttgaggccactggcccttaggtgaaggtatgcatttgaagcctgcaatgtttaaactatatgaaatgcagagcagtgatgaagcataagaaatcatcaaatagctagtaaacagaatagtacacaaatgagtggtaaaatacagatttgagaatggtatgcgtgcaacactgataaggttatatatgcgatgatatatggacaaatattcatgaacaattagggaggatataatgaatgtaaattatcgacatgtccaacttttcaacttggaaaaaaggataccatattgattagtcgtgaaacttgaaccaatctaggtgcttgccatgctccttgattaaaagtgagtgagatgtcttgttcataagcatcaaacttttttgttgagttatacgagatgaacacgttaaagttgccttgatcagaacttaagaagtcataagctgcaaacaatgaattcaatgttaatgagtggcagatttgaagaactgattgagggcacattggagattacctgcagcgatttcattggtcttcttcttattatttccttggtagtaacctctatagagttcatcgttgatgagccacaaactgtcacgccagagcattaatccttgggtacattgcacatctattccatgtccaagtaaacattagaataactaagttgtaataacattgctagttttgaaaacagagaaaatgtctgtaaatgaatttattcacttttccatgttcattagaaccttaatagaccagtattgagaatagttgacaccattggtacggcacatttttctactaaacaatgtgcaacccaacttttgtatcttacatgtagaaaaacttacgtttagtctcggttgtattgccactttgatatgtaaaagaaagtgtctggtttggggtgcatgtcttctgaagaaaggagctgacttcaaaggaattgaaatccaactcatcatctgcctctgcctgcaattatagatacatcacaaaatgcctcaacacttttccatcttctaaacatacgcagcactaatacatactattctttaaaaaaaaagatcaaccagaacaaaggtcacactgaaatcaaggacactaaccagaacataatcagacaaagcggaaatgtcagacggtagtttcgccgaagaattatgagcagggaacatattgtccatcacccctgcatgcagatcaagctatcaaagactgaaagactgttcaccgtcagagtaaaactacaagtcaacatatgcatgtcaatagagatcggagatgtaaaccattttcagtcttaaaaaaggagaaatttta

SEQ ID NO: 41791 - DNA, 1501 bp, Oryza sativa
aattagaataggaatcaggagtccggaagccttcggaagagttcgggtatggctctagcagctttcctttcctcttttgtaagctttgtacttttattagaatactcttctatatacatttatggtattgaaatactttctgagtatatgagtacctactttacattattgtcacgaccggaattaacccaacgggcgttccttacgtgtgtgtattattccttgtcccaggaggcaagatacaccaaaagttgatacatttcagagtttatcaagcggaagcgtaaatagttaattattacatgggcagcgaaggcccagcacacacaaagacaaacgagaaacaacggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttaagatataaagggttagggttcgcagtaaacagcattaaaagacacttagttgctcaaagctattttgtaaacacgattccagagctatacaatattattaaacaaggccgtgaacccacacgaacctgccttaacccaaggcctacgatgattcagaccgaactggcaacccgaccctgggtcccagctcgtcccaagccaaccattccacattttagttgttaagcaggttttaagaatttaaaacactaacttgggtacattgctcggcttgcccataaccgagggcacggctattcgaatagattatactctgatcagaggtgtacatctttacccacaagacacatcttcctcacgtgtagccacgtgccacataccaccacggtatacggacgaaatacgtgacatagtttccaacccatcctagccatagacaagagtaccgacccaaccccacctacggccgggacccccgggacaggtaggcaggactgagcccctagcagcaggacatcggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccaaggtgctactatcaaaaccatgcaccccgagcccagcctaaaaccattttgagggttttgaatagagggggaggtgtgaatccaaatctacctaaaatcatactagtggtaccatgagtagagtgtccactagttggggttttgtttattctagggtgaacaaggaaataataacaataacaataataaggtcataacaaaggtacataggcatggctagataaaacagtgataacgc

SEQ ID NO: 41792 - DNA, 1501 bp, Oryza sativa
gctgcttttgcaaatgaaccctatattatgccatcctttggtatccatgtgcacttgcatacttgctgtgtggcttgcggagtattccatgtactcaccttgcaataatcatcaaacctcagttgaagaaaaggatccagaaggagaagacctttggtttagatcccagttgagctgcctgtgggagtggagctgaagcttcgctagattttattttccgctgcagttttcttcatggtgaggactaagtgcctcttatgtaagtatttatcattttagttattttgatgaatctgtatattaaattgtcagtttgtgtacctcggctgattcctggacgagggttttaatgcacaaattagttcggaaattacttgtgaatttctgggcgtgacacatcgctaccctttttgctttagttttatttcgacgagttcttgctttcgggttgagctgcatcggtttcgattttcaccaagaggtaaaacttgttatgatgaattatgttctcgggattagtgcttccatctttatgatactctaatcttgtctatgtaattcgtcaagttatcatatatcttacataatcttcgacaatatcgtcatctaacctacaatcggctaacatctgttaacagaaggcagccgatttgtttaaatagcgacgttgacctagattatataagatatctactactctatgaaacttccagcggcttgattgtctagatattgttcttattttcatacttaatgctacatcagttgagtttgatctataaagtcatgcttagaatatcaatttctagcctgccctctggtcgccgattagagtagcgtcggagtttcagccgatcttacctgatttaatcgtatttgctctatatgcttcaatgatacattaaatctgccctttatgtcaagatcttactgcatttaagtatattaggctcttgtttgatatattttacttgttttagtatcctgatatagagtagtatcggagtattagccgatacatgctagatctatctgatcagctatgctattaagatatataaggctgttatcaatatatattttgatctaagtgattcatactgtctcggcatggcgaccgatctatcccagtcacttgatttaagtatatatcggtataggaactatatattgttaatatttacagccgatcgaatagatttagttctttattgcctatttacaaccgccgatcgattcatatatgacatcggctgccagataaatgatgtgtcatcggcacctagccgatcggctatcatttatatatttaactgcggtttctttgcttctatttcttgttgattacaggatcaaatcaactggcacgctcatacattcgaaggcgagctttggacctgcactggagttaagcagatctcctaggcctcgtgttttctgtcaacacgcttttggcatgcccggtgggacctttaagaagtcagccaacaattcttcctca

SEQ ID NO: 41793 - DNA, 1501 bp, Oryza sativa
aacaagatttccgcaatactaaaagggggtggctatcaagctggaaaagtggatgggtttagagacaaggaattttgtacaggttcaggccttcttaatcaagaagtaataccctactcctgtctggggattgatccgccgagagtattattgatcgtatgatctaggtgaaaaatcgtgcccctagagacacccggacccctccatatataggggaaggggtccatattataaaatacagttcatatccctaacggaatatgtaattacagataaaatacaatcgtaaccgactaggatctcaggtacttccttgacatacaagtttagaatttaacccgagtcctcttaaagatattctatctatacatggcacctcatacccagtcggactatacatgccgtgtaggtatggggtatccataatctccacagtagcctctgagacctttacagtcgatgaaatagtcttttcttgtagcacaaaatgataatccgagtgcttcaatttcttctgcattgatctcccgagtaccaaaatcaaagactgtgaagggctaaaaataaataatcaggtgcatcgaatagatgcacctaattaggtgtagcccccgactatgtgagtagctaaaagctaaacatatagtcaaagtgcaaataacatccatccgagtggttttacaaccgtatcatccagagtatcatatagctaagcatatgcagcgcttaataaaacatcgagccgactgctttagctttaatataccaaaaatgaagacgtaaagaggcccgagtaaaaaatactccaaaggtccataaatcagcacatatgacaagaatctgagtaaaaactctcaaagatccatcaaatgtggtataaatatgatatcacgacaattaatgagtcaaaatagcctaggctatactcacgccataataaaaaataagcatataacatgccgagagaatgactgttcaaaaaccaatcatctcaacaaaacccaaacagcctttgcagcctaaaaaggcttacaaaagaagtataacaccttttgtcgggtacctttttttatttgcatcatagtaattccaaggaatcatctaactgcatcacaaaggattttaacagcattaggccatactgttgtgaggaaaaattgccgaagcaaaaatgcctaagtccctacggatcacaacttagccacgccgataacagaattgggctgaagtactgtataggcctaggcccattagcactcccgataccctagagaaataaacgccgaagtcagagcgtcgtttcgtcttccccgccgagactctcgccattttccccatttcccactacagtgcaaaaccactccggcggaactagggttctccaattcgctcaaatccaccttccaaaattccacataaaccatccgcgcatccaccgcatcgatcccccatccattctcagccatttccaaagcaaatcgcatcacccaattcgcatcca

SEQ ID NO: 41794 - DNA, 439 bp, Oryza sativa
tcgaacttgtccgaaaagttttcggaatctccgaaaaacatcagttgactttactattttgttgttctggaaattttttgatatgtccgaaattaatttttggaattacggaaattgtaattattgtgcataacgggtagatctagagctgtggtatataataacccactctctctacttgtgtgggttgctggtctgatcggatattttcggcccttggcttgttcatctggagattcacttttgacccttgctttcttgtttcccctctccacctgtggtttgattcggatttggtgtatgtgtgacagttgtggattccaagtttgtgtaacgcctgttgttggcttcatgaacatttgtgagcacttgcttcatctccaggagatcttggcatcatttgttactcttgaaggttgaggactcctaaacggctagg

SEQ ID NO: 41795 - DNA, 1501 bp, Oryza sativa
ccccgccacgcgcgcctccagcgcggacagccattcttgcacctccggcgtggccacctccgacaccttcaccacccagatgaacggcttgccggagtcctccaggccatggccgacctcgaacaagtacttggggaccttttggatcatgtcgttgaataattttgtttcctgacgttcttcgtatattcttttatccaacctatacatttctccaatgcaaatagttgatcgatatttccatgtgatgtagaattacaaaaaaaatacatctatttatatttcgcgtcgtacatgtgctacttgatcatctgtgtgggaaataactaatgaaggaccgggactgacactatatctgggaacatatatgtgatctccagagaaggaaaacagagagagaggagatggacgatgacgacaaaacaacgaaacactttactccattctaaaaaattaccttagttctaaaataactatagttttatgagtagaaggataaattaacaacgagggaaaatcaactagctgttccctatcaaatgggggtggttgaaagtgtgaagatagttgggggtaaaattagaggaaatttgaatgagttattattaatgggacaatttacaagtaacactataggttttacttattttaggatggatatagaataatatgtaaaatcgatcttgaatatcgtaatttaaccatttagttcttttataaattattatcaacaataacaaactttacatcatatgaaacttactagttgtttttgctaacgaaccgctatgggatgtacggctactgcggtatttactattaagataaaccctgatctctactggtactagaattctagtactagtcttattattagtagaacaatctaaatcatcgatttatactataagtagaaaaatctaccacaattaatttaacatatagtatgaatagacattaccattaaataaaataagacaaatgcttagattcattatgctacctctatagaccattgtgaaaattaccaatgttaatatgcatgtaaccacatttttagggttaggggaaatgttatatgtaccctcagttgcattaatttaatttcttccaataaagcaatagcctaagtattttatttcatgaaaactcaacaaattaacccccgcggcatagatttcaacaaaatatgaaagattaagatgcaaagaaaaaaattaaaattaaaaataaaaatattattaaaataaaagccgtcatttcataaatcataatacaattcggagattacattcggtcttatgaaacaaccgctatcaattttatgttttggttatgacaatgttctcctattaaatatgaggaaggaggtgctagcaacaactgtgcacaatacgaggaaagagatactgccaacaactgtgtaactgtagtggataggcatccaaccatggagcaacgataattcaatagacatgacagaacggaccaatacccaaat

SEQ ID NO: 41796 - DNA, 1501 bp, Oryza sativa
gtaacattctaacaattgacgcttagttaagttatttatcgaaataaccttcggttgcaccacaattttgatgtacgtttgagtacaaccacatcactatttatggcgtggcatgatattttccacacatgatcgctacatcgaaacgtggcaacgaacactgccaaacatgaacacgagctatagtagcccgagcagattaattggatgaagaaaggtttttagccatcgaggtggtccgctgatgtcttttgtttctctctagaagctttggtgacactattgcatcatctatcttatctatgtattaccgtatctctctaatcttctctcattatcaaaaaaaaaaagctctactcttatattattattattattattattattattattattattattattattattattattattattattattattattattattattattattattattattattattattattattattattattattatatgctaaaagtaggaaaattatcaacatatgtccagctatgatgaggtactaaaaataaaaagtacatgattctatcaacaaatatccccatttatactccttcgcaaagcataggaatgattatattgcacaacacttagctagaggtccccaagatcaatttttccttcccctttcgcagcaagcgtttgatgaatataaggacatgcaagaaaatctccaatcctttacccttcaggaggttgatgattcatggacatttgtttggggatcagggaaattcacttcgcgactctgttacaagctcagttttctggctctcactcccccacctactatcaaatggatatgacagtccaaagtcaatatgaaaattaaggtctttgaatggctcttcttcatggacagggttaatacaagggatctccttgatagaaagcactgcgcgccacccaatacttcagtcctttgtctctcttgctcagctaatgccagagaaactagagatctcctgttcttcctttgtccttttagtgcggcttgttggaattgtctgggatggacatggaaccctaacttggattttcatcaaaggatccaggctcaaaaagtggctgtcttgcattcttgctttatggatctattcttaattgcctcatggaatatctgtaaggagagaaatggacttatcttctaaggcatccagccctcagtgcaaaactggttgatgaacttgaagttagatttgagcttacatttaattaggctcaaagaatgttacaggcccctagttcaatcatggatagatcagctgtaacttagatgttttttttccttcattgtttatctttttccttctttgtacatactactggaaaattaatataccgtgggggcctcccccactacctttggttaaaaaaagtacataaatctatatatccatcattttttgtacatttaataataaaaagacatatttctaaacatgtttaataatattctaacaata

SEQ ID NO: 41797 - DNA, 1501 bp, Oryza sativa
ctcctccgattggccgttcctcctcgccggctcgtcgtctcgctgcgccgccaccgtcgtcgacatcgcagcggcgtgttccacgccgtccttgcctccgtgcagctgctgccggctgccctcgtcgcctcctcgccggttccgggcgtcgtcctttcgtcgctcctggtcgtcatggcgttcgtccctccgtgaagccgatcgcgttcgccgcccgtggttcgtcaagcgagctgctgcagccccgtcatcgtcttcatcctcgcctccgcgtcatcaagcctcgtgccggtcgcgtctcgccttcgtctaaggatcgccgccgaaatcgtcccctcgccgttcgtctccgctgcccattcgtcgtcatcgttcccatgcctcgtcgcgtggtggtaaggatccgtcctctcgctgcccccgtcctcgtcctttcggtgtcacccgtgcccattgtgcggttgtcgaccccggtacccgtgtaccggtgtcggtagtcattcgcttgtgcgtgtggtgaccgtgttagtgtgcccgctcggtagccacgtggtttccacgtgtgcagcccgcgtggtgtctagtggagtccgtttgtcggccactcgcctcggttgacacacggggtccgcttctgtcgacccgtggaccgtctctatgtacccggtctgccgtggtctcttaggttgacatgtggggtccgcatgtcaacagcgcagccttcctgtcttttccaggctagcgcttacacatgttttatagttgcaaaacctaattataataatccgcaaatctccatataacagcatttaacttcggatgaccatgtcttggtcatacgaactccgaatcgatccgttcaagtctcctaatgtttgttataacctaaagaagattgtgctttctttttatgtattgttattgcttctttataggcttgtagttttgcttgtgtgcttcgcgtagcttctgtcgttccggaggttctcgaagcgtgggtcgcggtcatcgccgaaggttcggaaggccgttgtctctgagcaaggcaagtcacatcatcctttagcatattgaatcccagtttataaaattattttgatttaaattaatgcattattgctttatttaaattcccgcgttatcactgttttatttagccagcctatttacctttgttatgaccttattatgattgctattgttattattaccttgttcaccctaggaaaatagaaccccaactagtgggtactctatttatggttccactagtatgaacttaggtagatgcttcgctggttaattatgcagcattaggtggttttataactttagactttaggaattctcatatcacttggacactatggaatggttggattatggtggaattggacatacacctctcttcctctttcaaaacccctaaaacctgttttccggtggggtttgggtgcatgccagttgtgggaagtagcaccccggccaatataaggattaa

SEQ ID NO: 41798 - DNA, 1501 bp, Oryza sativa
gtcatccccttcctcccgccgctcccgccgcctcgcccgcgccctagcgccgcgaatcccgccgcctcccgccgtccccgcgtgcaataaagagggggaaatcactccccgtgatcccctctccctttccccccatttttccctctctcttccacgttcaaacgggcggatttgcccctgcaaatctcgccggcgccattgatggtggccgacctcccgcgccggtttccttcctttcccggccgccctctctcgtcctggctctatttaaaccctccccgcacctcctccgtccgtttccgcctctcgccgcccttcctcctcgccggaatcgagctcacgccgtcgccctctctctccgctgtcgccgccgagctccagtccgccgccgtcgtcgccccggaccccctcccacctcggcgccgcctcctgcggcttcgccgcatccttgccgacctcgtccacccctccgtttcgctcgccgaccgccggaactccgtcgaccccgtcgacccgagccgcgccgccgccttcctccgctccagccgcctttttcgtcgtcgccgtcgacctagggtgagccgtggaccgccgcctcttttcccccttcccttcccctctctcggccaccactccgacgtgcctatggccgccgccagcgaccataggggccagggcgccgcctcccaccggctgcgcctgcttggccgccctcgggcgcgccgagtggctgccgcgtggggcccggccgtcagccgcccgcgcctttaggtgcagctgacgcgtgggacccacggcgccggccggtgcgagccctggtgcgcccggtccaccgtggaccatgaggcttccacgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatatgaactcggaattggaccgttcaagtctctaatttttgtgctttgttcctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcctagtttataaaattattttgatttaaattatcgcattatcgctttatttaaattcccgcgttatcactgttttatctagccatgcctatgtacctttgttatgaccttattattgttattgttattatttccttgttcaccctagaataaacaaaaccccaactagtggacactctactcatggtaccactagtatgattttaggtagatttggattcacacctccccctctattcaaaaccctcaaaatggttttaggctgggctcggggtgcatggttttgatagtagcac

SEQ ID NO: 41799 - DNA, 1501 bp, Oryza sativa
ccgatgcgcctaatgaaccttggtgctggatcggctgaacgatttgttgtcttaacggcgtctgctgaatcggctggagaggctgctgcattggtggtgtttgctgaactggttgcatgacctgttgctggattagttgcacaacctgctgaattgggggtgtctgctgaatcggctgctgctgtattggatcaacaataggttgaggcggcagaaacgtggcagcaacctgatcttgggtcagccgattcgcaacctgcccgccatgctgtggctgctctctcattaacaaccgagggttcactggctggtctggtgccattgctgacagaacaggcaggggagttgacgccagtgctgtcggctgagatgttggtgcaacggagggaaccgcctaagttgatggttgaacatcggtaatcaaagaccgataatttgggaagacatctccttgcaaataaaccgggctgcagcctgatgctcagctattgaaccatcggctatggacttcaccatgtttgataaggtattgactaacaccccagattgattgatcaaagcatgatgcacagcgtagtcaacccgatcttggaaattactgaaaaaatcttgtgccgcatcactattctgattaatatttcctccttgcaacccctgggcaccatcaccttgaactccatgcaccccgtcaccttgcactccatggactccttgagaattgtcaccttgatttcctagagagctatcggtagcacttttgttactcagctgagccgagccgtctggagcttatttcccatctccatccttagaagaactggtccccggatcatcagcaaccacttttattttgtacttctgaacaaatgtccccttgcgggtttgcatgaatgagttcaagaactgatcccgtgcttgctgcaacattgcttcaaactctttcttctgcttaggtgtgaatttttctggattgatcggcacgacgtttccttcattgacgtcagtcaaccctaatttcagcatcttttccttaacagagcctgggctagctagggatggtggtagtggttgtttctcggccatgaggaagaattgttggctgacttcttaaaggtcccaccgggcatgccaaaagcgtgttgacagaaaacacgaggcctaggagatctgcttaactccagtgcaggtccaaagctcgccttcgaatgtatgagcgtgccagttgatttgatcctgtaatcaacaagaaatagaagcaaagaaaccgcagttaaatatataaatgatagccgatcggctaggtgccgatgacacatcatttatctggcagccgatgtcatatatgaatcgatcggcggttgtaaataggcaataaagaactaaatctattcgatcggctgtaaatattaacaatatatagttcctataccgatatatacttaaatcaagtgactgggatagatcggtcgccatgccgagacagtatgaatcacttagatca

SEQ ID NO: 41800 - DNA, 1501 bp, Oryza sativa
aaataagagttatatggttagcactttaaaattatggtatgactgttgtgagataatggagtgaaatgagataatggagtgaaacaaatcttactatagacgcagcttgtgtgccgtgcttcatatgctctcttctttaatagtcctcatttgggtattggtccgttctgtcatgtctattgaattatcgttgctccatggttggatgcctatccactacagttacacagttgttggcagtatctctttcctcgtattgtgcacagttgttgctagcacctccttcctcatatttaataggagaacattgtcataaccaaaacataaaattgatagcggttgtttcataagaccgaatgtaatctccgaattgtattatgatttatgaaatgacggcttttattttaataatatttttatttttaattttaatttttttctttgcatcttaatctttcatattttgttgaaatctatgccgcgggggttaatttgttgagttttcatgaaataaaatacttaggctattgctttattggaagaaattaaattaatgcaactgagggtacatataacatttcccctaaccctaaaaatgtggttacatgcatattaacattggtaattttcacaatggtctatagaggtagcataatgaatctaagcatttgtcttattttatttaatggtaatgtctattcatactatatgttaaattaattgtggtagatttttctacttatagtataaatcgatgatttagattgttctactaataataagactagtactagaattctagtaccagtagagatcagggtttatcttaatagtaaataccgcagtagccgtacatcccatagcggttcgttagcaaaaacaactagtaagtttcatatgatgtaaagtttgttattgttgataataatttataaaagaactaaatggttaaattacgatattcaagatcgattttacatattattctatatccatcctaaaataagtaaaacctatagtgttacttgtaaattgtcccattaataataactcattcaaatttcctctaattttacccccaactatcttcacactttcaaccacccccatttgatagggaacagctagttgattttccctcgttgttaatttatccttctactcataaaactatagttattttagaactaaggtaattttttagaatggagtaaagtgtttcgttgttttgtcgtcatcgtccatctcctctctctctgttttccttctctggagatcacatatatgttcccagatatagtgtcagtcccggtccttcattagttatttcccacacagatgatcaagtagcacatgtacgacgcgaaatataaatagatgtattttttttgtaattctacatcacatggaaatatcgatcaactatttgcattggagaaatgtataggttggataaaagaatatacgaagaacgtcaggaaacaaaattattcaacgacat

SEQ ID NO: 41801 - DNA, 1501 bp, Oryza sativa
ttgtaatctcacgcatataccataaaatatatgattaatgtatacagtgattaccgacaagaactacacacaatctctaggccatctcttccttgtcctcttgttcatcagatgtcctaaagtgaaattgctcaaccggtacagtgctggcagccttcactatgttacgaaaatctttctgaactctgaattctgatgagtgtgaatggtttcaaatttctaaattttgtgtcctacaggtgccttcgggcttcactctattacaaaagtatttctgaacttctctgaattctgatggctgagtatttccatttcagaacaggacgcgagtaaaatcattcagaactgtagggtagcacttcactcttgtttatcttctccgaacagccagcacggcactccaggtctgtcatgaaacggctgttttgctttgatctgagatatataattgaattctttttgggacaattccgagggtaggatagggcctaatggagccaaacggttggattcatcccttgttgcttcattacaataacccttatttaaagtgttaacagcatcatcacatttaacaagaagtaaattctattcataattttaatcttgcgcctaaaaagtagaagacaaatgattaataacagtgattactgaaaagaactccagcagcacggtctctatggcatgtcttccttgtcccctcggcagtaagatgtcctacaagtgaaattactcaaccagtacaatgcctgcagacttcacggtgttacaaaaaaattttctgaacttctctgaatcctgatgagtgatgactcctaatgttttccatttctgaactttggggtcctgacaagtgtaaaacaccagaaggatgctgacaatgttgagaaaaggaagctatttcccctaagaacatctttgacataatttcgaaactgaatgaacacacgatcaacatcaaatctacatactctattttattaaaaccatctattatactatactctgtgttgtatttttcaccatcagttacatgattttcagaagtaaacaatactcattttccatccttcagttaccccagtgtccccaggccttaggtttattcccctccaaaacttcagaagttcagcacatgtgtaaaatctttcagaatttcaggaattggcacttggaggctgcggagagcattttcagatatcagaatcatcatggccaaagaatcatgagcgataattcaatttctgctcgaatttcgaaattaatccgaacaagttccaaaatcaagtcatttgccgttaaacctgaaccattgctcgcgcgtggtggcaacgcagtctcacgctgacgtcaccgccttccatcaattcaaatcccgccgccttaccaaggggatccacgcgcaccgctctttctttcgctcctcgtctcctctcgcccacgcttccttccccccaaaaccctagaaatcctcaggcgccgcgcgcgatccagacagcaa

SEQ ID NO: 41802 - DNA, 1501 bp, Oryza sativa
cggaggcggaggtgagtggtggcggaggcggtggtgagcagtggcggtgttggtgctgcgcacgatagagtactcacgctctgaggaagctggaggccctcctcgccgcgtccaccgcctgcccttcccaccgcgcccaccagccaccctcccccgccgagaccttgtctgtccagaccaccgccgacgtcgccgccttctctgcctggactgctgccgctgccttctccgccccgaccactgtcgctgcactgcaggaaaggggagggagtcggaacagaaggaaaggggaaagggatgagcggcggtcatcggcactcctatgcagctccatctcgtgcatcgccgtcgtggacacggccatcgacaccctcgccacttcgctgccctcctcacccaccacgacgccctcagcctccagtgcgactccctcagcggcgacgccgtgctcccgtcgcgccagtcgcccgctctccgccacgcccgccacccgccgcgcccatctccggccacctagtcgtcgctcccagcgacatctgaaagagacagacgttgagaggaagggaaaggggaaagagagaggtgggtcccaccatgttttatttgttttggctgacaagtgggtcccatatcttttttatttgttttgctgactagagtgccatgtatgcatccacgtaggatcaaaactgccctggatcgacctagggggtaattcatccggtttgtaaagtttagggttaaaaataaatggtattggagtttaggggggtaactcaaacgaccgcgatttttcagggggcaattcatactttttcctaaataataacatcatatagccataccatatccatctcaaatcacaggtagcaccaattaacgaatatttgagccctacgtgggtgcggctagagacacaatggcagatctggtatgtttgagggagatttagaacgaacggtgtgtacacccttcctaacccttgtgattcaaccttaaaatgctcggttgctttagagtcttctcgcttcatatcaccgtaccaaacgcccaccttgttggctgccgtcataccttactcgcttacaagagagatcgacaagagctctaagattcgaccaccaaatcaatcttctatggggaggagggggggagagtgaagatgcacttaaacccctagtgggttttggtgattaatgacaaggtggttaaaggggactaacgtgtttatcaagtttattcacaggagtttagtcccaaagcaagttgtgatggctaagaatgcaaggagaccccccaatttgaatgttcctaagtgcgaaaaacatcgaaggtgattagactaggtttttctctttcgaaattgagtttaggaaaaacagtactattaagaggggtttcaagtgtggttccagggtatacaaagtgctcttagtcatatccatgagtctaaaggtttttggaactttctttttttttcttggaaatgattttcctcggg

SEQ ID NO: 41803 - DNA, 1501 bp, Oryza sativa
cctaagggaccacggtagaccgagtacacagagacagtccacgggtcgacggaagcggatcccgcgtgtgaaccgaggcgagtggccgacaaacggactccactagacaccgcatgggctgcacacgtggaaaccacgtggctaccgagcgtgcacactaacacggtcaccacacgcacaagcgaacgactaccgacaccggtacacgggtaccggggtcgacaaccgcacaacgggcacgggcgacaccgaaaggacgaggacggggcagcgagaggagagatccttaccaccatgcgacgaggcatgggaaagacaacgacgaacgggcgcggcggagacggacggcgagggaacgacttcggcggcgatccttgaacgaaggcgagactcggccggcacgaggcttgacaacgcggaggcgaggacgaagacgatgatggggctgcggcacttgacgaagcgaggacgacgaacgagaacggcttgacggagggacgaacgccacgatgaccgggaacgacgagagggcgacgacgacgacgaccggggccggcgaggaggcgacgtgggcagcctacagcggctgcacgaagacgaggacggcgtggaacacgccgctgcgaatccgacaacggaggcggcgcagcgagacgacgagccggcgaggaggaacgaccgaccggaggagtcgtcgacgaggacgaacggagacgacgataacgaacaccggcagggttcggatggaggggaggcgaggccgagggcgaccttgccgctgcgatgctggaggtggagatggcgacgtcggccggcgcacaggcacggcggacggggctgccggaggaactccggcgaggcggagggcgagaccgacgtgggcgacggcgttccggtgaaaccgagggcaggccggggtggaggtcgacgcggcgacgccgagggaggagacggcgcagccggcccgcacctgagcggcgcggcaggggtggctggaggcagtacagtggcggcaacgccactgttttgccggcgaggacacgtctccggtgatttccgcgtgaaacggagggctgacagggggagaggaggcagctgcgaggccaagggcggtgacggcgcgaccggacggcgctcgggcgaggagggaaaggcggctgaagcccggccggcaccggagagagagaaggagaaggcagggagaggtggtgcggccacgggggagctcgggaaggggctaaaacgagagaacgcacggagggggttccattttatagcggagggaagcaagccgggcatgggagagggcggaacggcgacgggaaacacggccggcggccatggaaggcggccgggaaagacgcgtccgttcccgacgattgggggcgccattcaaggggaaaattggggggaattgaagaggaattaatggggattaaaacccccacttaatttgggaatccccggtttgaatgaggcggatttggaggagggagcgagc

SEQ ID NO: 41804 - DNA, 1501 bp, Oryza sativa
gccacactccgctgcggcagcaatgacatgggtgcatggcctgtggagcagcttcggctttgcacaagagcaatgacatgtgccgtcgtctttgagaacatactcctgcttcactctcttgcggtagatacccctgcctgccttatcttgacatagtatctcaaacctgtgctgttgggtaccttgcactagagctcgatgtttcatggcctttttacgcaactcctctagctttttctgcctgaaagctccaaacaaaatgctgttgttcggcatagagggaagaactgcctggatccgatccctaaaatacctgcatgtcccatgtaaaatgaactccactatgccaactagtggcagtccacagacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttaggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgtctcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcctatcaatgcagagaacaggacgacagttcacgaatgccatcttgcatgcatgtagagctaagaatgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtctgcttggtaacaactgacactgtccaataatccttccatttccccttatacgcgtgcactctc

SEQ ID NO: 41805 - DNA, 1501 bp, Oryza sativa
cgcctgagccgtaaggggagcacgtgggctgggcccgaccgatctcgggtcgtggcggactgggcggcccattagaaaagtacagtatgcgcacgattttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttcaggaaaacccttgccgccctctgatggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatacattatatttttagggttttagttgtactaatctagaagtgcgtattgtagatatcggtaactacgtagatctgctagtttggaattaatacattaccgttgcattggcttacacaaaaagatattacgttgtagatgtttattgcatgaaagagtaatatgatctagttatttcgttgacagatatgtcgaacaaacaaatattccaagtttaccatggatgtcacgtcctgataaattcatcccgaaataaaaatcattctctaaaaggaataatagaattaattaaaattcgaaaagaaattggcaatcactaaaatacatacaagaaaaattcgaatgtggttcggagaatttttgttaaattctccgtggtctaacaagagccctcaaattttacttgaattttcagagcgccggaaataattattaagcaacaaaaacaattatcaaagtttactaaaaagaaaaactaaaaataaatcctccttcctcctttgggccaagcccagccaaagtctccctctcctccctctctttccctcctctcccaggcctctcctctccctcccggcccactcttcccctccccctctcggcccactccctcctcccactccctcctgggctgcctctccctcctctcctcctgggccggccgcccggcccaagccgcgcccaagccaggccgagccgagccagccgtgcacacgcgcgccgcgcgtgcgctgactgcgcgcccgaccgcgtggggcccacgcgccggtcgtctccttcctcccgcccggctcctctcactcccgtgaaaccctagctcgctccctcctccaaatccgcctcattcaaaccggggattcccaaattaagtgggggttttaatccccattaattcctcttcaattccccccaattttccccttgaa

SEQ ID NO: 41806 - DNA, 1501 bp, Oryza sativa
ccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtagggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatagttggcctgggttggcttgggacgagctgggacccagggtcgggttgccagttcggtctgaatcatcgtaggccttgggttaaggcaggttcgtgcgggttcacgaccttgattaataatactgtgtagctttaggatcgtctttttaaaatggctttgggcaactaagtgacttttaaatgctgtttactgcaaaacttaacccctattattaaccccttgtacccccttgcattaatcatgcatctgccggtgtgacttgctgagtactgtggttgtactcattcttgctcaatctttcccccccttcagtaagagaagcttcggagaagatgtcttaggtggagtcctggcttataccccagttgagcacctgtgaagatggagccgtaggcccgcaagtccgctgctgtttatttttgtttgtcaggcctgaagtgcctttgtaataatgtatatattatcgatatattaaagatgtgccttttgtatcatgtttgtttggtgtaccccggcttttcctgggacggggattaatacactagcg

SEQ ID NO: 41807 - DNA, 316 bp, Oryza sativa
  unsure (1)..(316): unsure at all n locations
cggtgggnnnntttgttgatcgctatcactggtacagnagttcatcaggggtccaactctccaaatccaggctctctagggtgaggcctgtgattctgcagccgtaaaaaaaaacctagctcgattccatgaccggaaggcaaagttatcaaggggttaatttgcacagaattctccatctgcattccagtgtcgcgcccgccagcctaccttaacggcgcggttagtcgacgcgcttgacaccgacatcgtctaagctatccaccttaacgtcctatgtgccttccctatactaaccacctcgttgaaaaccagt

SEQ ID NO: 41808 - DNA, 1501 bp, Oryza sativa
gatggagaggtgcgcacatcatgcaaagctgaagcgatgaagacaagaccttaatctgtgttgtctctctaatatctttctcgttaattaattttctagaccatgtttagtgataatgggtaattaacatgctaatgggctcacgtttgctgcctacctagccttgttacgtaaagcaccaggggagggggagtgtcggataggggggtgttggccccctccggcacccccgacagcttcgccactgccgccgacgtccggagcgcactctggtggatgtgcggccacatggacgccgccgcactctggtgcttcatggcggcgcgctggcggcgttttgctgtccatccgatggtccggccactatgccgggcaacggcgccactgcatcttaccacacgaacctgaacatgccactgcagagaagtcctccatgcgacactccggttgcacttgagttccgtcgctgagcccctagtaacctgtagcactatcgcttcaagttcagaaactgaagaaccgagccttggtttcttttcatgaatcacgagaaaaaaaaaaccacttttgattgcgtgtgcttatgatattactgtgttaaaaaatataatgaagtaacgaacattccaattttggatcctgtgaggtctcgagattgttgagagatggtcatcaatcaatttcatctatatactgcaagcggttctgaaagtttgacgacagcacacgaaaccaccactgcaacgttcggtttggcagcggcgatgccaccgtctagcaagcaccgtggccggaggcaacatgaacaggcaagggctagcaggattgctggtgatgctcctccgtgagctgagctctcgtgtgcccagccggcgcattggccaccgccttgccagccgcggaggtcgcaggtgtggccgtttccttgctggccacggaggtcgccggtgtggccgcctgcttgccaacggccgaggtcaacaccagagtccgcgtccttgacggcggccgaggtcgccgtctgcttgcagccggaagagggaaggagcgaggagtgaggatgaaatgtgcggtccacgtgggagccaccaattttaaattatttggtgtgtagctgacatgtgggctgacagtttttattcttttccagggttaaattaccatgtaaacactacgtcaatgtcacgtgagacgaaagacctagtcaaaccaaccatgtgcccaccacgtcaaccaaaaccaccttccaaactgctgagggacctcatttgcaccggttttgatagttcagggaccaattgtatctggtttttaggttaaggacgaaaatcgaatttggtgtaaagttaagggacctccgatgaacttattccttttggtccgttccctcgccgtcaccgggcagaggcacgtagtaatggattttcttttgttgccaaagggagcagatagttggaagtattggaaatgtgttgctttttatttcattgtttgtccttcc

SEQ ID NO: 41809 - DNA, 1501 bp, Oryza sativa
aggcaattaagaatagatccataaagcaagaatgcaagacagccactttttgagcctggatcctttgatgaaaatccaagttagggttccatgtccatcccagacaattccaacaagccgcactaaaaggacaaaggaagaacaggagatctctagtttctctggcattagctgagcaagagagacaaaggactgaagtattgggtggcgcgcagtgctttctatcaaggagatcccttgtattaaccctgtccatgaagaagagccattcaaagaccttaattttcatattgactttggactgtcatatccatttgatagtaggtgggggagtgagagccagaaaactgagcttgtaacagagtcgcgaagtgaatttccctgatccccaaacaaatgtccatgaatcatcaacctcctgaagggtaaaggattggagattttcttgcatgtccttatattcatcaaacgcttgctgcgaaaggggaaggaaaaattgatcttggggacctctagctaagtgttgtgcaatataatcattcctatgctttgcgaaggagtataaatggggatatttgttgatagaatcatgtactttttatttttagtacctcatcatagctggacatatgttgataattttcctacttttagcatataataataataataataataataataataataataataataataataataataataataataataataataataataataataataataataataataataataataataataataataataatataagagtagagctttttttttttgataatgagagaagattagagagatacggtaatacatagataagatagatgatgcaatagtgtcaccaaagcttctagagagaaacaaaagacatcagcggaccacctcgatggctaaaaacctttcttcatccaattaatctgctcgggctactatagctcgtgttcatgtttggcagtgttcgttgccacgtttcgatgtagcgatcatgtgtggaaaatatcatgccacgccataaatagtgatgtggttgtactcaaacgtacatcaaaattgtggtgcaaccgaaggttatttcgataaataacttaactaagcgtcaattgttagaatgttactaaatatgctgatgaaaatagaaaaataatgttggttaattgtatagcttttacttataacacagcaacccaaaaccaaaaggatgtacatagccaaacagtagctagacaaaggcaggtatgtttttcgtagttagcaataataatactccaagattagaagagatatcgagatagttataatcacaaaagcttctagaatggcgcaaaaaagaaaaaaagagctggaccgctttgatggctataaatcactctctatgctgtatccaatctcccacatcacccacactatcaaagctttttggctgccactcgcaccgctctcgtgcccaccatggcgcccacgccggactccg

SEQ ID NO: 41810 - DNA, 1501 bp, Oryza sativa
cgtcgccgacgtcgtcgcggccgaacatgactctgccgcgccgacgatgccgaccccgacctcgatgcggccggcaccggcgacgacgtcgcactggcagtgccaatgaagccgcgccacgacgccgttgcggcacggcaccgccgccgtgcaacgccgccaccgcgccacaccgatgccgcgcagccacgccgccgccacgcaacgcgccacgccgatgccgcgccgccatgccgccgtcgtgccaagccgcaaccgccccgccatgccgccgctctgctgccgccacaccgccgctccgctgccgccacgtgaatgaatgaacgatcgtgaacgagaacgaacgaacgaacatgaatgagaacgttgtcacaccctgaagttttcccccttttgcttgctttaaaaatttgttaaataaatcgtccggagaaattatcttaattaacctagagctaaatccctagttaataaatgcaattaataatcggaaatagtgtggtggaatttttcttgagttccccatgctccaatgcattaacaagaattttagtggaatttttagagccttggaaataattttaaccaattaaaaatcaccaaagtgcaattttaaatcccaggaaaaatcctttcttccttttctttttcttttccttcttttttctctattgggccgtcggcccactccctcccgcgctcggcctccccttgtgggccggcccgttctccttccccctctctccgggacgttgacaggtagggcccacctgtcaggtcgtccccttcctccagccacccgcctccgacggcaaccgccgccgaatccgccacgccgccgcctcctccgctcttcccgcgcccactccgcgcccgcacccgcgtccacgtcgccgcccacctcccccacctctccccgctctcgcgcccgcccaaaaatgggcgggattcgcattcgaatccacctctctctctctccctccactccccacatcgccggccaaataggggccattcccggccgtttccgcccctccttcgcccataaaaacctgcccccgagtcccctctctcgtttcacccatttgccgtcccctcccgtgccttctaccgagcccgcgccgctcgccgctagcgccgccgcttgccgctgcctccggccgcacgctgtcgtcgctagagccgtcgcctcgccgctcaatcacctccgccagcttcgccgccgcgagagctacctcggccgccgcttcgttgccgcgaatcaccaccggagctccgatttccccgcgtcgccggtgtgctcgccattgtttccatctccggccggccattttggtcgtcgcggtcgtcctctccatccctaactcctctcctcaccttctttaggtgttgccaccgcccatccgccgcccgtgtcgccggtcgtcgccgccgcctttgtttccccgcgccggccgccaccgcctcctcggtgaggaccggtctccctcccttcctctct

SEQ ID NO: 41811 - DNA, 1501 bp, Oryza sativa
caagtcttcaggcttagctcgcttttaccttttccgctgcatttgtaatcctttatgtttttgtaagacgtggatctgtatgtcaacaattgtcgtttgtgtaccctggctggtcctggacaggggtttaatacacattcagcttagaaattctggttcgtgaatttctgggcgtgacaaacgtgaatgaacgaacgtgaacgaacgaacgaacgtaaacgagaacgtgaacgtgaacgaacaaacaaacgtgaacgagaatgtgaacgtgaacgaacgaacgaacgtgaacgagaacgtgaacgaacgtgaacgagaacgtgaacgaacgaacgaacgtgaacgaacatgaacatgaacgaacgtgaacttaacgttgtatttgaacgtacataaacgaacgaacgtgcgtgaacgaaaagtgaacttaacaagaacgcgaacattatttaacatacgttaacgtgaacgcacgtgaacgaacgaacgtaggtgaatgaaacgtgaacttaacgagaacgcgaacgtgaacgatcatgaacgaaacatgaacttaacgagaacgcgaacgtgaaatacaatatatgttactttgcgtttatcctaatacatctttttgtatgttgcagaaaagacgttgtcgtcgtcgtccctcaagtcggagtggtagctagccctcgaaggaattcgcgcaggcaagtgatgtaaatatatgattgttagatttttaatgcaattaagactattagatttaatatacgacacttagacttagcattataattagagttttaatacaatattatttgagttttaatataagattattatagttttaatataagattattagatttgtaattagacttagcatataagattgtgtagggttctaatatacgacagttagacttagcatatatgactatttgagttttagtataagattatttgagttttaatataagattattagatttgtaattagacttagcatataagattgtgtagggttctaatatacgacagttaaacttagcatatatgactatttgagttttaatataagattattatagttttaatataagattattagatttgtaattagacttagcatataagattgtgtagggttctaatatacgatagttagacttagcatatatgactatttgagttttagtataagattatttgagttttaatataagattattagatttgtaattagacttagtatataattattgactagggtcctaatatacgtcacttagacttagcatagttgactattacagttttaatacaatattatttgagttttagtataagattattatagttttaatataagattattagatttgtaattagacttagcatatacgacagttagacttagcatatatgacttagcatatatgattgttagcatataagattgttaaagcaaaaatgacctatagacttagcaactatttcttgtatgaacaga

SEQ ID NO: 41812 - DNA, 1501 bp, Oryza sativa
cataaaagaaatgagagaagaccacgacctcatgtgtatcgggggtcggaaaagcctcaccgcacgctggccgccacccgatgatctccttggcagggagaacgccgtgcgccaccatctccttcaggttctcctccgtcacgtcggacggcgcccattggccttcgaagttttctttctcttccgccatcgattttccccgaatgcgctgatttgattcgagggatggcttgggagaggtgaggaattgaggcggtggatcacgggaaggattttgatcactttttgaaggtggatttgagtggaatggtgaaccctagtttgccggcgcagctctgtactgtagcaaggagtggggaaaatggcgagagttccggcggggaagacgaagcgtcgtttggatctcgggttttcttgttaagggtatcggaggtgagaatgggcctaggcctgaacagtacctcagcccaatacttttaacagcgtggcccattgtgttccttagggacttaggcattctttgctttggcaatttatgtacacaatagtgttgcccaatgctgataaaatcctttttacgcggtcatataattctttggaattattgcgatgcaaattaaaaggtgcccgacagaaaggcgttatgctgtttttgtacgcttttttaggctacaaaagctgtctgggttaacttggaatgacttgtttttatcatagtcatttcctcggtatgttatatgcctgttttcattatggtaaatagtcatagcctaggctattagacttattcattaccatgatttttatgatatttggtgggtaatctttagagtcttatattcggatgcctgtcaagtgtgttcattcgtgaactttttagagtgttaaccactcggattccttttattgtgactaaaaagcagtcggctagaatgcctctttgggtgccgcgtatgcttttgtcatatgatgcatgattgtgctattattttgttctcaactatatgtttagtttgttgactaatcacatagttgggggctatacctaattaggtgcatctattcgatgcaccatattctttatcttttcgccctttacagtcttcgtcttcactactcggcaggccttggcatgaaaagtttgaagcactcggattattgtctttgagcaggctatgatggttgactgcaaaggtctcgggggctactgtggagattatggatatcccatatctacacggcgatgatatttgggctgaatataggataccgaatatagatagaatattttatgtgtatctcgggtttgtttctcaacttgtgcatcaaggaaataccctgagacttagtcggtcacgactgtatttgatctgtatctgtgtattccgttaaggatatagattatcttttgtaacctggactccttcccatatataaggggggtccgggcgcctctaggggcatatgttgattttcccaaatcatacaatcaataatacac

SEQ ID NO: 41813 - DNA, 1501 bp, Oryza sativa
ctctagatttttcctcacatatgattgttaggtgtttttttttctctagtataaacttatgttttttcttcaaagtaaaaggcgccacatgcaccaatcgaaagctagcaaaagagctagcttttagattattagaagatgtggacatcgtcatagtttcagttttcatttcgtcaacattatagcctggggtgaaaaagaccaccgtaaagcatgttctccgaacaggagacccaattttcccttaacatgcttccaaatagtaatcaggcacatactaatctatactttctatataattatataattagtacccactaacaattgatagaagctaaagttcaatatgcaagcatgcaacatcatcaccgactggcaattactattctagcctatttaaaatcccatgcaagtataccacatcttcactcactagcgattactattctagcctattttaaatcccatgcaagcataacatattatctacaatattatattatatctacaatattatattatagagatcaacaagtatatgtcaaataatcttcctaacattatttttttaacatttcaacttttatcatttcgataatatttaatatatatctataaatctcgcagcaaagtgcgggatatcacctagtaataacttaataaaacacagtaaacctcaaaacatctaatcaaacaactgattcaaaaccttcattaccctctcatgcatccaaagagaacaaaaacaaagatgaattcatctatcactacatgccaccaactcaaccacaaaggttctagaaccatcatcttcccttccccccaaaataaaaaaaaaataccttctttctgttaggccccacctgtcggtgagacagcgcggagacaggaatcatcattagtcagcgactcagcgaaaacccaaaaacaaaccaagaccagaccagaaacgccggtgaaggaacagcccacgtccagctcacacacgcacccacaaccgacccaaccgccactgccatgtgggccccacacaccccaggccccaccaacccaccggctgccgccggtcaccgctctctcggttgaccggctgcctaaccttcgccttcttctcccaaaccccccacgagaaagggaagagagaaaaaaaggtttaattaaaagttttttttttcagttttattattattacttacttacacgcgcagcgaagcagccagcgaacgaaagaggcgaagccttcgcgtcgccgctcgccgccacctcgtcttccgctgcgagatctcgcgcgagcgccgccatcggaggaggaggcgcgtcggcaggtgagtgctcgccgattttggcggtggctttgctctaattgtgggcggatctggctgggttggtcggatctcgagccatttcggtgggggatatttttgtttgatttttttttttgcggcggtggggttttagggtttgtggcggcggcagcggcggccggggatccgggcggcga

SEQ ID NO: 41814 - DNA, 1501 bp, Oryza sativa
cgtagatccgttttaggtggttcaagttgccaaatttttctaaaataaagatctacatattaaaattgtccataaattgaattaaatttatttagttttttttaaatgggctttaattagatttgatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgtgagtgcgtcggaagtgatcaagaagattaattgaagactgattattgcaaggcaagtcacacagatcctaaacacaatcctttgagcatgttgatcctatatttaaattctctatttatttcaactgtgcatttattttcgaatgtcatcgggtggtgtgaacctattcctttgttatggccaatttgcattgaatgccctattccttgataccttgggtaataaattgattagcttgaaccttatatattggattggttcagctaaatgctatatgtaagtttgcttagctatgcttagaaacattagcctaactaaagggattaattataaactatgttacattattcttattaattatggttacatttaatggtagctcacgatggttaatcgtgtgatgataattaattgataattaaaacctggttaaggtgggttgtgagcatatggttttgatggttgtgctcatgacaattaaggaccggttcgcgagctactgttgtgaaacattttccgtgccaaccacaagccagcgtgggcaccggctttatctcttgtatagcatgatttattatagtgtgccagactgtgaagtggcgagaagtccatgggggtcgctggggagtccatgcctctggttgtagagggggtgattatgatccaggaatggtgcaccgtggtgagttgtgttatgcaggggataatgtcacagcctctattcgggtactttccagtatcgcgacgcatggtagacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctggtttggagttagatctgtacagccgggtatggttgttcaggatggttgggcctgtgcagcatgggtgtgctgttcagtgttgattaaaatttctgattaattactccactgttttgtttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctca

SEQ ID NO: 41815 - DNA, 1501 bp, Oryza sativa
tgaccggcatacacagcccggtctgaccggtcacatgaaataacagcagtatcctgtagattcacctgtaaaatccaatcatctccaaaatccacttcgaaaataaattccaaataacaaaaccaataatctccaatgccaattgtttatcacagaataataataaaaaacacctttgattttacaaaatctgttattactgctgatatcaagtctagcctcctcaaagcacaagcacgtatgaagcactttgctgatatgaatcgtagtgaacgagtactgactgtcggcgatatggtttatctcaaaatgcagccttagtgtcacaattccttggggttacattcttccttgaaattgcattctaaatactatggcccgtttcgtgtcttggaacgcattggctcagtggcttacaaattgctgttaccggcatcttctcaaatccatccagtctttcatgtgagccaactgaagaaacacatcggtccaaaagtggttcctgaacctggcctccctctcactgatgatgacggtaacattctttctcagccaacggccgttttggaacgcaggctgattcctagaaacaatgcacctgtggttcaatggaaagtccaatgggggaatctacctccgtctgctgcaacttgggaagatgctgctttcatctccaaagtgtttcctgcttttaacccatgaggacatgggtgcttggggggggggggggcaatgtgagaactctgacgaagtgaagtcatgtttgaacgctggaagagaaggcaagttcagttatccaatggctgggattattcgataacgcttggggctggagattatgaagatcggacgatggagatgcgcctggaccgtctacagcacgcccctgttgccgtactgttgacatcatctcttttgtctcgttgtattagcgaccccctttataagctagcaccgccgcaatgtctgtatcgaacaattgaaccctaaattactttactcttgtcttgcggtgcccatctatttccttatactgtttactcttcaattcagtgcaaatccttcaatttaatcccactagggtagctacttagcctcttttctctgaaattgttcttgtcaagctctgaatctggctggggcttgacatctcacgctccgccgatgccgccaggtgccgtcgttcaagatcataccggcgaagtcccacgctgagtcaccgcgacgtgctcgatgtgcgccgtgatgtacctgccaaggtcgtcctcggcgattgatctgcagcagcaacctcatctccaccgcacagtcaggcatccacacaatcctcgccatgcgcgtcctctctgcgtcccgccctgtcctcacagtgccgttcagacgccgaaccaggttagttcatcactaattcatgcttcgatcccatgccattccatcgaaacattgatcaattggcttctcagataactgacttctcatataattgatgcaaaacaaattt

SEQ ID NO: 41816 - DNA, 1501 bp, Oryza sativa
cacgcgagacggcgagaagatattttttttctcctttatttttcgttgacgaaagccagcagaaatggaagatgggtgagcagtgagctcatttattgtacaaaggaaaggaaaaaaagggttgcttcctctatttaaatttgattatcatatttgcaatagcgtcaagaccaagacaataaaacatccttccttttttaaatgagataacctaaaaaaaatgtcattgacaagcgtccaaatacaaaaaaatatcatcgataagtgtgagttctaaaaaataccattgtacaaacaattttatcaaaaatgtcatcgtcattatgattcctttcattccgctatgttaagtgtaataggacgaacaatgtatttaacagcgtagaatagacggaattttaacggtgatggtatttttaggataaaatcgtttgttcgatggtatttttttaaaacccacacgttgatggtatttcttagatttaaacgttcgtcaatggcattttttaattatctcttaattaaacctcatcaatcaaagtgttgtgttaagcatacatgtggatatgcaacgatgtccacatgcacgatcaaacagacatgtaactacagcatttactcctacacacatggataaatagacatgcaactattgcatttacttctgcataaataaacaaatagacaggttagatgatgatcaatttgaaaagatctcttaagagtgtggtcagaaggaggggttgggtacgtattattgcacaattaattaaatattagctattttttaaaaaaatagattaatatgattttttaaaacaactttcgtatagaatttttttaaaaaaacacaccatttagcagtttaaaaaacgtacacgcggaaaacaagataggtgagttaggaaaactgagataagaactctgtgcaaaggattaaaatgggatggagtactgctgtgcgcagtttcggtttccaattatggccaaacagagattatgacgagtgggaccctggataaggtgtcgcaggcgtggtggttggtggggccaggtccaatattttgttttttttttgcgaatattgggcctcattgggaccgttgcatgagtagaccatcttcttatcctacatgggccaccgcataacccactaactaagtttcctgcaaagtgagctgtagccccgtgcactgtgccggcccatctcgtgtcagatggggccgtcagttacgtgcacagctttcggatgaattttttttatttttaattttttttattaaaagttttacaaaaaataattttccattttgaaaattgacggaagtagtcgccttccgccctctgggagggcgatttttaaaaatcgccatcccagagggcggcgaaaatgacgtggcagacagccgttcgctctcgggcgacggccgtcaacgaaatttgcaggcggcccccttgccgccctccgctagggcgatattgtactgtgcggggggccgcc

SEQ ID NO: 41817 - DNA, 1501 bp, Oryza sativa
gagataggtaattttggttccctgtattgatctttcattactcaccgtaaaagacatgatggtaaaaatatagtttactcctaatggttcaaaaaagttctggatgcattgcatggcgcacaatcctttgattcggcctaataattgtcataggagttgactaatagtaatataacctaattttgcattatttgtactattattttagttttttaaataaatgttttcctttgatgggtctatttctaaatgcagagagtgcatgcttatccacagtcaatatatgcagagaacaggttgattatatatgaaattccagtggaaatttctcgagggaaatttgacaggccagaactatttgtatgcaaattgcgtggcgaaatttgaaagatgttatatacatgtggaattgttaaattaatttttattttgttaagcaacgtgagatttgttagatttatactactccctttggcaaaatcaatctactatattgggcaaaaattttgtgacgtttgaattattttgtcttcggggtgcaagtttaagcataatttttttatgctaaaattttacggtataatgaatttatttggtaaatcatttagcattcacacaaatacatataatatctttgcttgattatttggttttcaaatacatataatatttatttgattattcggttttcaaagaaatctgaacacttgtattgccaatgttatcttttttgggtcatttagtttgcaatacaaaatatcatcgtagcgttagtacggacacattactagtcattagtaaggaatccaaggcacttaatcaccattaggtggtagttgtgcatttatcatatgcagcacttttgctgtgaattacattctggactatatctcatgagttttttttttaccgtccttcgtatctactgatacctctcggtgcctgttatctcgtccgtccgttcagctggatccaagagcctaggatgcaaggtacctgtcggcacagctcctaacaggtacctataggacccacgtagtgctgtcatgtggcggcgcggcgctgctttcccgctttccccttctttttatgtatttttcctaattttgttcttcttttttttttatttttgttcctctcgtggtgcggtgtggcacagagaggcacgcattggcggccaaccattctggaaatccctaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 41818 - DNA, 1501 bp, Oryza sativa
ttccaattttagcctgaacatcgcaccctaaacactctaccgggaatcgttgcggcgcccgcgttgggaggtctatgtcgatcgaacgaacattcctgaccacgctgaaccagccatcgcgacgtcgttggtcgatcgcttgcgtttccacactgatcgggaattagctccggacctggggatcctctcgtggagtcaactgatctgatctgcaatccatgtgatctgttcagtagtaattcctccgtcccaaaaaagacaaaccaacgtttgaccgttcgttttatttgaaaaaattatgaaaagaattaaaaagataagttacgtataaagtattaatcatgttttatcatctaataacaatgaaaatactaattataaaaatttttcatataagacggacagtcaaacgttggcacagaaacccacagtttgcctttttattttgcacggaggaagtatagtataaagctcttcatctgaactcaactctgaacatttgcatgttgtgtctgactgtcggcaaaagttctattaccacgtgagacatttgtttgtacgaggaggcacactaatcaaaaccaagctataacaaaattatattttactccctccgtcccataatataaacagttttgaacttcgacgtagttttcgagatgctattttaaccaataatatctataaaagtaaaatgttttaaataaaaagaattgcatattatgatagtttgtttaatgataaatccagtaacatcaattttacacgattgatctttattgatttttgctattaatagtcaaagttaaacattatatttaacttggcactattttaaaaatacttatattttgggacagagggagtattacaataaatctgtgcattacctatttcggatatgtatcgtatctatttaaattcgttgtactagataatgtttatttaggtcgtttatttgagaacgaacgtaatattatagagtaggagtatcgttttgttggtattatcttagatgagaaatcatattggaatcttcgcaagagtaacaacctcatcctacacatattccgtgggagttctattttagatggcgtagtttctagtgcttgatattatcgttatagtttctacgtattttctacttggtattatagttgaatattatcaggagggagatggtagatgcctagatgggatttatcccataacctcgagtttttttatttatcttctctttacttattgattgtgcgcctgcttgtagaaaccacaaatgtaaatcatttacattattagagaccaggagtgtaaatcatttacattatttaaaaaaaaaacatttgtccgtggagataattcgatactagtaaaaaggaagaggaaaaaatctagcgaattggaggaggacatcgagcatagtagaatcgcaccgccgtgtcgtcaggccgcgggcgcctcggcgtggccgtcggccgccgcggcgccggcgccggcgccg

SEQ ID NO: 41819 - DNA, 1501 bp, Oryza sativa
tcttactcttcttctactttggtctacagtaacgtattatgcaacccctcctgctataaagtagtcttaaagctgtgttcgctagttgaagttgggaacacttctctcattgcacgcaaaatgaaatgatggtttagcgcatgattaattagtattagctaaaaaatcttgaaaaatagaatgatatgatttttaaggtagcttttgtatacaaaacttttgaaagaaatgacaaaatttgctacaagacactcaaagaatatagtctttgttgcgggacaccttaagaatgtgaatttgctcaaggacactaaaaaaatatggtaatttgctggtagacactatacacattattttataatttcctgctatttaggagagaattttcacaaaatggcacctttgcccctgagacaaatcttcgctgacaggatcaaatccggtcgacttagcacaaaatatggcctcaccgcccgtcgctgtgcccatatccgtcatctgccacaaccgtttgtcgcggtgtgttctcgccgaggacggcaactccgtccattcgaggatggaggtctgtgttgacggttgttatcaaccaattttgaccgtcaatattattcaatcaaagaagaatagctatgtttgtaatgcataatttccaaataaaatatctacttccactatgtgctatgctactaacatatgtgcaggagaagcattcataaatggaggagaatcgacggaacataaccgaataattaatcgaaatccgtcagaggcagacttatgggtggatgggcctccaaacctattaagataacttcaattgggccaaaccaccgcaccacttgactgaggagtcattaggagacgcacctgccgtactataggccaattgggcaagtccaggtttcggccgaaccctgatctcagccgttggctctcccctttggcttggatgctccagatgcctccccaatgacggttgcagggtatttccgacatttccaaaccgctgtaaccgtcaatgggagtctataaaaggacctcacctcctcacttcatccacacactcaagaagaagatcaaagagctctctctcaagtttagttagtgctctagtgctagtggagtagaaatagaatagttttcttagtcctcgagtcttttggagaatccggatatggctctagaagcttctctctcttcttttgtaagacttatcaaattaatagaatattcttctttatacatctttggtattttattttctttatattatctgagtatcgattttattttatacttgtatcgatatagttgtgtagcatggatacagagtagtatttaataatgtaagcatggtgcttagatcattaagtatcattatctggatatatatgctgcgggacagtagaggtgggccactgatggtgacagctcagtacgagtattcctccacgttagtatatattcctaagaaactttcctaggaagggtactcctc

SEQ ID NO: 41820 - DNA, 1401 bp, Oryza sativa
cataagaatcggccagatctataaccccatcaaagaagatagatgaaacatggtgaactacgaaggaaaccgaggtccatttttaaatggggcctaatccttcgtgaatcttaaccacttcaaccacctattgaggaatcctccctgagatctagaagaaggctgcctctcttgcacagagctcgccgaagagatatgtgtaggccggagcaacatttccttatgcacatctagtagtaccacagttggctgctaggaaagaaatgatggcgatgctgcagctcgttagcaggaggaatcccggagactaacatcatgacagtaggacgatggcatccgaagccaacagccatctcgaagaccaaaagagtaaaatccatgggaatagcccgagaaagtaggaggacccgactaaaagtactactactagaggagccgtgaagcccaacccctctatcctccacttgcgaaaatggggaagatggcatggaagagagctgtgctaagacgggatgcgacaggattcgagagagaacgagagaaaaagcatttttttcctaggcttaaaatcggtgcgtatatctacagtcaatattgatgtgtgtgtgatgatttcatcaaccttaagatataccaactcagtctatcgaagatgccactaacatcatagggatagggggtgtgcgtgtgccgatctagcctaggtcgctaacctcataggggtagagcgtgtatatgtctttctataagtgagtgtgcacatgtctatattagcttgtgcgtttctaccatgttttaggaagaaaaagagggacatctccaactgtcctctgtctcgagccagatcaatcgaattgttcatcacccatgtttgctgcaggcccgcatctgtctctacagaaaggataaagtatgcatatatagggtttgtttcttaacggtggcaagatgctaacatggccttggccaggaaccacaccaggccaccctatagtcggtagaatttttgttttacaaaataaaagaagaaaacagtcgtcgtaactctagcttgcacatgaaattttatgttttcgacatgcagaaaacaagggttggtggcaggccaacagcacagatgatgcatgatggtttaatgagcagtcaagacggcatatacggcacacgagagacctgtaataagaagaaaattttgtacgtactttcgtggtaggagtgtgagagataattaccgccggccggtcccaaactcatgaacattcatgaaaaaagatggatgctgaagaaaagatcatggaaaatgtcctgaagctcactggtctgaagctcactggtctatcatgtatacgtgatgtagtcatatgcatgaatgaccaaaggcaaaacctagatgatagaatc

SEQ ID NO: 41821 - DNA, 1501 bp, Oryza sativa
catgatcttcagcaatggaagatgaacaaatggatgatgtagattcttcatttaactattgatgttcattcacttcctccttcaaaaggttagtttcacaagtactataggaagtagtgcatccatccatatcatccacacgcacacatttaatgctaggtgatatgcatgagtcaacaacacaatcaaatatagcaatttcattatcggtgttgttggagtccaaagggagagttggaagatcatcaaccttattcaccaatttattaccttgctcatacttgcatgttggtgagatgaataatgaggtgataccttcttggtcggaggagataatcacttgggacttgtcatgatgagacgataaagtagagcaatcaccaaatgatgtttccctaagagcatcctctccatcacatttggacttgtcatatctttcctttaatgttgtccaaattagataagcatcttcaagtggcatgatggttttgaacacatcttcactcaaagcactaaacaaaacattagtagcttgagcattgagatgtgtgcatttctcttcctcttcaaatgatagctccatatcattaggaggagaaatactcacatctacaactcgctctatattaggacccatggccctaaacatattaagcacatgagtactccaagatatataatttgaaccatctagtaaaagaagttctaggaacatttcacctcttgtcgacatcttctctcaagacggtgaagcccggaatgagagaccttgctctgataccaattgaaaggaccttaatgtcgtctagagggagggatgaataggcgttcctaaaaattatcagaacttcatagcatattagaatgatgagaacttttggttcaaataggaacttccgatatgagattggaaattccggtctcaaccgaaaagttcggcggataatggaataaaacactagctatgaacttgtagctcaaataaacaaaatatatatgaatcaaaaggtgacaaataaggtatctaaacaagatataaggtcaccaactaaatcaattaagcaagcaagtagatcgggtaaaaacaagctcaagcacaatatgagagaatgcacaaataggcaaaccaagagaggagacgcgtgatttgtttcccgaagttcggatacacggatcctacgtctccggtgaggagccacaagggccgggcctatttcaaccctttcctcatgaggttacacaaatgcactcctcggttttactcttgatttcttcccttgcggaggcgaaatcgaagcctttacaaactttccgtggcacaccacaaccttgggtgctcaccggcgatgcctagccgtctaggagaccttagtccccaaaagtaacaaacacaatcgaagatttgcttgctatgaactcgagtgctcaaagtatggagtgaagctcactagctctcaacttctcaatcactcaatccaactctttccccttctcaaatccc

SEQ ID NO: 41822 - DNA, 1501 bp, Oryza sativa
gccgcccatttgcaggcggccccccgcacagtacaatatcgccctagcggagggcggcaagggggccgcctgcaaatttcgttgacggccgtcgcccgagagcgaacggctgtctgccacgtcattttcgccgccctctgggatggcgatttttaaaaatcgccctcccagagggcggaaggcgactacttccgtcaattttcaaaatggaaaattattttttgtaaaacttttaataaaaaaaattaaaaataaaaaaaattcatccgaaagctgtgcacgtaactgacggccccatctgacacgagatgggccggcacagtgcacggggctacagctcactttgcaggaaacttagttagtgggttatgcggtggcccatgtaggataagaagatggtctactcatgcaacggtcccaatgaggcccaatattcgcaaaaaaaaaacaaaatattggacctggccccaccaaccaccacgcctgcgacaccttatccagggtcccactcgtcataatctctgtttggccataattggaaaccgaaactgcgcacagcagtactccatcccattttaatcctttgcacagagttcttatctcagttttcctaactcacctatcttgttttccgcgtgtacgttttttaaactgctaaatggtgtgtttttttaaaaaaattctatacgaaagttgttttaaaaaatcatattaatctatttttttaaaaaatagctaatatttaattaattgtgcaataatacgtacccaacccctccttctgaccacactcttaagagatcttttcaaattgatcatcatctaacctgtctatttgtttatttatgcagaagtaaatgcaatagttgcatgtctatttatccatgtgtgtaggagtaaatgctgtagttacatgtctgtttgatcgtgcatgtggacatcgttgcatatccacatgtatgcttaacacaacactttgattgatgaggtttaattaagagataattaaaaaatgccattgacgaacgtttaaatctaagaaataccatcaacgtgtgggttttaaaaaaataccatcgaacaaacgattttatcctaaaaataccatcaccgttaaaattccgtctattctacgctgttaaatacattgttcgtcctattacacttaacatagcggaatgaaaggaatcataatgacgatgacatttttgataaaattgtttgtacaatggtattttttagaactcacacttatcgatgatatttttttgtatttggacgcttgtcaatgacattttttttaggttatctcatttaaaaaaggaaggatgttttattgtcttggtcttgacgctattgcaaatatgataatcaaatttaaatagaggaagcaaccctttttttcctttcctttgtacaataaatgagctcactgctcacccatcttccatttctgctggctttcgtcaacgaaaaataaaggagaaaaaaaatatcttct

SEQ ID NO: 41823 - DNA, 1501 bp, Oryza sativa
tgcatcggaagtgatccagaagactaattgaaattattgcaaggcaagtcacacagatactaaacacaatcctttgagcatgttgaacatataattaaattctctttttatttcaaatatgcatttattttcgaatgtcattgggtggtgagccttttccctatattatggccgaagatttattttcctgtgttataatttgactagcttgggccttatatattggttcagctagatattagatataattgcttagccatgcttagaagtattagttaactattggggataactaatgcttcattattacttaatgattgctatttaatgtttgcacacggtggtcaatcgtgtttggttaattaattaattgccaattaaaacttgattaatggtgggttgtgagcacatggttttggtggtcgtgctcatgacaattaaggaccggttcgcgagctactgttgtgaaacattaaccatgccaaccacaagccagcgtgggcaacagctttaccttttgtatagcatagtttattacggggcaagagactgagaagtggtggagataagcccacgggggtcactgaggagtccatgccttgttttataaaggggtgactacgatccaggaacggtgcgctgtggtgagttgtgttgtatggggtgtattgtcacagctcctttcctaggtaccatgatggtattgacgcacatggtgggtacggtggtacatctctgtccagagtaaaattattcgaatagccgtgcccgcggttatgggcgggttgagcaatgtttttcgtgattagtcccacactactcactaatgtgaataatgtgatacttgatgattattaagaatgctaggtcttttgctgtgtgttactctactcttggattattttaacccctatatagaccttgatgtacacaactaatatataaattattagtataattctctcttatcatatcttccattgggattaaatacgataccttagaatacttccgggtgaaatgctacaatggtacattcgtgcgcttgcggatcatatctgtaaccatagtataccgggattatttctagtgctattgctgagaattatatttccagtactgtcgctaagaaataccaacaagcatttctagcgctgttgtcggggaagataaatcattcagagtttactacttgctaataattttatatttacctctgtataatcactatcctatgtaggcaaaccttgtatgttttctcttttatgtgaaaacagggtagtacaagactagttctgatctgccaaccaatttcaatcttgagtcacttgtggagcgagcctcgaccccgtgttgtccctcctcaagttactctatcagcaaccagaccatccattttcgtgccactagagtttaacgatatggctgggaagatcctccgcaagttcgcagctccctccgccgacaatgtgcccgttggaccctaagtcagcatgggaga

SEQ ID NO: 41824 - DNA, 1379 bp, Oryza sativa
ggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatgtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctggtagtttagacgtggtgtctagattactaggtatcattatttggggttatatgctgcggatgagaggtgggccgctgatggtgacagctcgctacgggtattcctccttgcgtgtatataatcctaagttaattccctggggagggtactcctccgtatttagccctggttgtatggtcatgacgggctgtcgtaaggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttctgaagcataaaactgcgggttgttcccccgcaga

SEQ ID NO: 41825 - DNA, 181 bp, Oryza sativa
atatatatatatatatatatatatatatatatatatatatatatatatatatatatatatatatatatatatatatatatactgcagcttgctactcggaggtttgtgaatggagaacaaatcgatgaagactatatgcattggcaagtctaccacttcttagagttcgtatattttcagg

SEQ ID NO: 41826 - DNA, 1501 bp, Oryza sativa
cttagagctaatatatcctagtatattttttttattttctaaaaatagtaaattcacagaactacaaatactttaagtaaactatcccaagactagatattttatatgttttattataaaaaaatatataaatttagcattgaatttatcataaaactacatattttaacttttgtgaaaaatatatttattattaaatttatcacaaaactactgattaatcattgacttcatcacaaagctacatatttacaagttccatcatgataaaaatactaggatggaacctctaactatgttgtttcgtgataaattaggtgtcaaaaatctgtagtttgcaatagtatggcttgataacctgtcggtgttaaacgtttagttttctgtgacaacgctagaatttgtactagtaactatagatatttttgtaaaactatcataaagctacaaattaaaggagcatttttttcatggaaatatatgtgccattcaattataaattatattggaaaaacgtgtataaatccaggctatgaaagagccccattgattggcttgataagccaaaacaaaagccaaaatttgaacttttaaacttgaatttaaagttgattttaagacattttcaacgtcatttatttttagcattggcttttagatcattatgaacaaatatataaaaaattatctataatttagtttttatttcttaataaaccgttttgatttattagtagtaggatatatgggtaaccaattaggctctcaagattactataagtaataagtctactttgcctccctcaactcatgctcctagttgaattgcatccctcaaccgcaaaaccggatataacccgtcctccaacggtcaaaaccattgcaaatcgacttctcggacggtttcggaggcagttttgtttgacatggcaattaacttgctgagtcatcaagtgggacccacttgtcaacagcctatatctcatcccatcttctcccacacctccccccctctctctctcttaactcttcctcttcttgtcaccttccatcagcagagaggaggggaggagctcgtccgccggccgcggcgcgcgtggggaggagattcgtcggtcggcagcacgcgaggaaggagctcgacggccagccgtgcgcggggaggagctcctagccattgacggacgccgaggcccacgggcggagctacagtaataaggctggtgtcaggtgacaccaataactttcggcaaaacctaaggcaaaactgtttatccatatgttattacactatgatctaagtataattagtgtactatgacaccgatagacacgctatgacaccaacgaatcgattttcattcgtccctgccgaggccgtggaggttctcgaagccgtcgtcaaaggcaacgcgtgggcgccgccgccgctgccagccgtcgcgctgtcgacgagagcttcaaggcgatgcgcatgcaggacatcgtcagggatgcgatc

SEQ ID NO: 41827 - DNA, 464 bp, Oryza sativa
taggggcaggtaattaggagggaattcctcctttacttcgtctaaacaaatctcagccatccattttcattaatgatctaatcaccaactaaactccctatcaatttccaccacctctaccaaacaagagactgggatgaaaaatcaaattcccatcttaatctcaccattaattccttggtgtaaactcccaattcccttccctcaagttgccaaacaagccgttcgtcctcaccaaacaaaccctagcctcttcataatcggggaaacagaaagagaaaaccctaaggctctctcccctccggcggcgacggggcgatcagggctgccagcgaacacgtctacggtacactcctcgatcgcctcgattctctcttccgattcgacgaaatcgcattgtatgggcacctaatctcacctgtgtccctttctttccgtgttcttcttctgcatgagcgtcaaga

SEQ ID NO: 41828 - DNA, 534 bp, Oryza sativa
ccccacaggctgttgaagtcccacattacgaaggaatgtgcttgactttgtcaacacttgggcaacaagatctgtgcaagtcatttcctgctccccttcatgtactggtcttctcaaaatggcttccatatcatcctagcaagacaatgatttgtcaggtttccttcacaatttattttcagtagtttccttcacaatctctactctagtccactttcactatttatttttttcacattgtaaagttacattgtatagcaggttcttgtgtgaagatgatgattaacgggtgcatgaagatgatgattaacgaaataacagttcaatcaatctggagcaatagagagtatacttcaattagatggagaagtccaagttatgtatttgtttatgatattgtagctaaaattgtacattttttttcctgaagttcaccttttcatgtaagatgtaaattaccattcagtgaatgaaatgtgtgatttttcgacaagtccctccctgattttttttatttataatgctaaagtgtga

SEQ ID NO: 41829 - DNA, 480 bp, Oryza sativa
caatcaatacaattcggcgcatcgccacacatttatacttttctactttatttaccatctggcggaacttggcacctgacacagggctgcatcggttttcgatctccggcgaaggggcaagtccaatgtttcgccggcccaagcaattgtctagtctacgtcggcgtcgttcaagactgcatcagtacgttcgacctcttggattgctccggtttggatgatatatttgtctgcctatttatcatatgtcttagttaatctagtcttagtatctcaatttagctctatcagttgtttctcgctttagggttcctgtcggtaccggctaaattgttttactagattagattagctaagacatctaccacccaaaaattagtcaaaggcttgattgtctagatattatgtttctattcatacttagtgctgcataagttaagtttgatctactaagtcgtgtttaaaaccataatccctagc

SEQ ID NO: 41830 - DNA, 889 bp, Oryza sativa
ctccttgcccttgtttgctattggaatcaaccagcagatcttggattgccttcagatgcttggtaacctcctccttgtgagcttgagccaaaatcgcttgactctggatttcctcatgaattagcttgttgtctccttctacctctttctgaaactcctcaaagtttaaccgcagttcttctaccgcagcctcccacgccggcatcaagacttcttcctccaatccagcagcatgtcccctccccatggtgagaaatacagatctggagatttcacaggaaagaaccttggcctctcccaaccctctctgcacttctcaattctgcatcttctccaccaaattccaaagcctggctacggaattttacagaggaacttgtcctcaaaccctcaccagcttaggactcttcgaattggagaaaacttggccaattttcgactgatgctctgatacctttgtcagatcccggggtcaaatgtcaccaaaaatctgcagattcgagctaatttgggctaagtagctacctaataggattcctaaggcagaaattaagctaagaaaattaaaggatgccgcaagacaagcaagtaggaactagggtttatatttctcgatccctttttcatccacccagatcgccttatatggagtacgggatctgagtgaggaggctggatagctcagcaggctgtgattacattaagtttcagagttttaggacaaagaagtacagacacagtaattactgaaatgaaccagctccctcggatttacatcattgaaccggtatcttagcatctgcgccgcccattcccgcaactcctgtttctctttctgataaacaacttcttcagataagcaaggcctgacacgagcttgcggacagca

SEQ ID NO: 41831 - DNA, 1501 bp, Oryza sativa; identical to SEQ ID NO: 18746

SEQ ID NO: 41832 - DNA, 177 bp, Oryza sativa
atataaaacggaggaagtaccaattaagagggatatactgactgatgcaaacgagtgaacaaagcagaacagatgtacatgaatgatgaatgatcgatcgattagttgtggattatatatacactcacatgagtaatctttctccgagtctatgaggctgcaatcacgctcggcagg

SEQ ID NO: 41833 - DNA, 1501 bp, Oryza sativa
ggtaacttttgactaataatcgtactaaccatatatatgttaagtattatgcatgttatattacaagattcatcttttaaagtacttttatgtgaagctaatttcatatttgttgggaacataacataaaataaattaatggtcaaagtatgtcattgaagaccgtgtaaaaaaatattggccttataatttgggacggagggagtactagcgcacagtttggcatatcttttagtttataatcggtcttcagtttggcacattctagtttgtcatgaagtttttgatttccgagtggatgggctgaggttcatatattatgcaagtattttggtaatttattatttaaaattttgtccatcttgttctacatgcagtactttggttttctcccatgtcgacatcattagctgaagttccgcaaggaggacatatcaaagaggtcattgcagagggctcttcgggaggcctatcatcgtcaacacagttattggctacaaaacgaaagttagcagcatcgaatcctccaacagcaaagcgaagacgatcacctattgcattgccaatagtcaggtctccaggagtgcgacaaattatttcccaaaatgaagtcatcatggagagatcacaagttgctggtcagatgtccccaagtgcagagtctccaagagctagatctatgtctccagtggcaaggttcgtatcaagtccgtctgctatcccaattgagctggatgttgaaactcagccaagggagtcaactcaatcaacacctcatgttgtgactcatcgttctggttagttctttactcttgatgtattgcatatataattctgtagtttatcttccacccaaacaaattaaacttacattctgtggttagttttagtaggtttgtgcacctgcaattctaattctgaatttggagatttggtcatttagcccctgtttattcatgtagctaagataattcagtttcagcagaagtttttagttcactttcatcaggaatctttactagtagaagtttagttcagtttctgtagagatttttagttcagtttcaacagaaaattagggttcagtttcataagaaaattttcatctcagtttcagcagaaatttttatctcagtttcagaacacattttagttcagttaaggtttcagcataagtttctagttcagtttcagtacaactcttagttcagtttcagctcaaatttttagtataattttagcagaaacttttagttcagtcccagcacaaatcctgttcttgtttgtgctcaatagattaattttagatatgatttaatgattcagggaaaagaacactcaaatctttaatctggaaagaatttaaaccattttattcttctactggaaaggtgctctatgggaaatgcattcattgcagtaaggtaattaaagctaaccgtggttcggggacaagtcaatgccatagacatttacttaagtgtccactgagaattagagt

SEQ ID NO: 41834 - DNA, 1501 bp, Oryza sativa
tgatgaagaattgggctaattgggctagctactggttcggccgaaccaggccgaaccctggccaagcccaatcagcccacaactttgtaggtggacttcttgttgattcctcaatccactgatgtgaattattaggcttgtttactcgtgtgaattctgtattattagcccatctgtccacaagtttgcttctcgatggcttccgattgatcgttcgtttgctttccgtcgattctcctccatttatatgtgcttctcctgcatacatgttagtagcatagtacatagtggaaatagacattttaattggaatttatgcattgcaagcatagctagtcttcattaattgggtaatatggacggtcgaaattgttcgataacgactgtcaacagtgcctagtcctcactgtagccgatatgaatagagatgagcctgtgctatcggctgcagcttatttctagtccaatactttgaatgcttttttattcaaccaaggaccaataacatcaactctcctggatatagtcatgatcatggacttagacatcacatcatcggctaacccagttagtatgaataccaagggcaaattctcttacaaaactaggagcatcggaggttggactggcttcatcacccagaacatgggaactggttctgtaacccctaaggaacacacagcctttctaatgatgtggttggaaaagttcttgttctgtggtccaagttgtggccctactaccaactggcagcacatagccaaagcccttgtagacaagaagcaattccccttgggcaaatatctgctaggctcattgtatcaaactctgaattctgcatcggctaagattgctgtagattctgtcattggcactggtggcccttggtggcttttgcaagtatggctcaaccttcataccatcaaggtggctaaatgtcacaccccgaagttctcctcccaagcctaaatttaatttataaatgaccctaagaaaataccggtgcaaagcaagagtaaaccccttttaaatcaatgcaaataataatcggaattggcatgtggaatttttcttgagttctaaatgtcgaaattcactaacaggatttttagtggaattttcagagctcttgaaataattttaaccaattaaaatggagcaagcaatattttaattccagggaaaatccttttctccttttttatttttctttttccctccctttttcgaatgggccgctggcccatcctctcctttcctccccctcctccctgctgggccggccgcaggccgaggcccagccaagccgcccctccctcctctcccggggtcgcgacaggtggggcccacctgtcgggtccttccccaacctcccgccgctcccgccgcgccaccgcgcccacgtctccgcctcctccgggccacgtcgaccacgcccgcgcgtgcgccgcgttccccgcgcccactcccctctctctcccgttcgcgcccgcgcccgaga

SEQ ID NO: 41835 - DNA, 1501 bp, Oryza sativa
ctgcacaagatataagagttcttaccatgctcatctttgctactggtgcaaaagtttcatcataatcaattccatatgtttgactatatctcttagccaccaaccttactttgtatctttccacctttccatcaggattttgctttactgtataaacccacttacagttgacaattttcttcccttcaggaaatggtacaagatcccatgttttgttcttttcaggagcctctagttcatctagcatagcttgatgccacctgggatcttgctttgcttctctccaatcctttgggatttgcactgaatctagtgatgctacaaaggccttatatgtggatgacaaggagtcataggaaacatagtggatatattattttcatatcaccctcatcttgagcttcaaaaccataccttagtggaggtttacctgcattgcttctcacactctttctaatggcaattggtaagtcagattcttctctaacttcctcttcttctccccctgactccaaagatccttgctcacggcttacatcttcctctacctgattatcctcttcaacttgttggattactggacaccttgttctccttgtgtatacttgaagatttttctcttcatgtggcttcctccattcttgctcctgtgcaacaggaccacccaagggacatggaattcaaccaaccacaagcttttccttctttggttgttcatctccctttggacccaatatttcatctttcatttagtgaccatcatgaccactagttgaatcatcaagatcaatgaataaagaacttaaatctgtcttctcaccatagaatgggacagattctctaaaagtaacatccatacttacaaaggttcgtcgttctaatggactccaacacttataccccttctggccagatgaatagcctacaaagatgcatttgacagcccgaggatcaagttttccaatggaaggtctatgatctctaacaaaacaagtgcaaccaaacacttttggtggaacaacaaattcattctttccaaatatcatctcacatggtgtcttcattccaagtattcttgatggtgtgcggttgataagataagttgctgtcattactgcctcactccacaagaatttaggtacattcatagtatacatcaatgagcgggctgtctctaagagatgacggtttttcctctcagccaccccattttgtggaggagtatcaggacaagaagtttgatgcaatattccttctgatgaaagaaagctactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaagttaacaaaatacttcattccactcatagagaccacaggtgaagtccaaacatctgagtgaa

SEQ ID NO: 41836 - DNA, 1501 bp, Oryza sativa
gatttcttcatgaaagcgatgaggctgtccattttgggtggctccactttgaccgtctgaatattctacggggctggcccgtactttaaccggaccatggagcattgtttcgtcctcggctggaactcgaacttctcctcctttccattgatgtggaaacggatgcttcttgttccgacatcaatgtttgcctctgcggtactcaggaatggacgcccaggatgagcggagtctccttaccggtgtccatgtccagcaccacgaaatcgaccgggataaagcaatcccgtatctttaccggcacgtcttctgctatcccggctaggtagcggaccgacgagtcagccagctgaaggcgcatcggtgttggtgccaacaccgtaaagttgagtttgtcgaagacgtccttgggcatgacgcttacacttgccccaaggtcgcagagtgcctggtcgaatttttgtgtctagattgagcaagtgattgtgggacaccccgaatctttcttcttctccgggagtttgtggaggatcgcgttgctgcattcctctgtcagcttgaccacctcggtcgtcggtagtggtcacttgttgttgaggatgtctttgagataacgtgcatatgttggcacttgcatagcgtccaacaacggacgttgatgtgaatcttctagatcacctcaatgaaacgagcgaactgctcgtccactgacggcttcctcatcctctgggggaatggcagcaacctcgtgtcgcagtaatgctgcggcacggtcttctctggctgaatttcttcttcagccgctgcgtcagacggtgtttccctgctgttgctgctagtacctgcattgttagggtatggcggatcgcaagtggacttacctcccctcgtcgtgatcgccttaacattttctatggagggttcgggttgccccggaatcctcccagattcatttgtaggaactagagcagctaattgtgccaactgggtttcaatcatttcattgaaacttagctggttttggaatgcggaagcaaagccatctagtttcacatttatattttctaagatcttgtcattagcaaccatctttttattaagtgcgtcagtagttttggcttgcgcgaaaacaagatccttcaaggaaggctggttagagaaattagcttggttattgccttcttggaaatacggacggggctggttccacccctgacctccttgcgggtggtacccgttgttgttgttattgttgttgttgttgttgttacccatgtacatcgcctcttcatgggtctctgggcagtcattcccagaatgtcccgtgttgccacagacttagcacgtgatgtgcgagtccaaggccttgacggtgcattggggcttcttgtcgtgttcgtcaagtcgtttcattaggaggtcgagttttgcagcgagtatttccgtctccttggcagtgtgcattcctcgctgacgggattggagccgttcctcgctccaa

SEQ ID NO: 41837 - DNA, 1501 bp, Oryza sativa
tagtcagggaaagctagcgacttgataggtggtccacgtgcaagctttgctgcaaaatcaagccagagacataaatcaaaccaggaaagtaaatttttttaagacatgtacaatagtcaaagaatgaacaagaaacaaggatgatattataacaaatggatgtttgatagatctctctcccccttgagcccaacggcacaaggggaccttgacccgcgccctgatcgagggcgcccagcccattggctggtaggcccccgtcaccccgtgccatataaacaggggtggaggccggggcggcacacgatacgaggttcgctgccgccgccaattccactcacaaattttcctttaatgcattctatgcattgttctaaatctgagaactccaatagaggaagaatgtcattcttaactagtcataattctccccctcgaaatatggcctaaacgacagtgccataatttcgatgagacatcaggagttctctttcttttcttgtttccttttgtcaatgaggacacaacattaacattctcagcaaaagataacaaataaagctcatcttgcaacacagcaagaccaatacatgcattattataccatagttcacatttgccatttccaaaatggcaatcatatccatcaaaatcctatttcgatacacttattaaattacataaaaaacatctcgaagtaaaagtgtgaagccaatcgggagctctaggcaaagactccaacagcttctacttttgcttcaactccattggcaactctaatggatcttttgtttctttgcgtagtcctcgtcgaacggaatccctttaaacaattacacgcatgaatagttactccagaatcaatccaccatgtggatctaaaataaccaacataatgagattcatttacaaatgtaataatgttctcacctttctttgccatgatcattttcaggaagtcaggacaatctttcttgtaatgtcatgtcttcttgcagtggagacactgatccttttcaacagtgaaatgttgttgctgaggcagatgctgaggctatttcccttttgaggggatggtttgtggctctttttcttgttatctttaacatagttaatagagccaccattggactctttgattctttcctcctcttgcacacaattagcgatgagcttttcaaaattccatttctctagacttatgttgaagttgacaataaagttgtcaaaatgctttggcaatgaggccataaccagatggaccagaaagtcatctgtgatacccaaatccattggcttcaacttggaagccatgttgctcatcctaagaatgtggtctcttacaccacccccatggtacctctctgtcacaagctgctttatcagctgtgtcgcataagtctttgaagaaccagtaaactggctctttattctttcgaggtactcagagacggtgtcacactctgggattgagcccaattctttgttgtgttgcaagatg

SEQ ID NO: 41838 - DNA, 1501 bp, Oryza sativa
ttccctctctctctccctcggattcgctcggaatctttcccctaaacctcgccggcatcaatggcggccgcacctttcgcggccgtttccccctcgcccggccgctctctccccctcccgacgctatttaatcgttccccgtgcctccctcctccgtttccgccgctcgccgctcactctccccttcggaatcgagcccgcgccgtcgtcctctctctccgccgtcgccgccgagctccggttcgccgctgtcgtcgccccggacctcctctcgtctcggcgtcacctcctttggcttcgccgcgtcctcgtcgacctcgtccgctcctccgtttcgcccgccgaccgccggagcaccgccgtcctcgttgacccgaaccgcgccgccgccttcctccgcttcggtcgccgtttccgtcgccgccgtcgacccggggtgagccgaagaccgccgcttcgcttccctcttctctcctctctctcgggcgccgctccgccgcgccggtggtcgccggcggtgaccatcggggcacgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccagccgcgtgcacccggtccaccgtggaccgagaggctgccgcgtgggtcccactcccgtggacccggtccgcgcgccctctctcccggctgacgcaataattcgattttaaattaaaatttaaatgaagaaattcgcaaatatccatttaaagaacatataaacttcaaatggccataacttggccatttgaactcggaattggaccgttcaagtctctaatttttccttaagaagtcaagaacccatttttgtgctttgtttctgctgttatgtggaatttattagcgtaaaagccttttcttttccgttggtcgtgtagacgctgcagcttcggaagatccgctcttcgtggaagttgaagccggcgtttgggaaagtgagcaaggcaagtcacatcatccttgaacatattgaatcccagtttataaaattattttgatttaaattattgcattatcgctttatttaaattcccgcgttatcacggttttacttagccatgcctatttacctttgttatgaccgtattattgttgttattgttattattaccttgtccaccctagattaaacaaaaccccaactagtggatactctactcatggtaccactagtatgattttaggtagatgcttcgctgtttaattagacaacattaggtggttttataactttagacttggggaattctcatatcacttggacactttggaattgttggtttattgtggaattggattcacaccgccccctctattcaaaatccccaaaatggttttaggctgggctcggggtgcatggttttgatagtagcacctcggccatataaagaccggt

SEQ ID NO: 41839 - DNA, 922 bp, Oryza sativa
attcattcatatatatgttaatgaatctaaatatatgtatgtgtttagattcattaatatctatatgaatatgggtaatgctagaaagtcttataatatgagacggaggcagtattttttttttgtttgttggatgggaaacatcaaaaccaaaactttgcttgttttgcagctatggctggctgccaggccggagaacacgctagtatatttggcattgacaagaatggggatgattctgatgaaccgtgtgctaaggatgatgccaatcaaagtgatatggctgctctgaaggaggaggaggagaattgggagctggacagtgaaccagagctcacatgggatgagaaggtggttcaagttctaaacatggttcgacaccgagagatcaccgaatataaccccaagcagttttgctcaattcctactcgattttgtgcctacaacatagccttctttgacctggacaaagagtgtgagtacatccatccactgttagggttttctataggatcgtctagccttagatctagtcgggtagagctcttgggtggatgaacaaatatggatgaaacaacagagagggaagtgagagggtttagggatacgactggttgacgttgaggaggaggaagaggcgccggccatcgtcgttgttgtcgcgcttgacgtggacggcggcgacgatggtcatgacggcggcggtcgtaggcgaggacgacgaggcgtggcgcggcgtgatgcttcccgtcactggctgcgccccctcgatcagttagggttttgtgggtggagttggcggtggcagtgaacctcgtatcgtgtgccccctcggcctccacccctgtttatatggcgcagggtgacaggggcccaccagccaatgggctgggcgccccccgatcagggcacgggtcaaggt

SEQ ID NO: 41840 - DNA, 1501 bp, Oryza sativa
tgctcctcagcgaattgtcatccatgcatcccgaagcagtcctatagcccgcggtgcaacagctccaactccagctagtgcattaccacaaggtgtcaatgctcaatttcagccgcagccaccagttgacaagacagaggccagtatcggcattgtacctttggatgttccagcacagcagccaagaaatcaagtacaagatgaagaacccgagcgtaagaaagttattgtcggttacaactgtagtacctgttaaggaaacagacatgccaatcgccaagtggtcactggagcaaatgcagtacctgttaagcctagcgctagtcagaagcaaccataatactcttatatcagtgttcaaatacttttgttttatagttgttccccgtcaatcatgtaataacagagaaacatgagataatgaatgagtttgataagtttatgaaggatccatgttaagattgcaagagctgtgagttgtgtacattttgttgttgattagggggacctagggtctcatttccgtaagctcataatctattatgaatcaaataacctagcgattgatggcgaagaaaatcaagtgatcaaccaaagagacatttgtttggactaagagtttcagatatgtcttcttcggatcaaaggcatgcacccgttgtggagaaattggacacgttgctagcatgtgtctcacactctgcactcactaggaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctccacctagctctgcaataaatcatagcaataatacctttagcaccaaccattctctgcaccgacagcctcagcaaagaattgtcgtcgatggaagaagttgtgtctctccccgacctactccaggccgagcaaagggcaatcaacctccggagggcgataccaagcagaagaccgtcatccgcttcaacccacaatcagaaggaagcttctcctgtgaatgatagcaatatgcagtcctatcacatcatcacagaactaatcaaggatgcagtcactagaacaatgccagctatatctctccagaatcaaaatgagcagccatatttgtggttttcagttcgctacctatcattgtgtaatcgaaagtttgcagcaatcatgtaatacataaatatattcatgtctataaacagtgagcttgctatgcttatggatgattcatgttgaagatacaatgtaccgatgttaagcaccttccctttttgtttaaggcagtgcctcgtattcttgtaatatgggagaaatgtgtaataaagacaagttctatgaggactctttcagaagatgctgatatgggattatg

SEQ ID NO: 41841 - DNA, 818 bp, Oryza sativa
ataaatgcatcgacattcagacagccaacttcagaaattgatacctcctaaaccacttgatataaaatcatgccatctggtcagaagatagatctacacgttatctacaacttttgtatagagacttttcacaggaaaacccattatgttggccggaaaagcagccaaaacagaactgcgcagggggcatatcagcaagaaaaacctggctgaggaataaatcggtggatcccaaacttactcacttccaacacttgatctaaaccctaaaagaaaaccaatacagtgggaaagatcatgtatttgatacctaggcctccttgggaagcggcaatcaaacccctcatttccttcttcacctcgattccctccgcttccttctctccctttcttctccttcccttcttcttcttcccaggtctgcagtagggcaggcatgggggaggtcgaccagagggggaggtgggcgccccagggtaccaaatgacggctagggggaggtgggggggacctcctagggtcttgggggtgtggagggggcagctgggccttgggctggccgaaagctagcccaactagcgtataactattgtttttcttctaattgcaaacaccaaaaaaaaatgtagggaattccaatatatactatacgctattctttttttttctagggcattacacagcatgtcagctctcttgctctcttcctcttctcccatcttttttttctttttttttcgtctctcttttctcctctttttatctttttttatctctttttttagtaaggtgggactaacaccaactttaaaccaaga

SEQ ID NO: 41842 - DNA, 1501 bp, Oryza sativa
cgcttcggcagaaagaatcgttctctaagatgagatctaagagttctctttgttctgcagttgtcttgtgtgcgaacgatcctccagcggaaatatcgagatttgcaacagactccttgtctaatccatactgaaaatgttgtaacaacaaatggtcaggcaaagacaagtctgggctagactaagttaacaatgacaacctggcccaggctgcactgagagattccttcttgttctatcggaaagaaatgatgtctaatcgaagattaattatacgagttaatggaaagaaagcaaggcaaaatttgcactttagctcctcccattgaccgtggaatttcttgacagacatagtgtaccattgcttcacttcatctctaagagaaaaaggaaacaattttcacttcaaagtttcatgtgccattcctacgatcgataggcatgaacacactagctcaaagtcccgaagatggaggtatgggctttcactaataccaccagagaaggtttgctcttgaatcatggctataaagccaggactgatttcgtagccttatgaaaggattggttttgaagaacgagatggctcacaaagatcagcctgaggagcagaaaggttttgaattgtgggttgctccatcaaggaaagggataaaagaagaagaaataaaaaaagatacgaggatgacctagactcggaaaaattagcaaccgttccccggcaacgacgccagaaatgcttgttggtattccttaagaccatagataaatctgcaagcacacggaataccgctgtagtacttcatcttcgggtgacccctaaaggatatcgaacacagggaacgtgtgtaatctacataaatctaagactatctaaggacaacaactaatggtaagcaagctaggctaggctagagaggactttctaagtgttttagttatctagactgagttgaaggtaatttccaatctattgcttcaggcaccgacccctgctggtctgccagcgtggttctggctatagctctatgatgtatctgaatgtggaagattactaggacgcgattcagggctgtcaccacctgtcgcctacctctgacaaatccatgggatacacaacaaacaaaggtaatatctaaactagacaccacgtctaagttataataaaataaagtccactattgcttggtttactaacctcttgcagagaatgagcaataaatggagaagaatcggcatcaaaaccatcgatcaatcaatcggacgatgccgagaaatagacttatagaaagatgggccatgaaaccataattgacacgatcaaattggaccaaaattcataagtctgggtgaaggagagcaagaggaggccactgaccgagtttgggctgggttcggcagaaccaaccgaagcaccattggatccaggttttggatagacggtgtggatggcttccctatggcggttggaggatattaccgacatttccaaccatcattg

SEQ ID NO: 41843 - DNA, 1501 bp, Oryza sativa
gtgtagatgggccagaaactcagaattgacacgatcaatttgggccaaaattcacaagtctacaaagagcagaagcaaaggagcccgccagccgaaaatgggctggtttggcctagcccagggttcggccgaacctccctcacggccgttcgatccaggtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgctcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctggtagtttagacgtggtgtctagattactaggtatcattatttggggttatatgctgcggatgagaggtgggccactgatggtgacagctcggtacgggtattcctccttgcgtgtatataatcctaagttaattccctggggagggtactcctccgtatttagccctggttgtatggtcatgacgggctgtcgtaaggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttccgaagcataaaactgcgggttgttcccccgcaga

SEQ ID NO: 41844 - DNA, 1501 bp, Oryza sativa
cattggcgaaggaaaggcgagaagagcgagagcgtgtggcgcaagggaggcacagaacggagagagctagggcacagaaacgcggcgtattgaagtgattaaaggaggggaagagaacccctcctagtcgtttttatccttccctcctccgtgcccggctcctcatttctcgcggccactacgcccacttccccacgcatccgcttcggtgcgtgttaggcacgacatacacgcatgcatacatatttatatatacatatatacgtatgtatgtaaagtatatgcatgcatgcatacatacatacatacatacatacatatttatttatttatacaatcttgatgtataagaaaaaaatatatacatatacaaattaaagtttgtatgtttgtatacgtacatatttaaacaacaaagaaaccgagagaaaaaaaagacgtatacaaggttgatatatgtatatattaaaaaactgaaaaaaatgaaaaaccgaaagggaagaagaaaacaacccgtataccattattagcggtttcactccgtttgtcgtgctagagaggaggaaaaaaacggcaagaggagcagatagctcgcccacgaattgccgaggaagaggataggtagaagacgcatgcagcttatggcagaggcggcgtgtgcagccagcttggaagaggagatgggaagaaagcgacgtttctggtggtggggagatgggtgcaaaaggatggggaagagataaggtgttccctgctttagtagcgcgcaaacattagcgaaatagacatacattatgtccagattcaaactcaggattggatttttttttgggacggagggagtactcgtcttatcgtctagcatgcatttcggcatgcatctgcaatacatatgtttgctgcagtaattttgttctgccgcgcagtcgtgcaggcgtacagtcttaccaggcgtacggccgtacagtcttgagtccttaccagatacagatagccgtacagtcttgcaggcgtgcggccggggatcatgtcggagggagcgatgggaagaacttccatcattgtgtagtgaaacttctgtgtaacttatgatgagatcgttgtgtagtcgatctcatcgatagacacgaaagttggcttatgatgctgaagctcgagacgagggacgccatagatatagtgaaacttctgtgtaaacggcaccgagaagaagcacctcgctcgctgctgcgaaaaccacccatgcggtgcttccgccgcccaatgtctttcaactatgacactccgggtaaggcgtactatctctaccgtgtgttctccaatgatccacgcctcaagctcccaagctcggagctcatgccatcactgcatcaagcagcccaagtcgaggctgctgccgtccatgatcatcttgttggcatcgacggcacggcaaacgagctgctcggatggctcatggccgccgacaagagcctccgggtcatggccattgctggacccg

SEQ ID NO: 41845 - DNA, 1501 bp, Oryza sativa
agttcggtcggggggcagcgggtgataatcgaggtttggtcgaaggagcgatgcagaaggggtcgggcccttaaagaacgatgagacaaaaggggtttatacaggttcgggccactaagaagcgtaacatcctactcctgtatttggttgattctgtgaggaacacaatgtatcagtcggttgaaatctgagaaatcatcccccttctcactaggcctggatctccttatacctcaaggggttaccacaggggcccaaaaacccacctagagaagaaggaaaacattatttacatttattacatgtcttatccctctgacttggaagaccatgagcacagcgcctcggcatggcccccatcaaatcatgctgaacgatacgggggacgtctgtatcattctgcattaattactgaaaacttccgagcactcgttcccaccagggaacgggtaccctcctccatcggtacacgccatgtgtccattcgcgtggggggattaggatcctctgacgtgaagtcagagggatgtggtcactgacatatggaccccaccactcgcggaccaacatgtcagtgattacgccagggagtagttcacgtcagaggatccggttccgcgcgggagagggacgcgcagacatccgctctaaatagcttttccgatcacccctgggggttgtcctggccagtggccactggggttccacttgcaattcttcaccgctcgaataaaaaaaaaatctccatcggttcttccttactcaggtatctattccctcagtcacagccactggcgattgttttctcgccgaagtcatgccctacgaggaggttacgactagagagagaattgtggcgtgggggagtcactgaaaccgtgaaacgaaagctgattatggatctggtcgtcggcgcgtcgagcggcgccgtgaagtcgctcgtcaacaagctgggcaccctcctggcgcaggagtacaccctcatctccggcgtccgcgacgacatccagtacatcaacgacgagctcgccagcatgcaggccttcctcagcaggctcaagcgggacgtcgcccacgacgagcagcgtcaggactggatgaagcaggtgcgcgaggtcgcctacgacatcgaggactgcgtcgacgacgtccgccaccgcctcggcggcgagccccgcgggaccggcacagttgtctccctcaagaggacgtggtacctgctcaccacgctgtaccagcgctgctgcatcgccaccgacatcggcaacctcaaggtcagggcgcagcatgtcagcgagcggcgcaccaggtacggggtggagaacctcccagcaaacagaaatggtggcggcaacaacaactccggcgctcccggagaccatccagctcctctcccccggctgattggcaccactgaacctgtaggcatggacgacgccatgaacgaccttcaaagatggttcatggtctcaaagcagaacagccaaatcagttaccttgc

SEQ ID NO: 41846 - DNA, 285 bp, Oryza sativa
ctatgctataaacatatataatctttacattgaagtacttttaaacataagtgatttatactgtctcggcaagctggtctgatctatcctaatcacttggtttaaacatatttcaatctatagattatatactgttaatatctacagccgatcgactagatttaactttctttttgctttatatatcattgccgatctaattcacgttacatcggctaacttacaaacgatatgtcatcagcatgtggccgatcggctaccgtttatggatttaactatgttttt

SEQ ID NO: 41847 - DNA, 1501 bp, Oryza sativa
tctaagcacgacttaatagatcaaactcaattgatgcagcattaagtatgaaaagaagaacaatatctagacaatcaagccgctagaagattcatagaatggtagatatcttatataatctggatcaacatcaagatctaacctaatcggatgccttctgcatacagatgttggtcgatagtagattagatagcgatattgctgaagattatgtaagatatatgataacttgacgaattatataaataagattagagtgtcataaagatggaagcactaatcctaataacacgatccgtcataacgaattttaccttttgttgaagatcgaaaccgatgcagctcaacccgaaagcaaaaactcgtcgaaacaaaattaaagtaaaaggatggcgatgcgccggaattgtattgaacgtgtgtgttaaaaattacatagggctcagggtctatttatacccgaggattacaagatatgcccataccggacacgaccattatctctaacaaactctaaatatcacgtctttgcggcagacttttgcccacacttatctataaggaatttacataaaacatcctaattaatagatacaattgccttcccaggactctatccatgcgtggcaatcatcttgaagtacatcaacctgagcccgacgccgtgcacaagtcgtattgtcagaatcggctatatcagcttatttagcttagctcaacctcagccgatcctagccgtagccgatctggactccagccgattcctgctttgttccagaactcgatctccgcctccaactcttcttcgatcaaatcccctttcctgacacaaatgctaccaaatttggttgttaacacgacggtggcgcgctcagcctagggcgagcgtgcgcgccggcgaggggccctgcggcggcgccgccatcacctccagctgccaccgaccgtggccacagcgaagagaggagggagaaagagaaatggcgctagggtttttcggccggccgggagggagggttttgttccccccgatctcggcggtcagccgtccgatcgtaaccctagcgatcggatggctgaaaaaaggcgcttggttggtggctgtgggccgaacgtgccaggccggccaaagtctgattttggttcctcgtggccgaagcaaaaaaagaaaaagaagttagatttggatccctattttagaagcttttattatttatgtttattgaagtatttatttctaagcaattttaaccaacgtgaaaattgttcagggagtaaaaaattgtaagaattgcttctgaacatgtatgtaattttaagtttccgctgctataatgatgtttacaagttttccatgcattagttctatttctgcccaacggtgatgtagaattaatgtggtagtatgttgtatgttttaattttgaccaacgttaaattaaaacatacaagagttttatttgtttcttgatttatttaaatttgctttcaggaacaacta

SEQ ID NO: 41848 - DNA, 1501 bp, Oryza sativa
tcgagcacgacggagacgagggccttgatgttgaggatgccgacggcttgggcatagagggctgctagggctgcatgcgtggccggccgccggatgtgaccaacgggcggcgccgcggcgccgtgggtgagccgtgcctaggcaaacagggtggcaagggccggcggtgtggagtccgcgggcggcggtgcgtggatcgtcgcagtgggtagggacgacgcgtggagtgtcgccgcgggcatggcaatggccgtcgcgccgagagcgccagaggtcgcagcaaccgtggcaaccggtgacaagacgagggcactgagggcgacggagagggcctcacgtgtggcgtcagaggcgcgggtcgccgcagactcggcaacggtgtttgccgtagtggggtcgatctccagaccgacgggaacagcgaaggccgcacgaacagcgtctgcgacggcaccggcagtagaatcgatcgcggtcgatttcggagagggaggggtggtggaagaggacgacatgatgtcgccgggaacgcacggccggtgagggtgcaccggcggaagtggacgcacggcggcggagcgacgccggcgggttatgcagaagcgaaggatcgatgagtgattgattccatgttagacaggaatgactcatcgcgataatgaattgatcacggagcattacatgtataggcatccactttccatactcactcaaccgatttatggaaacaggatcgggaggagaaggaaggggagttggtaatgaagggaaagagattacattccaacagcctcgtcgttgctggccttaggtcggcccgaccgccacactgctcctctcttgtcggccgccgtgcgcccctcctctcccaccggccgtcgcgcgccgcttcctccccgtcgtgcctgaagagtggaggggagagaggaggaagaagagggtgagaatgacatgccccaccattttatattatttttttatataactgatttgtggtgtcatagtttttattatttttgaaatcaaatttccacgtaagcaccatgttaatgccacctcagatgaagactgagtcaaattatccacgtagacgtcacgtcagctgaaaccgctatccaaaccgtcttgaaacttattttgcatcggttttgatagttgagacctgaggggctggttttcgggttgaaggacgaaaattggatttgctgacaagttaagggacctcagataaacttattccatatttaaatcctaacgataataaagggaatgggcagcagacacgccataatgtactagtatggcggcattagacgatattcctaaaaactataaaagataaagccatagcgagtggggaatcaaggggaggaaagaagtaagaggtggtggttgctgtgacttttaaaaactgtaaaattataaacctgatgacaataaggcttgattttttaaaaaatcctaacacaacatgatggttgtttaacaaattttaaagaaa

SEQ ID NO: 41849 - DNA, 1024 bp, Oryza sativa
ttttttttcggtttttcttttagtttatttccattttttaatacgtcacaaacaaactttatatacatgtatatttttaaaccgtgttgaattacttgaagtgaactcgatggcttgatgctagctggataaacgtgtggatctttacgttcactctcagagattaaaatatagtaattagcctcccccgaaaaaacaaatttaaaatggcttataatagtgaatatttttaatgcgctaattttctaatacgaccatgttaagctccactaaaatagtaataaaacaattaaattgtgttacccaaatatgcactttatatttaattttcttaaatattttaattgtcatttcacaatcctatacgtccaaaatatcgagaaatacttgataaaaaaaactatcttggaatagtttaaactacttaagttggtcgatgtaaccgacagatgtacgggcccctccaccctagcactctatactcctttaaaggagaatagttgtggcgtgagtagtaattctaccaccccatcaccatatgcataggatctaagggtctgttttgtgttacccaaatatgcactttatatttaattttcttaaatattttaattgtcatttcacaatcctatgcgtccaaaatatcgaggaatacttgataaaaaaaactatcttggaatagtttaaactacttaagttggtcgatgtaaccgacagatgtgcgggcccctccaccctagcactctatactcctttaaaggagaatagttgtggtgtgagtagtaattctaccaccccatcaccatatgcataggatctaagggtctgttaggaggagcttttagcagctgcagccagggccggccctggtcctatgcaaccgatgcgaccgccgggggctcatgatggtgaggaccaacacctaatactagtagtctagtacctgcctatggcctacctagaagcagaaacgtcgagacgagaggagttggagtgtcgtcctcctatagacttgtttatagaa

SEQ ID NO: 41850 - DNA, 1501 bp, Oryza sativa
atgtcgtcgtggacgccggagatgagggtgtactcctgcgcgaggaggctgcccagcttgttgacgagggacttcacggcgccgctcgaggcgccgacgaccagatccataatcagctcccgtttcagtgaataggtataggaacctgagaaagtaagaaacggtggataactttttttttttctttttgattcgaacgatggagaattggaaatttggaaccccaggggcagggatgggtcatgggcagggttttaaatcttcctctatagctatttgagaaagactctagttatttattctcatgtacaatttagctgctatagctctatttagcctattatatatagctgccgctatagccttttgagaagttaaccgctaaatgtcttaacccgttatttaaaatattggtcatgggtggtccagccgctgggagtgggattgaccgagtggggcaatcatgatgccataatgaggcctatgcaattatctaattattttaatacatgattttctttaaaatttgttaaacaaccatcatgttgtgttaggattttttaaaaaatcaagccttattgtcatcaggtttataattttacagtttttaaaagtcacagcaaccaccacctcttacttctttcctccccttgattccccactcgctatggctttatcttttatagtttttaggaatatcgtctaatgccgccatactagtacattatggcgtgtctgctgcccattccctttattatcgttaggatttaaatatggaataagtttatctgaggtcccttaacttgtcagcaaatccaattttcgtccttcaacccgaaaaccagcccctcaggtctcaactatcaaaaccgatgcaaaataagtttcaagacggtttggatagcggtttcagctgacgtgacgtctacgtggataatttgactcagtcttcatctgaggtggcattaacatggtgcttacgtggaaatttgatttcaaaaataataaaaactatgacaccacaaatcagttatataaaaaaataatataaaatggtggggcatgtcattctcaccctcttcttcctcctctctcccctccactcttcaggcacgacggggaggaagcggcgcgcgacggccggtgggagaggaggggcgcacggcggccgacaagagaggagcagtgtggcggtcgggccgacctaaggccagcaacgacgaggctgttggaatgtaatctctttcccttcattaccaactccccttccttctcctcccgatcctgtttccataaatcggttgagtgagtatggaaagtggatgcctatacatgtaatgctccgtgatcaattcattatcgcgatgagtcattcctgtctaacatggaatcaatcactcatcgatccttcgcttctgcataacccgccggcgtcgctccgccgccgtgcgtccacttccgccggtgcaccctcaccggccgtgcgttcccggcgacatca

SEQ ID NO: 41851 - DNA, 982 bp, Oryza sativa
ttccccccacgcgccgggcgcctgacatcgagcattctcgcacttttttttaacgatagtaagaataattgtttgttagttagaaagaacaacagtaagttaaatagaaatgaacgcgaacacgcgacgacacgccgcgcacacagctgcacacaaaacatgctttaatcaaaacaagcattaaacacatgttacctgttgtcaaccaaatgctcatcttttgtttcatttataggttacaaagattgcatacaagttaataccacacttgcgcacacagtatgtcttaatcaaagcaaccaaaaaacacgtgctagctgttgctgatcaaatgatcacctttagtttcatttaggtttaaaaggtcgcatataagttaataccacatgataggtaatgaccaatccaattaagaaacaagtaatcgaaaccatgtcaaatacatagaccttatgaacttgtatcgacaacacaactgcgaacagatacaattatacaaatgaatactccttccgtttcgtaatataagtcattttagcattgtccacattcatatatatgttaatgattttagacaccccattaccagacttgagggcaagcctgtgggctgagatattttttgtcggtcccgcagacgacctacagaaataatgagtttttgtgaaggtttacttatacctacagaaaaattggtatatttctgtcggttgtggctaggactcacagaaaaatcagcgctgactggtgggccatataaccatcgtataaaacttgctcatccaaccgaagccctaagggtgtgtttggataatgggaaatggagagtaggattgggattggaaaatgaatgaagggttatgattaaatggaagaggaagaatgaatggttaggatttaaagataccttttgatgggtgagaaatcatttcccaatcccgttatcgaaacaatgcctaaattttttcccctcattcccagt

SEQ ID NO: 41852 - DNA, 424 bp, Oryza sativa
tcctgcagccctattaatctgttaaactacattaacacttgattaattcctgtttaatatatttgatctatattgatatcctagtataaagtagtgtcggagtattagccgatacatgttaaatctacaacatcggctatgctataaacatatataatctttacattgaagtacttttagacataagtgatttatactgtctcggcaagctggtctgatctatcctaatcacttggtttaaacatatttcaatctatagattatatactgttaatatctacagccgatcgactagatttaactttctttttgctttatatatcattgccgatctaattcacgttacatcggctaacttacaaacgatatgtcatcagcatgtggccgatcggctaccgtttatggatttaactatgtttttttg

SEQ ID NO: 41853 - DNA, 1501 bp, Oryza sativa
ctaattgttccataatttgacaatgtagtgctgtagtaaacatttgctaatgacggattaattatgcttaataaatttatctcacgttttactgacggattctgtaattggtttttttattagtgcccgaatatctcatagaacaccctatataatatccgaagtgacagtaaaaattttacacccttatatctaaacaccccctcaaacaaaaaaacatcgcaaacttttgacaggaaaactaattagcgcgtacgcgccagatgagttagcggcacgcacgtacacgtgtcgctcacacagcgcagcgctaccgttattataagtaaaagccggaaaccagaagaaaaaaaggtgatgcgtggttttttttttcagattagcgagattagtgctgattttttccagaataattaggccgtaatctgcattcaatgattttacataattcaaggatttcaatgatttttaaaaaatcgacccaaaatttgaaactttcaacactaatttaaaaactttcaacttatatttaaaaatttttaaatcatattaaaaactttgaagtcaagatttgaaaactttcaactcaaaatttgaaactttcatctaaaaattcaaaaactttcaactcaaaatttaaaactttcaactcaaattttgaaatctttcagctcaaatttcaataactttcaactcaaaattcataattttcatctcaaaattgaaaacttcttatttgaaattcaaaactttcaacttaaaatttaaaacttttaaatcaaatttcgaaacctttccacttcaaatttaaaactttccactatttttgaaaagttttcgactaaattaactatatatgctttttaaagactaatgctaatgatggtaattaacgctaattgtcgtaatttgcggcacgaatgtcgtagcactgtagcaggggcgcgcgttggtgggctgaatgcccaggagtcggaatgaggctgctccactggtgtaccgtataataaccaaaaaagtgcgcgctacatattctactcgcgaatccgcgcgaactaggtgtcgcgagaggttgatacgcagtcactgaagtccccgttcgcaaaagagcaaaaacattaaccgcacgcgcaatcacaacgaagcctctctggtcaactctcacccgcacgtacgactacccacccacccacccccaccgaagctactccaaaccagtataaccaccgggccccacgcgtcatcctcccgcgcgtacgccaccgtcgcgtggcaaaagttcgcgaccaatctatacctcgctcgctcctcgctagtccaccaccgcacctaacagccgccaacctctccctcgactcgtcgtcgtcggcttcgattcgatcgatcgaggcgaggaggaggaggagctagggtttcggatgggaggaggaggagggttgtagaagcgcgggggcaggctgcggtggatcgtcgatgggggagcagccggcgcggggggcgg

SEQ ID NO: 41854 - DNA, 1501 bp, Oryza sativa
taccagtcttcttctcggggttggagggaggttgcccgcgtcctaagtgagatggtaaaataagaatctgctcgctccttttcacgacaacaatacaccgaagacgactcacctcggaaccgctcaccttgcgacgagacccagtgccggtgactgtggtcgcccacctcttctgtttcgacgtcctgctgcccccagcagcagcgacgtcggaagcctccttggagactttctccttaagtaaggcggaagcttggtgatccacgagtgggccaatggtgtccgttagaggtagagcctgcaaagatgaggtcatatcgttttctcggaagaaagaggaaacggatgtcaactatgcttacgttgatggcggtagctcgttctgtgccaccttgctcacagagcggggccaggatctcggccgccttcgaaggcaggctaatcatcacttggcacaccctctgggctacggtggcgctgtcaagacctacgataaggaactaaccttggttagatctgaaaaaactgtagacgcagaataaggtaacaacgcgagaacaagtaccccgctgcgagatccgggtcacatcgtccggcccagagtagtcataagcagggtgaacacgggcttgcagcggctggattcgacgacctatgaagtcgacagcaacctcatagctggtcagtccttgtactcgcagatcatctatgatgtccacgaatgcttggagagaagaagtcaagggaggtttcgaggtccactcttgagatcactcaggttggttctcgggaacgacaaggacaggctctgagttttcgatctgaagttaaaaccacctcgatcttcacttgctacgagataaggggtattggaagggaatgtatttcgccttcatgccatcctgaaggcgaaatccgtagcatccagagatcctgctggattccatccaatgaagctcgtagtagtagcagaagagatcgagaaaaggcactaccacaacagagatgagcgaaaatgctcaggaaaataatcgaattggggttgagatgaagcaaagaaagaccgtagaagttcaagatcagcaggaggaattcggaaggtggaggtagacaaccacaataaacgaaatcctctaccactaccatacgacctaagatgggatggggttcagtacctcctttgtcccgctccatggtcccgcggccgggtagagcccccttcttgcagtttcttcatggcggcggtgtcaaaagatgatttttccagatccatggccgccagaagatcgccgggaagtgaacagggaaaaaaggctagggttttttggggacggaggggtcaagagcgccgggaagatggaagaattttctcgcaaacagatttgaaatggatcccaaaattcctttaaataggcgcacaacaacacggttcgtatcctaaggaaaggagagagattgctgccgaaaatttctaaagctcgttatgggctgtagtttagac

SEQ ID NO: 41855 - DNA, 1501 bp, Oryza sativa
tgataaagtatttgtaatatttcgatgtgtaatgcagtagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttcgtgtttactacggtggtagagtggtggaaccttatgttggtggacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagatctcagtttagatctctagaggtgtttgcatcaaagttagttcgtaccgtagaaaatttggatctaaacaaatctccttcttatcattacgttgagaagaattttgtgacatattattctcgtcgtggagggggtgcaagtaagagtgagttggtacgagaagacttggagggggaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattactttgatgtcgaattgagtggtggtcacgattctgtctcagtagaagtcaatagagatgatgttgacgaggaggcaagtgttgagcaatatgatgttgaatttgctgaagactctgatgatgaccgtccattccctccacttagtaataatgacaagttagcattagaggaatgccgtgcgtttgagaaggtgtttgggaggaagccgggcattcctgagtttagggacctaacacatgcccatggtgcactactagatggcggcatcaacctagatcagttgccagaaccattccaggtggatggtctcagaaagggtttagagttcccatccatggtcgcattgaagctatggcttcaggagtacgccatcgtgcaccatcgtccataccgtgttgtcaattctgccgcaaatattaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctg

SEQ ID NO: 41856 - DNA, 1501 bp, Oryza sativa
ctattaatacctggtcccacctgtcatacatacactgtgtcttaaagtctgtgctatagctgattacaaatctgtagcccgctggcttttctctttcctaaagccgtctccaatgggcagctcttagctagctcatagagttttttaatcgatgaacaggacgccaagagctagctcgcacgctcaccgaggcggtgccctctcccaggtacgctcgcccagacagtggctggcactgtgccgagcgcgtatgagctagcagccggcttatacagctggataaggcttatgcacagacaaatctcagaatttaggcctcctttgattcataggaatttcatgggaaaaatgtaggatttaggattgggcactgtagcagcctttgattcataggagtagggcataggaaagttagaggaaattttcctttggaactcatttcacagggaaaacataggaaaagaaaacatccaccctaacctcttttttccatcatgtgtgcgtaggatggagataaatgacagacatatgcatcattgttgttcttttagaagaaaatatacattgtgatattgtggataaggccaaagtgacatgtattaatacacttcctgacactctctttcctgtgaaattcctatacccattcaaagggctagtaacataactttcctatgttttgcaatcctctgtttttacagtttcattcctacaaaaatcctacgtttttcttattcctctgttttttcattcctgtgattcaaaagggcccttagtgtatgataactgctgttcatcacattcatggggagaggagtcggcttcccttgttttccttcgccttctcgtcaggtggatgttattgagggggatcgggattgggatgcttggaacgggtggatgtcgaggagggagaaagagattgggagaaagagagaggtcaggatagcgcgcgagttggagagacaacgagatgccagaatggcggcagccgcgaaggaggagatggagggagtactaagggcgatggatcgtcttcccggtaggatatccgatctgctccggtcggagcgtgggcacgccggcctctccgtcctcgcccgccgtggcttcgtcttcacggagacggagctgagcagccttgttgcagcactgcggcagctgctggcatcggccgagcgaattggtccggggcatgtcgactcccagaccgtgaaccactgcgcctacttgatagatctggctagatggatcgatgacctcatcgatggctacgcaccagataaggccgagacagagctccgggagctgaaccttgcctggatcgagcagcttctgcttgtgaccgacgcgccgccggcagcgcccgacgtcgtcgtcgacgttggccctcccagtattcttgtcggcatcgacgtcccaaggaagaagctggccagatggctcacggcctccgacgatggggaggcgcagctgaaggtgctctctgttgtcggaccag

SEQ ID NO: 41857 - DNA, 1501 bp, Oryza sativa
gattcacctaggcacgagaggggactgcccgctgccttgcgaggagtgggggtgaaacctgaggtgtggtgtgtttggttagagcgggttatgcgaagggtcctgtcacggcctctttccggtatgtcgtgttggcatgccggcgcacggtaacgtgtcgtggggctgtgtcttgtgggtacagttgaacacctttgatcagaggaaaagtattcgaatagccatgcccgcggttatgggcggtcaaccagattcaccgtgattagtctcaccctagcttagtctaatggaattgattagttcaggtggttggttggtcctgttgcaatgtggtgtagcgttggacagtggatggttaatattaactaattattacaactattttactgttttcaactactgtttataaatgctagctttatgcaaatgatcgaaagcaatattaaaaaattgaaaacaaagaaagcaatacgcatgtgcatcttttctagtatattgaaaaactgaaaaccaagtggtttcattccgtttgtcacgctagagacgacaaagaaaagggtaaggcgaacagatagctcgccgacgcattgtgaagaagaggatagctagaagatgcagcttaaggcggaggcggagtgcagccagcttgggagaggaaatggaaagaaagcgacgtttccggtgggcgcagagatgagtggataagggtggggaagagataaggtgttccctgctttagttgcgcacgaacattagtgaaagagacttatactcgcctagcttgcattcggcatgcatctacaaccagtatagttgtttcttgaaataattctgttctgcagcgctacctagctcttgagtccttaccagctagccgtacagtcttgcaggcgtgcggcggggatcatgtcgaagggagcgatgggaagaacttccatcatggagaagcaggaggaggcgttgaaggagtgggagcccctccatgagagtatctctaagctgctgaagggtggacgcatcaccgacgcccgcgaaaggcacagcttggcattcatggagatggaactgggcgtcattgtcgcatacctgaggatgccgctgccaccacacacagattgtcctggtgtcgatctcatcgataaccagatccagtaccactggagttactacagggatgtcgtgatatctctgtataatcagtacggagaagaagcacctaatgcggggctgctgcgaaaagccatgcggtgcttccgccgccgaaggtctttagagtataacattccgaggacagcgtacagtctctaccgtgagtgctccagtgatccacgcctcgagctcccaagctcggagctcatgccatcgccgcatcaagcagcccaagttgaggctggtgccctcaatgatcatcttgttggcatcgacagcatggcaaacgagatgctcagatggctcatggccaccgacaagggtctccgggtcatggccattgctggacccg

SEQ ID NO: 41858 - DNA, 1501 bp, Oryza sativa
ccaaagagtctatgctgtcgaaccgtggaggatgagacgtcatgccgggtttgccagacctggggacaacttgggacgaacgcgcgcaatggtgttgccaataccgcgcgggcgaggttggagaccaccatgaatcatactccaatgtcggaggaaactagcagagaaggcctccaagacggtcacgacacgagaacggcatagaaggagaattgccggagcagcgcggtgttgtcagagaggagcgaagtgtagtcgaggaagatacaacaacgctagtgatgagacatgctggatgaagacgaaggcgaagtagtgggaccaacggccgggacgacgtcgtcggtagccatgtagaggtagcgagaccaccaacccagagcggcgaaggtggcaacttggagacgcggcggcgatgctcgaagtaaacgaagaagaacctgacggctgaagatgaccagtgcggatgacgaggaatcacggtggatagtggtcttgagcatgcacgttggagccgagcgttcgtggtagtgggaaccggggcctcacgacgccttgccatgcttgtggaggtcgcagtggtcttgccgcaccttaactcggggactgcagcaacactgcttggacacacgaactgggcaagtgcagataggaaacaatggcttcgatgagaaaaatgtggtcagaaagtggaaaaagagagggggaagaaaatagagatccaccgccaccgtgcaccatcgaggagcacatccaccatggagctcgttgcccttcgctacgcagagctcaccatcaagaccacgacaccaatgacgttggcgctcacgaaaaagtttcattcccgaaataagtttttttaggatctgtttgtaaaataagttttcacaagggacaaaaattgaaaaatccaaactcatcttatatgtggttgattacttaatggactgtttctttccggttgaatatccttgcatttctttcgtatatcttatgtgggtcataagatagataaatagatatgtgaacacgcaatttcgctttcatattaatctgtcagcaataaattgatgtagaattgtgccaagggagtagctatagaactgtcgacagtttttgggatgaaaaactttcaaatgtaactactatgtaattacgttgtaactactatgtaactactatgtaattgatatgtaactcaagtgtaactcaaaaaagcatgatggagcaattggttagttgaaaaaaatccaagttggaggtgttgggttcgattccatacctgctgtacgcgtctgatttttttttcgttttccttcaccagcagtccagcatattagacggcttaaaatttgaaagttttcacccctgttaactgtcgacagtagtatagcaaatccgttgtggcaatgcaaggttgcatgcctatgaggaaacctattaagcgtattactacaactcatcacaacaaggcgcgcgtgccgtagctttattgagagca

SEQ ID NO: 41859 - DNA, 1501 bp, Oryza sativa
gccagcctttcctccagtttaacatcttctagaagatggattgcttaccaaatcgtctattgcagaatggttgctcagtgcctacctcccctcgatttgaggatgatgcaaaagatgatacagcattgtgaataaagctgttattgttgtggccggccaaatcctgggctattgggataccggtaaatatcagatctatttttaaaaatatgccggtaagacaatcactgttatattatgtttgcctgtatgacatctcaaagaaggataggggaaactactttgaatgaatgatgacaaggaaataagatgagccagtcagcgtgatttggtttactggaaaaaattagggggaaactatcataagagatggtttggcttgcataaaatttgcgcatatttgaatcaaaagcattttatatatggaatttgactttctgttaacctgtcacgcagggcagcagactacagcgtgtgttgaggtaggagagtacgaatgtccacacagggcgacagatatagtagtgacgaaattctaaacatggttaagaccatgcttatgtgatgtattcatgaccactttttcagctagaaccattaattgtgccgagggatcaaattaaagcaaaacaagttagctcatctgcttttgattgacactaaaagcagtcccaaatttatttactggagtaatatcttcttcaattacagtaactaaggcatgcaaacaaatgtcatttccaatttgagtgtatatcactgaatattctaaatgctcttttctgtatatatcttatcttcacaaagcacataacaaaatggttaaagtcgcgcagatgcgcaacttcataacctaataaatatcttgaaaagatgcaaaattattgtatatgaccctattatactgagccaaatgagctcgcgagtggctcgtgagacagctcaggcttggctcgttttagaaactagatgaataccccgtcgcgttgctgtgaaaaattaagttgcataatatgtacagaactaaaacaatttgatacatttttgagcctaaaagtaattgagattgtatgtttttaagagagaaaaaagaagagacaatttggatcatagatctatcatccaaaggttagaaataattagggtgatgtggcttaatgagagaagagagaaatagcattgactacacttagtggggatgaactatataagtatataggatgagctaggaaagaggcttgggcttggctcgtttggctttcgaccgagccgagctatgcgagcccaaaccaagcccaagccgagctctcctcgagttttttttccacccctactctcttcatcccaaaatataaggcaaccatttttctcatatatcataatataagacgtgcatgcatacatacattaattaacacctcttggttctctaaatttggtttattttaaatcctctacaatcaagcccctcaatcacattcattgcttgcttgtattgaga

SEQ ID NO: 41860 - DNA, 1501 bp, Oryza sativa
tggaggttgcccgagtccagcagcacgagcaagaacccgttcggctgtcctggattcgagctcgtccaaacgttgccgcccacgccgccgccggtggtggtgtccgcgaggaggagctggccgagggtgacgctgaacacggactgcgccgtggctgtcactgccgacgcagagctcggatccgtcgcgtaccataccaccaccgccttgtgctcgtcgtcgtcgttattgaaccatacggcgaggaggaacaggccggcgtcgatggcgcggaagccgaaggcgaagtcgtcggacgagctggtgatgtactgaggaggcctcagagtggatccggccgtgaggttgaggttatccgcttcaagcagacggggttggtggtgcagcacgatcagcagcaacagcaaccgagcgaacgacgagagggacattcctgcaaatggcttcatttctgctctcaataaagctacggcacgcgcgccttgttgtgatgagttgtagtaatacgcttaataggtttcctcataggcatgcaaccttgcattgccacaacggatttgctatactactgtcgacagttaacaggggtgaaaactttcaaattttaagccgtctaatatgctggactgctggtgaaggaaaacgaaaaaaaaatcagacgcgtacagcaggtatggaatcgaacccaacacctccaacttggatttttttcaactaaccaattgctccatcatgcttttttgagttacacttgagttacatatcaattacatagtagttacatagtagttacaacgtaattacatagtagttacatttgaaagtttttcatcccaaaaactgtcgacagttctatagctactcccttggcacaattctacatcaatttattgctgacagattaatatgaaagcgaaattgcgtgttcacatatctatttatctatcttatgacccacataagatatacgaaagaaatgcaaggatattcaaccggaaagaaacagtccattaagtaatcaaccacatataagatgagtttggatttttcaatttttgtcccttgtgaaaacttattttacaaacagatcctaaaaaaacttatttcgggaatgaaactttttcgtgagcgccaacgtcattggtgtcgtggtcttgatggtgagctctgcgtagcgaagggcaacgagctccatggtggatgtgctcctcgatggtgcacggtggcggtggatctctattttcttccccctctctttttccactttctgaccacatttttctcatcgaagccattgtttcctatctgcacttgcccagttcgtgtgtccaagcagtgttgctgcagtccccgagttaaggtgcggcaagaccactgcgacctccacaagcatggcaaggcgtcgtgaggccccggttcccactaccacgaacgctcggctccaacgtgcatgctcaagaccactatccaccgtgattcctcgtcatccgcactggtcatc

SEQ ID NO: 41861 - DNA, 1424 bp, Oryza sativa
acccacgactaccgtaattgccctcaaagaaggtcttattaagaacaggaaggagacgactccaactaacattaggattcagaaatcttcaaatttacgcctttacgccctggagctaggattcagaaagatggttatagcaatgcctcattttgcttcttgctagtgacgcttttaggtgccagtctatgttagttaattaataatcataaatctgcttcagaacatgaggatttctgcactttaattaatcttcatatgatgtgaacttatgtgttatctagtagtcctagcagtagtggaagtgttagtttctgcgtactcagtgagggaaatgggatgtcccctaaaacaagttcttttgggacatgaacaagaactaggaatacttgtctcattgtctgtgatcaatcgatcgttgatcaagttattcatttttatgtacctttgttccttttcttgtccttcatgttttgaattttggtcatgaatccaacatacaaaaggcaaaattcttttcagttttgtcacatgagacatgccaagttaattcatatgtgagagagaaagtgcattgttttcacgtacacgtttttcaaactgctaaacaatgtattttttataaaaaaaatatatatataggaaagttactttaaaaagttatattaatctatttttcaagtttgaaataattaatactcaactaatcacacgccaatagctcacctaatattacgtatcttatcaatcttctcttttcttctgctatcagacaatctactaaccaacaaatcgatactactactgtagacattgaacgatgacacattgggtagttgtgaagtctacaatcccgttgtgaagtactccagttagaatgggcctacgagccgtgggagaatttactatttaccaccctcccaatgtgcatatgctcaaatgtcactctcccaaattttcattctcattagcacccagacccacatataagtctccttcaggttcacacgtgtccaccagctcaatggatgaaaaatgaggctagcatcctcccaaaatgcacatgcccaaaataccactcctaaattttcatttttatttgtcacccgggctcacatgtcagcgtcacttttgattcattcaacttgtggacccgggaagggaagggagtaagattttttccaatcacattagacatccgtttaggagcattatctattcttctactagattttacaatttgtaagtggcgcgggagagacaccagcagagcggcaaatgaaaaaaaaaaattacacagaagattttctagagagcatcacataaagttgagacttgagaggaggaaatcgaggagagaaaaaacaaagatcgccacaacgcaaaacccacttcctcccgccgattacggggacacgccgaca

SEQ ID NO: 41862 - DNA, 466 bp, Oryza sativa
catattctccctcaaagcatgggccttagcctgatcaataaatttagatgcttccttaataaatatcggttgcgttctccgcatctcatacatccatgacgaccgatccatctaattatataaaggcaaaaaagttacagataaaaaaatagaccgcaggtatttcatacaaaagtttaaatgcatttgtctcccaaaaaaaattacaacaatacatgtaactagtatgtacaagtgattacatgcaaaatttgcccatcaaaacaaatattttgaagctagattttgcaaaaaatagttagaacaaaccttgtcaaaatattaaaaaaactccactttccaccaacgaaatataacaaaaatggagccaaatgaaggaggatagagagttcttcacctttcgtatagagttcaagcaaaaatttcgagttgaaaacctccccccctaattggtgcttgctttagg

SEQ ID NO: 41863 - DNA, 1501 bp, Oryza sativa
cagcaagcagaggatctaatcaccaaacctaactaaccagcgtggcgaagatctataaaaatagagtgatgcccactgtcaggatgtatgccaagactgtaggggtgtgtgcacatacgattgggaagatacgtaaaacgaggtggcctattaagttgtgtttgggagtgagggttcccagcacgtaaaacgaagcagcctttagcgtgtgattaattaagttttagcaattttttttaaaaaaattgatcaatatgaattttttaagcaactttcgtatataaactttttaaaaaaaacgcaccatttagcagtttgaaaagcgtgtgagcggaaaacgatgagaaggggttgggaacctagacaaacgaaatgagccttagtgcatgattaattgagtattaattattttaaattttaaaaatagattaatatgatttttaaagcaattttctgatagaaattttttgcaacaaacacacaacgagagaaatattctctatcacctgctgccgaatgcagttagactcatacgattcagcatgtaccagacaatatcattatttctgaaaaaaatcctgcctttggaatcgtgatgattctgttccgacaaggtcgccatgtctatgaactgcactgctgtcgaggaaagacatctatatcttgtttgaattgcctgaatctcaggtgataattaagctagctgattccgtacttcgcggctacatgggtccattccttgaaggggtgattagccgtttccaggattctgtattacagcaggcaaagtagttatttgctcatcatctaatctacaagtgatccgccatccaaaccctgttctaaaacagtactattattatgacaaaagtaccatgcaatatcatctgtcatgtaacttcgtcgtgtcctcatttagttttgtcaaaactattgttatcgcatcctatatgaagtgtgcacattcttgagctagctacccattagtccatatcgaggtcaagaataatcatatacccattgggcgggtgctattggcgagatgaagaacgcgatggtggcacacaaagacgggggtggtcgcaccgaggagaggatctcgacatggaagagggagcccaaagagatgccacagagtacaacagggacatgggcgtgagtcaacaaccacgctatggaggaagccgacttagcgaaacctgatatctggcgagccaagtatacgtgctgcgtgtccttcataatatgtttaggccaatttaatataggcaacataatgttgcgatcctgtcctcatccatctgaaatggcatagatgcctattgtaacctgttgcgacttatctagtatgggcaccatttatcttaacacatatgctttattgactcaattttaaaatttatagcagatgaaaaccatatgcggacccacatatttatacttaattaatacaaaaggtacaacactttttttccgttgtacatatgtactatctcctaat

SEQ ID NO: 41864 - DNA, 1501 bp, Oryza sativa
agagcagttgaaaacagggtagtgagtcttggcaattgcattagtatgagaatacgacagcaacaaagaaaacccggtactttctctgtttgctgaccttgctaacaaaataattaattcagaacatactttcattgatatctcatcccttttttgctaaatctttcacacagcaataattgtaaaataaaataccagatatcatgagctactaatgttagtcagattatgatcaaatattaatttaagagagtctagctatacttgaattattattaatatatattttgcagtacagttcacaattttcagttgtgagatagcattttccagaatttggagaaattaaacttttgtttgtttttacctttattacaaaactgctctggttccagtacaattcgagcagaactcaatttctgcttgaagtattttgtcacaatgtgattgcttcttctgattgtgagaaatccaactgatcatttaactcacatagttgaggaagtcacatactgtactgcacataagcatcttagttcactatcctttagaggagctagctactcatacatactcagctcagaaaatgcagttgagacaatttgcatattgttttccccttgccaatcagtgggtgaaactgcgcaactgtagccatagtattccaatagtgtttagcatgaactttcgacaaaattaaaaagttgagtactttttgagagtaaggaactccatgaatgtatctttaatgcttggtatgtataagttttaaaggattggaagcaatcaggattgagactatgacatgatctaatatgaattccctggaatctcgacgacagtgccatgtgtgtttgtattttagctcctatttgtgggttgcagataaatgcttgggctttcctcaattgtcagttagtcctgaaacataagaactgtacttggagcatctaaaatcgtgttgcttgtagtgcaacatccaatacaaattacttgtaggatctgtaagatcaatgtgtgttttgattcttattccgtgataaacaattagcatctgtgattattggttttgatatttggagattatcgtcaaagtggttttggagatgatcggatttactgttattttatgtgaccggtccgaccgggttgtgtatgccggtcagaccggcggtgatcgagcggtcagaccggccggcccgcagtctgaccggccgacgctgtgtcggcttcggtttcgggttgtttctttggatatccgtgattgtttcatggttatggcttctagatggatattatacgtatgtaatactgttgtttgctactaatgagtcaagttggtgatagcttggtctcggaatatagtttctttgtttgtttcatccataggtgactcgatgcctcgggagagtatttacggtgatggaccggaagtcggcttggtggtaagacgacgtccgtggtagtcagatatcatgtgggatactaaggctagagttga

SEQ ID NO: 41865 - DNA, 1501 bp, Oryza sativa
attcgcggtagtaatttagatgtaattaataactaaacaaataaatgaattcttatagattattatagattatttttgggtaatccctataagtaatcgattcacggtaaaaattcggatttaatcgctaggaattttagacgtatattatatttaatcgtttagtcatagactaaattaaattgtataatatttctaggatttcgtccaatatttagctcgtggtagaaatttctaacctattatatacaatgctcggggagactaaattattgacaacgaaataattatacccgcaaaatagtttaaatcgaaattgggtttgccgtagttcgcagatagtaaagttaataaaaagaatcaactttcgcgttcgactttcatttggatttatttggatttttatttgaattctaaccaaattcaaatcaatttttgcacgtaactatagagcccgagggagttgcggatccaagtgaaggccaagacccgcaagactttgagcaaggcaagtcatcgctattctttgaacatgttgatcccaattgcgaaattgttttgtttacaaataaaattgcatgcaatcatgaacatcctacttgtgattataccatgccttgattattgttcacctttaaatctttgtaaccatagatacgtacgagtccctagtcaactatgacacttgcttagaaatgctattttagattcatgcatactcatatttatcaaatgttatatgcttgggcaattacctttgggaaggtaattgagatgcgacatgtggagacatgagcgccacattgccatgatattgatgacataatttgtgaaaggaaaataaagtaaaacaactgttttcgactggggtggctggaggacttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactaccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtttgagtaaaccaaatctattcgaatagccgtgctcgcggttattgagcaccgggacatgtattacacttggctagactctaaattcttaacttgtgtgggaggggatattgcatga

SEQ ID NO: 41866 - DNA, 386 bp, Oryza sativa
ctatgcttgatgaaatcattgtcaaaagggggagaagtaatgtgaaaatttttagatttttggagaagcaaggtgaatttatggagagttgttgagaagagcatgttttttgttcaattgggaatttctttcttttaaaaagggggagaagttttcttttcgatttttgagcacgatgtgtacatttgtacgaagtgtgctctttaccacttttgtttttatttttccaaacaccaaaacatttttatggatttgccaatgtgttcatcaagggggagattgtaaaatcaaaggtgttttcgattattattctgtgatgaacaattgggcattggagattattggttttgttatttggaatttattcacgaagtggtttttggaga

SEQ ID NO: 41867 - DNA, 396 bp, Oryza sativa
cgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagttcgaccagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactt

SEQ ID NO: 41868 - DNA, 326 bp, Oryza sativa
cttgtgtctcggtccaaaagcggtagatcatacttcaaactcgccatgggaattaatcctgaatttgctggtaagaaattagggtaaactagcaaaaacgcgaaacctcggtgcacttcctgtgtgcacaaagcgaagtatgtagatttcctggtacacaagctttggtgcgcttagcaatttcctccttggcaaaaagcctgaacagaacagccaagctctcggctgattattttaatcctcgtgacgcgtgcgctgcttgtagtactcctctcacgacgcctgaacggctgctgctgcggtgctgccttttcttctcgcgcagg

SEQ ID NO: 41869 - DNA, 1143 bp, Oryza sativa
ttcatgcccaaatgaatgtgactgtgcttagatatatttttttaattgtgaatgcccatataaaggtccgtgactagctaagcagacgacatctttattttactcattttactgtctgtgacggatcctaattatgaccatcacaaataaaagttacttaaaatatctgtcctttttcaagttacatttgatagcgatggcaattgcacatacttatatatatgtcctataaattgaggatatgcaaagataaaactactagatgtactgagatgtcaatcacatcaatttccataaaattcaacaactaatctttggtcatgattcaaataggggaagctctacacatccgggagatgggcagatatcacacaggatgaagtaaacagcttgaccgtatagtagttttgatgccctccatgcccacactgtttgtgtttgtttccatgcatcatagatagctgctgctctttgctggtagcaagattctgcacattcttgatcaactctcacgattaaagaaaaaagagagatttcgaggaattgtgagcgtgttgggattgaacacgggacctcaaagttgaaaccacatacccattaccactgcactatcaagtgcctcttagctctcacaattcatatgttaagatctgttgcctgtagccttgagtttatatggtgattagcattgaatggagatgttatcctacaaaaaagtataaaatggatgtggtattcggaagagattcggtataggattgttttgacgaattcttgttgtgtcacatatgtttcggtgcaccaggacatccatggccattttgtattgttcattccagtctaaaactctttcatgagaagtgctataaacaaattcattttgatgaggtcgatctagaccagtatttatgatttttaactgaattttcctgtcaattctccggtattacagttccaaatttcaagcatcggttcaaaatgcagtgctcactcaaattttgattgaactccaaccagagtttgaacatgtggaagcacttctacacttaagaacactgggtttcgccctcgaccatatgttttataacaagaattaattagttaccggcctaattttattattacatctcttcaactcccagg

SEQ ID NO: 41870 - DNA, 1501 bp, Oryza sativa
ttttcattagataagtattaaggaactgttccattgatgtgattgacgcagcttgcaattggagagttagttttcctgcatgatcttacctacagtgtgcagtcacgcaaagtgagcttttgtccaatctggacataatctgattggttctaaaacattaaggcatgttgcagtacagaggttttctttggcaatcttccctgggtctcttgttttttatgtttcacattactggttctgataagcattctacctaaataaattggactccgtaagtcagaacatgtatatcagcatgtgggaagagcacccctgaccattgcctgatcctaccaatctaccatagccatcggaaagctcttctggtgtttaccatggaaatggaagacatgaggaattctcatcatacaaattggataagatcgtccgcatctgctaagggaagacaagagatctaaaacgctgcgatgattgtagcagtgcgagtagcagcgagcctgagactcgagaggatatctgctcctccattgctccatcgccttatttccaaaatggattggttcacttgtgcatcttgttgctccttggttcttcctccatttttttttgctacagaatggttcattgtttttcttcctattattagtttactacaagatgttgcttatcacaggttgtatggagtaacttatttttcttttgaagaaggaagtaactttatttccaagaggtcaattttgtgctgagatgccttgggaggaagatgatcagctggaatttgactgggttgaaagggcatcctcttgtacctttgactgagttgcatgtgcaaccggcttgttagcactccgaataagtcattgcacaatagagtacactaatcgagcaaatcttaaaattatgttatcaaaccatatgcagctgtagacaaacatagcgccgctgtagatgaacaataataggacagaactgagaagtaaatgttcaacctttggaatctctaatagttgctctgattcgacttttggtagcatacattttgactaaaattataaattagagatcacaagaactaagagaacttcacatagactacagcccatagctatcaaatgcatatcagccccaatcatgcgaggggtgatgtttactgtacaatagaaagtaggaacataagtcaaacgcgcacacgcttcgcttgtgttccaaaaaaaggaacacacacacgcgcgaatgcctcgctcgcttggctcgggctggagtggcatgcgtacgcaatttgtgcgtgaatggtttgtaaaaattggctcctcatgcttgcataaatgcagcttccttttacagttttattttgttgcaaaatttggtgctcatttttggaaacacaccaagtcatctggtgcgtggagcggtgtggagtccggttaggttacatgcgatctctctagttcggttacacgttatggagaacgtctaggcgtcttgaatcacattttctatt

SEQ ID NO: 41871 - DNA, 1501 bp, Oryza sativa
tttcggctccgataccatattgagttgcgtgcaccgaccagttcaacccaaaagattaagctgatgaggaaaaaagcgaacaattcactttgtattccaacaaaaaaaaatatgagtttgaactaatttagttgaattataacagactattgggtacccatatagtcagggatggatccaccgcccagcaaccctgtttggccgcttgggcttgtcgagcagacacaaaatagaattggagtgttttttgttgaattgaaaacaaaattttgaagcaaagacgtgatataataagattgtccgaggcatgtgttcatattttgtcagtcaaaaacagagcattaagactctgaatacaatcaagaaacatcttagtgaagataaaatagtgagtgcatgtgagagcgcttcctccaagcaattcagagagacaaaatatttcttctcagttgctcatatgatttatgcacgttttttttcccaatgcttgtggcaacaatattgctgacgatcattatctcttcctatggatttaacttggcctgtgttaatcactccaaacatgacagcattatatatgtagtcaaattcctgtagctacttttcctcttaaggcaaattcagcatcgaatttaaccccaaagaaataaagttaatccatcgaaaaatacaaatgtgtcgagatgttccgtatagcatacaatctgcgatgctaattagaatacagtacactaattaatacgatatcttgtgaaagaaaaagagcaaactaggagcaagaaggcgcgcgagcgaactaaaacatttcagatctgagatgatttggccatggatgagcatcctcttgcaagacatctgaacccacctggctagaatcattccatgattttaagtgactccccttcctgtagcaaacgcggacaatcttctccgtttgtacgatgaaattgaattcctcatgccttccatttccatgacaaatttgtgaagatcattcctatcgctaggataggtaattgccatgaacacagagcgctcgtccctcatacttctagccgaagtttgttattcgactgtccaatttataatttcaaagtgaatgtttgaattcatatatatattgctccaatattgtgaaacaaaaaaaaaagagctcctcagccttacgtacatggaagattatgaaaggatcctttgtacaataatatcaatgtaataataccacataagtgtcaatattatcaaacttgtctgtactcatgccttgatgtttcggtgcttatctcactctatccacagatcggctgcactgcaggtaagattaggctgaaaaattaactctccgattactcagcatatatataagacttgtgtaaaacaaagcatattcaacatctttgttggtaattaaaatgctgtccccttcgatgtaataaaaaaaaagaaaagtacgaattacccccccccccccggaactatcccggtcgaccgaaatacaccc

SEQ ID NO: 41872 - DNA, 932 bp, Oryza sativa
gaacacctacaaacatacagagtgtattcagagaacctgtagcttgtcttcaactccacaaggaaaagagtagctatagcttacaattagtacctattgacattaatatccaacatctcgacatctttgttggtacactgttacctccttggatgctatcgaacaaatgtaacagttgtgtctgatcgaaattgacatttatttatcatctatgtttcgttcaccatagaagcattttcaactctatgttcatttttacatcatccaagtaaagtttatctggccgtgacaatgttaacggggagataaacatgaatggaaataggagccggggaccaggttgaagtcctggaatatgcatgaaaccacatcaatccatcatctgttgcttagatatcaatgatcattagcaaaaagatggacgacattggtattcctagggagcattttgggtgcacactgcacagtctgtagatgtggacagtcccattctgggtgcagagataaatgttccttcccctggtactgggtgcagataaaatgggtcagtcggatacctactctatcttcaaaattaatgtagttaaatcctcaattgataactatgaaaccacagttagaccttgaaatagctatgcaataaatattgtgattgttagagcagtgatcacataaatacggcttctgatgatctgcacttaagcacactctcattctgagtcccttaactacacaagttgagctaattggattttgagaatatgcttcattcacatccatcatattaattctagtgctgaattgaaattgcgtaaatctttgttttaatttatatagataaggactatccgtatcattagacaagaagagacaaagaagatttgcgcattgtgctcagaaggtttgatctaacaatgtatatcctacccagc

SEQ ID NO: 41873 - DNA, 1501 bp, Oryza sativa
gtgctcacagaacttcatgttaccctgagtgcagccatccagcaggttcctcttcatcaattctgctataccaagttcactcatatgtccaagacgcatatgccataggttagtcctactagcttcatctttagaaacagcagcagcggtaacagaaccatgtaatgtacttcctctcaggacatataagtttgtagaattcatatcaccaatcatataaacgagagaacctttcgatacctttacaactccactgaaccggagtatttgtatccttctgcatcaagtgtgctgagagagatgagatttctcgccatccctggtatgtgtctcacatatttcagcgtgcgtgtcatgccatcatgtgtcttgatctgaacggagccaatgcccatgatcacacgtgggttatcatctcccatgcgcacaacatctccattctgcacagacttgtaagaactaaaccaatctctgttaatgcagatatgaaacgaacatgcagtatcaagtatccattcatcatgattagcaacacaaccagcaaaaacgacaagacaatctcctgaatcagagttatcagcactggtaacaacagaggccttaccatcagatttccttttctccttattctgcagattccaacattcttcaatgaagtgatttttctttttgcaatacttacataattttttacctctactctggctcttgtcatgatcattgctgtcgttgtaggttctccgctcaaatctgcctctgacctgcaatgcttcgcccttagaggacgatgcatcagattgaaccatacctttcatcttctccctgttttggagcgcctcatagacttccgctagggttagttcatcatggcttaaaagtatggtgtcgcgaaaatttgcatatgaactaggcagtgagcataacagtaaaagacctaaatcttcatcatcaaactgtacctccatcgacactaggtcggcaacgatctccttgaagaccgatatgtggttcaatacagaaccactctcctacaacttgtgtgagaacaacttcatcttgatatgcatcttactggttagatctttagacatgcagatcgattccagtttgagccaaagttctgcagcagtcttttcctgcaacacttcttgcaaaatatcattagatagatgaagttggatcagcgacagagccttacgatctttccgcttctcctcagcggttcattaagtcgatttcttcttcccgaagctttccagcacctcatcaagatccaaagtttgcgccagaacagcccgcatcttgacttgccatagcgagaatctcgtcttgtagtctagcagcggtagatcatacttcatcgacaccatcgcgaaaccctaatgtgggaacaagctctgataccacttgttaggaaacgataagcgaacaaacgataaagaacaatagatcaatcatagaagacacgagatttaacgtggaaaaccctcctaaaacagga

SEQ ID NO: 41874 - DNA, 1478 bp, Oryza sativa
acaccagtttgggaagcatttggtggtctagacaagcgtgtataattgagatgggactagcagtactttgttcaaatgagagttgcatggatctgaaattacagtactgtccaactcctaaaacatcaagccgttcaggcaaaacatccggaaattacaagcacaatttggatttctatccttgttttatttgcatttgttcataaggaaatgacaacacatggctcaggcaggatgcaaaatgaagacagtggttctttggatctaaccctgtcccctgcaaacgagcacatactatgtaggtgtagggctcgcaacattcttaactaaataaaggcgagcaagtggagttaccttagatttggtgttcctaatgcttaccaagcctacatgatatgtcattgacgatttgagtgaacatgaggacaacaatgaaacttgggaggcaacaatattcataggcatcatatttatactcaacaagtagcagcatcaactagagcatccgtaaacatatagtttaattgctcctgataaaaaattccagtaccacatggtccaactattgagagaccactgcaatagtgttccgaagttctcgtttgtggatgatagcacaagaatggctatcctctttatgggtttgctgttggtgtccttccggctttatgtatctttatgcagaggccagaagtgagctcagcttggttgtattatctcgatgtagttgactgagtttcaataaagcttccattatctaaagagttaaataaatttgcaagtttcattgaccgtccctgattggattttggcaaccatgtctcctgctttttttggcttccctgagaaaggttgtttcttgttaatacaatcaaatttgatctgcatgcatgcgtaattgaaattaatcaacatgttggaacagaacttacgagtgttcaagtttctgtctatttctctcgtaccccttctgagggtagtatttacatatttatactaggttacatacaaaggaagttacaaatctacccctatcactgtagttacctcgaggtggctgataggtgggctggccaacggctcgggggtccattcgcctgaccgggagacggctgcgcccattaagggggccggtatggtgccatcatagtagtagcttttacccaggcaatagctagcattggccttcacatcgccagtcgtgtcgtgacatcggtggtggttggaggataagtaatgcgctttaatggcggcccatgctcattcccggtgtcctccctaggctccggccccaaactcctggtaagagctttggagccccttgagccagctccgaatcctccggggcccttgagccagctccgtggccttcagggccctagactgggctctgaggtccccggggcactttgcttggctccgaacttccgtcggcttcctaggcctccgataagggcctttcctacggagatggactc

SEQ ID NO: 41875 - DNA, 217 bp, Oryza sativa
tactttaaatgtgtgtccgtatatccaatgtgacaaccaaacctaaattttttcccaactaaacaaggtcttagtcaaactataccggaactgaaacatttcaatcgaatttcgttcagattactgcagttcaaaccagaccctggtcaacgcttattgggttgggcccaccctgagagacgccgcagcccggaagagccagcccactttgacggtt

SEQ ID NO: 41876 - DNA, 178 bp, Oryza sativa
aattagccagcaaacaatgaatacaagatggacacaagcaagcagtttaaacttaagcaccagtattaattgttgtattgccgtgtcagtttgtgatgcagaacattgagcatgaggggtggtcacttgtcaggcgaattgctcgtgagccgtcagagagagacaggtttcccggcga

SEQ ID NO: 41877 - DNA, 855 bp, Oryza sativa
aagatgtaaagagtttttagtaatcagtaataattcagtaccccgtggtgtgcctgacactacagtggggtagttaacttatgctatatctgatgaaattgtccacaaagtggcatttcagtccaatacactgtgacgaatgatctcatgaggcaaaatagaccaaattcagcattggagatcgactgccaacattgctgatcattcaggaagcgagtagagttacaactcaggttcttcaggtgagcatgtgcctttgcaaggggcatcagtgcaccggcaaacgggttgtcccgaaagctcccatccattgaacccacgttccagcaccatgatgttctttgttcctgattcttccttggtctcagatagatagtcggagaacatcttggcacacgatggacctcgcacctgcagcgtgatttgatctcactgtgtaagaaatatgcacttttgcatgttatctcaaataagaatatcaggcgggagagcacaacgatatgcttgattattatataataatgagctaaaaagagattagaaaacttgccctttccatctgctattaataaatgtgctgttacaatataataaaaaacatgagctaacgcaatcagcaatgacgacagcgttctagatgcaaaaatcgaacatggtaccaactcagtggatgtggacaagtataagttaacaaagaacactctctattattgataatattagaagataatgcaatgcttcaaaagtattaactggggatttccaaaatctttactatagaaagcatcaaaatcagagtttgaaagactatctgcttgaaccagaaataggtagcctttcatttattttagataa

SEQ ID NO: 41878 - DNA, 377 bp, Oryza sativa
ctttgtcaacattgggtaataaatcgactagctcatgttacttatgtgacctagctagaactatatgcttagccatgcttaattaccattagctcagttgatgggataattaccgtattagaccttttagtatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtggacaacggctgggcttgtagtgtagctttcctctagtcgacgcatccaggcaagggtgggcgtga

SEQ ID NO: 41879 - DNA, 416 bp, Oryza sativa
ccttgtgttggtatttaatgacattgctaaaagtattcattcccaacaatggcgcagaaatagtcctggtatatttattgttagatataccattgtagtatttcacccagaagtattccaaggtaacatatttgtttaattccaaaggaagattgtgaaagagagaaccttgccaagctatacatattacttgcattcattaaagtctaaacatggattaattcaatatgtgggtagagtgacacgaagtgaatcttatagaattcctcatgagaataattctaactaagtgagataagaaatagaaagaactcaattcctatacttttaatatacactcaaactttactctacatttgctagtatattatcatgtggtcaataccccataacagtgtcctcctgttgtttcgaga

SEQ ID NO: 41880 - DNA, 844 bp, Oryza sativa
caaagtcagtggcaaatcgtagacgtgcgacaaagtcagtggcatatcatggattatctcaatttgaatttggtaacacggtgtaaccatccaagtaaaatgcagaaaaactcaatattaaattccaattccaaatgtccacgtatacaggccatatttgacaatacaagcacacagtcaaatatacagaatcaaattaaatgtccaaattatacagtcccattacaattacacagtccatttataaatgtacaatccatcgtaagtccaaattaaatacagagccaggataaatgtcccatttaacagttcaattacaattctaccgtccatgtacatgttcgaatacatatatcacccctattccaatccatgcaaattacaaaagctcctattacacttgggccattcctctctcttccaacccagcccattcctcacagcaagtctatgtttacgccctctacatgccagcccactccctctcttcttctcagcccaaaagtttactttgcgtccctcagccaacacagcatgcatgcacagtaggtgttcgatgaatgcttacaagccggcacacacattcgagtgagggtgttgctgccatcaagtgcctgggacccctcccaacaacattccaacaaccatccatgcacccctgctcccagcccatcaaaaacatccccagaacacaagccaacacatgcaacagtgagaagagagtccacatcgaatgaagaaccgagttcacagggatatgcccaccaaaggaagttgcatggcttgcctccagcagtcttagggatggcaacgggttgggtcgggcacgggcagagcgaaacca

SEQ ID NO: 41881 - DNA, 377 bp, Oryza sativa
ctctgcaacattaccaggaaaatgtattagtctaaacgggccaagttacatatattgtatttcacgttttaacatatatatatataatcatatatgtatgctaagtttaataatcgtttaattatctcgttcgtacacgtttcgctcgcgttcgttctcacacttttagtacaagtgcattcacgttcgtaagcgttccgttcacgttcgttcgcgttcgttaacgtttcgttcacgttcgttcacgttcgttcgcgttcgttcacgttcgttaagcgttcgttcacgttcgttcgcgtttggtcatgtttcaatcacgttcgttcacgttcggcgatgtcggggcgcgcggcagtggcgtcggcggaccggtggca

SEQ ID NO: 41882 - DNA, 470 bp, Oryza sativa
tcccaagaggttggagtataacgccaacctccctggatctagactggatcggggccgatgccagagctcgcctagatctccgagtgggagatgttttggctgtgaagacggcggccaagtcgtcaggaagtttcatcaagattgagggataggacccatcgtcttgatcggatcgtggaggaacagattggatctcatccgagtggcttgaaaccaactcaggagagatgatcttggagtaggcctcggccgagttcggaataccaaacggcacggggacctggtttctccccgactggtttgaatccgagtcaaggagagagatcttgccgaagtcgttggtgatgaagtcgaagctgccgaatcggaacgcctgcccgggagggaaggcgaagtcgtcgatgccagaaacgaaacccatcgtacttagtcggcgagaacttgacgcctcccctacctggcgagccaac

SEQ ID NO: 41883 - DNA, 284 bp, Oryza sativa
attcctgcaccccctatataaggagggtccgtatgcctcttggggcacgattcttttttctcccaatcatacaatcaataacacactcggcggaatcatccccggacaggagtagggtattacttctttaataagaaggcttgaacctgtataaaattcattgtctccaaacccatccactttcctagcttgatagccacccccttttattattgccgaaatcttgtttcgatagttggctcgccaggtaggggaggcgtcaagttctcgccgactaagtacga

SEQ ID NO: 41884 - DNA, 546 bp, Oryza sativa
agcgtaatattaaaactctaataatcttatattaaaattgtaataatcatatatgctaagtctaacaattttatattaaatcgctactaatcttatattaaaattgtaataatcatatatatatatatatatatatatatatatatatatatatatatatatatatatatatatatgctaagtctaacaatcttatattaaatctctaataatataataatcttatattaaaactctaataatctaataatcttatattaaaactgtaataatcttatattaaatctctaacaaacacttctttacatcacttgcctgcgcgaattcctttgatggctagctaccacttcggcttgagggacgacgacgacgtcttctctgcaacattaccaggaaaatgtattagtctaaacgggccaagttacatatattgtatttcacgttttaacatatatatatataatcatatatgtatgctaagtttaataatcgtttaattatctcgttcgtacacgtttcgctcgcgttcgttctcacacttttagt

SEQ ID NO: 41885 - DNA, 170 bp, Oryza sativa
gtggccgggcgcatcggcacgggcggcggcggccgggcgtgtcgcggggcggtggcttggcgcggcgccgggagagaagcggtgggggacggaggagactgccgcagttggggagaggaggatggcagcggtgtggaggaggatgccgaggtggagagattggtgcggga

SEQ ID NO: 41886 - DNA, 1197 bp, Oryza sativa
gttttgttctctgtttcagtagtcttatagcctgtttgcaatgtttgctttgtatgtcgctagattccgatccctccgacgctccggtgtacttcgagatagtcgccgaggtccctccagcagcagagcaaggcaagtcatgcctgtcacttgaacatgttgatcctatattgcaaatgctctactgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggagtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcaga

SEQ ID NO: 41887 - DNA, 323 bp, Oryza sativa
ccaaatggcaataagtccaaagcataagagcaaataggagcaaatatccaatatgcaaaagaagcacccatggtgcactatctcaagccacattagagaagtctatgacatttaactcattactcaacttgcaaaagcgggttttatcaagaggcttggtaaaaatgtcggctagttgatccttggttcttatgtggctaatgactatgtcacacttggtaacatggtctcttaggaagtgatggcgaatgtcaatatgcttggttctagaatgttgaaccgggttattggctatttttataacactatcattatcacatagg

SEQ ID NO: 41888 - DNA, 368 bp, Oryza sativa
  unsure (1)..(368): unsure at all n locations
ggttaagggtagtttccccctttgtttcaatctttatgaaatagacctacaccttgatattcatgttccaatcttgggcaactttgtcctagcaatttttttagaatcatttgtgtggattgtggaaggattcggttgtgctactgtcagtggcggtctgaccggccaagagcttgcggtctgaccggccgaggaccgtcggtctgaccggccgtgagccgttggtctgaccgacttggggcttgcggtttgaccggccttggctttcggtttgaccgcccctgacagacagcactcctccttctcccacttcaatatgtggcttctaaaattgttgcttatccatcctttgctccttgtttttcagn

SEQ ID NO: 41889 - DNA, 881 bp, Oryza sativa
tttgagtgcaatatatgagagaaagaatacttggactaaatattaaagcactcaaataggaggggaaataaatgatatgattactcgcaaaatatatttttgggaataaggaaggaaaatacttagaggcaaaaaaaaaaggatttgaatccttaaattggtagtatgaatatttggggaattatttgtggctaatagggaatttagattttggatgagaacgatgaattaaaatctattttcttagcacaagagcaatcattccaaaatttgtaataatactattcttgtgccggggaggttgaagccatagggattaaattggaggctcgatcgaaaaaggaatttgactattggaatatctacagaaggattggtaacatgtcaggatagagaagaattagagataagactagatcaaaggtttggtcaaggattaattccaatgaaattagaatcatggttgttggtatttcttaatgatattactagaaatataattcccagcaatagcgtagaaacactcttcgtatattatggttacagactttatctgcaagcgcacggatataacattgtagcatttcacccgagagtatttgtaacgccccgattttcgttcgggaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccatgaattttcggagctcgagaaatagttttaatagcacaaagatcattgcatcaattaaaataaaaagaaaacaattaaaatcccccttcctctc

SEQ ID NO: 41890 - DNA, 365 bp, Oryza sativa
agaggagacaatttgcgaatagggttttcagaaaacttgtccttagggtttgaccatttggctcaacctacagtcaagttgcctctgataccactttgtcacgcccagaaatttagtccaaatttctagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggaaaagggcgatcctagcggggcttcagctccactccacaggcaaaactcaactggggtctgagccttggtcctctaactccatcttcagc

SEQ ID NO: 41891 - DNA, 1501 bp, Oryza sativa
taggaaattccacataaagaaattctcatttagctcctgatcttactaactcttaactgactatcccatcagtaataactgctggcatgactgtccttcttctgacctgacttcggtgtcatccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttgcctctgggattgggggtgacttagctgtgctggtctgctaaagacttggtggcgtactgtctgaggttgcaggtgcttgctcttggaaaacaaactgactttcgctctgatcctgattccggcttgcatctgagcttgtacttgttgttggagacattgtcgttgcatctgctgctttggactctgcggttgctacatcaatatctggcacatccatcttccaatcttggctaaccagagcgaggtgctctgacttagctggtagcttgttgtcttgaactgatccactgactctgactgcaacacactactgctggagttatttccgctacatttgactaggtgtccaacctgcatctcccacatcgatacacccatcctctgatcttggacaccaaaagttgatcatgagcaggtttcatctggcattggggcaccttgcagctttcaactaacccttgatctgtggcttaaattgatcttatctctcacactgaccatctgctgccaggacgaaagagaggtggaagaaaggggtcgctaaagataaggtactaaaccacttgcctactgatatgttgttaatagatttttattgttcaagttgcttaagcaaacaacctagtatagtcgcatccccaccaatgatgcaaaccatacccctacacacaagcaaacaacacacgatctagaatctaacgaactactcttccgggaaggattaggtttaggtgaacttcgggaaaactcttcttgatcttcgcggaacgatgactctgaactaatcttcccgctccttgcacgaagcttgagactcgacttgacttctggacgggcatgaagctggcggtttctcctacatgtttgacaactaaaagagttggagggacagggaggaaaaattttaataaactgtttcgcaaagaaatgccgaagggcgagaggagacaatttgcgaatagggttttcagaaaacttgtccttagggtttgaccatttggctcaacctacagtcaagttgcctctgataccactttgtcacgcccagaaatttagtccaaatttctagactattttgtgtattaaatccctgtccaggaccagccagggtacacaaaacgacaagtaatatacagttccaaacgtaaataaagcgtaaaatacttacaaaagaggcacttagtcctcgc

SEQ ID NO: 41892 - DNA, 159 bp, Oryza sativa
ccaaataccctcagggaaattctgacgacgatgacatcatagcaactcagtcaaatggtaccatagcaattaagcatttgttatggtaatgacaaagataatctcgaataaacaattgttactaatatagtactaaatacgatgagcattgcgaagaca

SEQ ID NO: 41893 - DNA, 304 bp, Oryza sativa
  unsure (1)..(304): unsure at all n locations
ggtgggcacttatggcaattatggtagttatgacctgttccatgncgggttccacgtaatttgtgggccctccaatccgtgtgcttgcgtttgatgggcaaaaggtgtgtttcctcgtatgacaggtgtgttttctccttaaaatacctgcatacacatatttcaccaacactagtggaattgattagtaataatccctatcactaagttggataccatgttttatttcattatatgcaggtattgacggtcaaatattatgatttaaggaccgtcaacaaagattgataaatatacctcaagg

SEQ ID NO: 41894 - DNA, 432 bp, Oryza sativa
  unsure (1)..(432): unsure at all n locations
gcggatgaactctgtanccataatataccaggagtatttttgcgccattgctgggaatgatatttctagtaatgtcgttaccaaataccaacaataccctccaaccatcatagggagtgaatctccaccgttccctcaaagccctggatccaacggagctgttcctggcaggcttcctccttgacctcttctatcttcagacttgtgaattttggcccaattcgatcgtgtcaattcttagttcttggcccgtctttccataagtccgattctcgacatcgttcgattgattgatcgtctattttgatgtcggttctcctccatcttatgcttattttctgcaagaggttagtaatcctagtgctagtggaatatatattattttaacaagaagatgcattgcaaacataactagttctcctttatttcagt

SEQ ID NO: 41895 - DNA, 294 bp, Oryza sativa
catgggtgtactcggaagacccagccgagtcctctagctccggcgacctcatggttcagagccatggccggcgatgatgtcatcgtgacatcataaatcttttttttagtttttctgtattagatgaaatctgattaaacttcagaaattcataactaaatcatcataactcggattcaagtggttcaaattgctaaattcatgtaaaatcgatatccacatgttaaaaatatccacatgtactgtttatgcttgttttttactgttttgttgattttatttatttgctttagt

SEQ ID NO: 41896 - DNA, 925 bp, Oryza sativa
acacagaagtcactcataaatcatgatatccgagataaacaaactgtgagtctgattagtcatcaacaacatcttccatatttagacatgttacaaaggcgattatgatcctactaagaatttgttgcaggtaggcttgtgtcttctttttgacaactattcgaatttcagaaagccatacataagtcagaacaactatattttcttgaatatatagtttttgcagtacaagtgtaatttaatgtaatttactccattttacatgtaggacagtgggaactaaaatgataaaatttgtactgctcttgctaaaaacataaaacaatatgcactttacttcatttgacaaatttcaaaggacataaaagctagagggtgagctatcaattatcaaccatcagatacccaatatgaatctaggtatagcttctagtatttaattataattaaaaatatagcttctaggtatttaattatttgcacaaattatttaccttgccaaaagcaactgttgattgggattatttgttcctggtcctgttgggctccatctaatagtgtatatttcctgcaaaatataattaagcatatgatagacagtagaacaggttctagggatcataaaaaatgagggtagatttctcaaaccttagtatgctccttaaaatcataaacacatttatcctgcttcatactccatatctgcaaaaaaaaagaaggcaacaaaagtgggaaaaggcttcacaatggacgatatagcaccagcacttcccaaggattgtaactgcaaacccatagcgttgtttaaaggagtaagttcattggccccctcaactatcggtttcatcaaattgtttttgacacattatcaactccacattactggtttttgttgttttatcaaaaaatcatctccaaggaagaa

SEQ ID NO: 41897 - DNA, 265 bp, Oryza sativa
atagggagtggcttctgatgcactggaacattaggtcaacctgggattgactttccaaccacatatcgagttcatcatagaatagtcatgactcatgtattgagaccacctactaggaagaataactgtgcaggctgaagtcctaatcctccaatctgcaccttcatacaactgcatggtggttcagaaccacatactgtccaaggatatcctactgtttgagaacctgctgaagcaaatagcaatgttgcaaagaggtgcaaca

SEQ ID NO: 41898 - DNA, 485 bp, Oryza sativa
atatgaatgcaagaatgatacattgatggtttataatgagaagtgcctggaactaatgaaagagttttggctggttactttgaagcatgtatctcgagaacaaaatcttgaagctaatgatttggcccaaggggcatcggggtataagccgatgatcaaagatgttaaagttgagattgcagcaatgtcagccgatgattggaggtatgatgtgcatcagtatttgagtaatccatctcaatcggcttctaggaaattacgatataaggcattgaactatacactgttggatgatgagctttattatcggacgattgatggggtattacttaagtgcttgagtgccgatcaggccaaggttgcaatcggtgaagttcatgaagggatctgtggtactcatcaatcggctcacaagatgaagtggttgcttcggcgtgcagggtacttttggccgacaatgctggaagatttattcagatattata

SEQ ID NO: 41899 - DNA, 242 bp, Oryza sativa
tttagaagcctatatctcctaaaccgtagatccgattccagtgaaatttggacctaaattcatataaattcaaactattcattttgatatcaaatttgctattttaagattttatttgaatttctttaatttattcaaatgccatttgaataaaatttgatttaatcttttaattgaatttacaacttaaacttatatttgctttccaaatattttcttttatttccaaaataccctgtagc

SEQ ID NO: 41900 - DNA, 1501 bp, Oryza sativa
agagtttattgtcttttggatggcaacctatggtatttcgagaatcggataatcaggttgcctatctcgtatttatttgcgttggagcaaggcaagttattattcctcccctttgagcataattatcctatattctacattctattctatgcattagccattcatgattttgaatgcataatctgaacatatagcaaaccagttatatgctagcttttgcttagccctgcctagttagactgcataaaaatacaatgaacttagattgggacagtacgcaggaattggttgatttccgggtggctagtactgtcttggtcgatataagtttaccaagtacttatgtcaaacgaacgagtacgaccgcagcttctagaatggggacagacctagacttactagtagtaagtgggaccttcaaacggctctgttgttctcagcctagctagctgtgggcatcgtgcggttaaaactggacagtctctgcagaggtgaattaaatcattcgaatgtgccgtactcccggttctggagttgtgtcatcagggtgattcctactcctgaagtataagtatttttaaaattaaaatgttgaggataaagatgatttatggtttttattattcctttactttattattgttttatttattcatatctcttcacatttaattatttataatatgtcttgctgagtacataagtactcacccttgcataatttgacatatagagaaaacatgctaacaaggagattagaaggaagcgagatctacggcatcgacaagtttgtctagactagtctacactcgagcttttgcctatggagttctttgaattctttgcagtttattggctgtagttttagtagttgaagagcttaggagtttagtagtttagtactatggattttcttgtatttcaaataaggatatattagtttggatcttttcaccttttaacaattgtataattagcttgtataaccaaatttgtataattaatcgaaagctgttctgtatatcaatttgtacgtgatcgaaatcctagacgatcacgagtggattttcggggcaccaagcctaaattgggtgtcccacattgatcgatatgttaaatctgccctttacattaagattttgttgcatttaagtatattgggcttctgtttggtatattctacttgctttaacatctttatataaagtagtatcggagtattaaccgatacatgctagatctatctgatcggctatgctatgaatatattaaatgatttttaatcccgaacgaaaatcggggcgttacactgggagatctacttaactccagtgcaggtccaaggatagcctcgagtgtgtcaaaggcgtgccagctgatttgatcatgcaatcaacaagaaagacaaaagcataattagtcagtcgatggccgatagcgtatcattggtggtctcagccgatgtagttagaccaaatcggctatggacgggatagatcag

SEQ ID NO: 41901 - DNA, 1501 bp, Oryza sativa
tggaatccattcccgaacacctcgaaccaataccctttcaattcccattcaaccatctcttgagcacataaaatatcaatctctctagagcttaccatactaccaccaaatccatttttatcttccatcaaatacttcccctttgatctctacccgaacacatgaaataccaattcttattttttcccccagaaccaatacctttcctttggatctccacctaaatattcccatagtccataaaatatccttttcaattcccctttgagtcaacatacccatcctttagagtttatcaacataccaccaatttcgttcctataaagattcccatccacatatacttccgaatccagttctatactcccacaaatatttcccctttgaaatctcgttcatctaaattatccattcaagatttcaaagtctactatttagcttaggccaatatttccccgattgacccgattctctgttatatcctaataaccatttttatctttggggctaaaccagtataactccctttccgttggaatttattttggatcaacccctatctaaacctatccccaaaaacatttgtctccttttaatcggtccaaaatatcccgtggttaagttcctattttgatccatgcaccaattcgattcctataacttgatcacattcttggcacaaagaataatattatcacaaatatttgaatgattgctcttgtgctaagaaacttatttccaatcccttctactcaaaatccaacttcctttagccacaaataattcaccgagaatccataccacatattttggaggctaaaatcctagttatttacctccatctatttttgccaccatcccaaatttatccaaagttagaaattaaattatttcctttccttcccatttgattaatttaatttttaaagaaaaatctttgtgataagttttatatttggttcttattgaattcttttaaaattggagcatcttaatgtttatccttttcaaattatatctcaaaaaataatatctggattttattttataagtattttaactcctttcttttgaactttttcaaaaccctttattatttcaaatccttttataaagtttaagagacccttaaacattcctcttttaaattttatctcctttaaaatttattaatttatttaaaaccctgcctttcaaaattcctctagtttaaaattcctttaactctatttaaattccttgtccaaagttcaaaaggttcacaaatatcttcctttagaattttttcccctttgaattctagtcaaattcaaaaagtccacaaacattcttcttatagatttcatctcctttaaattccatttaaaatcctctacacaaaaattcccaaaggttcctattcaaatcgggccgaaattcctttttcttctcccctcggcccatctccctcctcagcccaagccgacccagccccagctaagccggctcctttctcttctct

SEQ ID NO: 41902 - DNA, 1501 bp, Oryza sativa
gtaggaccgaattgatgaccaaatttatcggtctcggtctgccacccctattgggcagagtgggcgagctcctcgggcccaccttctcattggttttacaatttaaggacgattttgtaatttggtgacaagacgagggacttcgggtgtactacccttattattatgggacaattgctcgtttgaccctattctgaactataactactaatttgaccctactttttaaagtttgcttatttgaccctgcttttcaaaattggagttgccgtttggccctggtttcatcacaccgttagggtttcatttagaaaatagaaaaaaatgttttttttatgccacaatggatggagtgttctacggggagggagggagcgccggcggtggcgtcgtacgaaggaagggagcgccggcgcacggagcagcggagccggtgggcggagagaggagtggtggcctccgccgcccctcggcaactacctccgccgccactgccgagccgacgccgacgccgcccctccgcaaccgccgtcgccggtggtcttcctcgtgccgagccgacgccaccgccggtggacttcctcatcaccaagccgcagccgccaccgccgctcatctgccgccagcagcggccctcctcgtcgccgagccgacgctgcccctccattgccgctcctcccgccgcccctggttgccgctcctcggccacgcggtgacctattgcttgactttttttctttttttttgtttttggtagacataattttgcaccatgtatttttgtgtttgaggcaatatatactgataagtgtaataaaaaactttgagaaacatggttaaattcataagggtataaatgaaacttttgtcttgagttaacaccgtcatcttgccttcacggaatagggccaagttccatcttcgtttaaaaaaagagggttaaatgagcaaacttgaaaaaacagggtgaaattagagttagtcaaattagtagttagtcttcgaaatatggccaaaaacgcaattgcccctattattatcggctctagccagccaactatgtggcccgtaacaccatctcattcggcccaaaccaatctgggccgtcacatttatggatgtcagccggcccaacaaacctttgaccaacctgggccgtcacatttccgcacaccccctcggaagatctcccattcgccatttcccatccctcccagagccctcctcacccgtccgatcacgcggccgcggcaaccacagccgtccgatccacaccccgagccgcgcccgaaaccctaaccctaaaacctcccgcctcccccataaatccccttctccctcctcgccgccgcctcttcctctctctctcccctctcgatctcgtcttctctctctcgcaggactcgatcgcggtaagctcccgaaccctagctcgatccagcgactgctcggccgtgcggatctctgagcggtgtgtgtgtgtgtgcagatggcggcggag

SEQ ID NO: 41903 - DNA, 1501 bp, Oryza sativa
aatactctggacgatttcagcgtagtgactgtgaaaatgatgccggtggtggaggacgctgaactttcatattaccttcccttggaatccttgattaggtggaatccattgaagtgaaccaccagcggttaacagaattgaaccaccagaaaccgggggatcatttctgaaggctgtccacaagatgaacctggatggatcagtgacaagccacacaccaatggagaatccctccccttcgggatagaagccaaacgcaaagcgccctgagggggagacccaactttgggggccagctgtgttgatttcagaaccttgaggaatggttgtctcattgatctgagctcccatggaatgactagcttggatgatgaagagaatcaggcacagagggataatacaagggaacattgtttggccagaggaggttcttcctttgggctctgcaaaatgaactgcttggttctcatgtaaggaaataaattcaggacacaaaaacctcctattatgtgcacatgaattaaaacacaacatcagggataatcacaactcacaagaacgttgacctggacctggacttgggaaagggaaagtactaagttagtcaactactgatgtaaagtgaaagtaatcttgattttttttttctgggcgtagccgtaccataatggtatggaagcaacatgtcagtacaaggaagtccccaattttccagggtgacaaataacacattggacaagtcatgcaattaattgcgcaggaaggtctgggggcaaaaaattgaaccgaatgatggcaatgtatcagaaaatgacatcctaaccaatcaaagcacagaggaaatagaacaatcaaatatgcagtttctcaatttattacaatattttttcaaaactgttgctctttgagtgtgctatatatggcgacactatattactagttagggcgaattgcagcgatgaagattaaatgtcacatgtttgcacccatttaaaacagaaacacatgatcattccacactagacaaatacaacatgataatttgattggctcacataataattattttttcaaaaattgttttaatattaaaaagcactttactgatctctctgtagtcaaagaccatggcagttggagtaaatattggcgcaactgcgatgtgctacactacaccccaagcaggaatgtttctattgctaaagtcaagtgaaattgtagtgcattattgaaggccaggctccagctatagtgaaaccagagatatatagctaacggtagcagattgtcttgaacacagaactgcttaaaactttatgaatctatctagtcttttcaaatctactagcagctcatattttgttccctaaccattgctcaaattttgttgcgctgttgctgacaatcctcagcatcatctggattgtgacacaggtttgctatccttatgttttttcatggaaatataggtgaactaggtcatttacatatgcaggggtac

SEQ ID NO: 41904 - DNA, 1501 bp, Oryza sativa
attcttgagtgtacgggtgaaaagtagattttaagaagagtccaagagaaggaaaatgaaaagatgtagtattactgaaatgcccaactcaggggtagcttgtccaacagtccaaacctcactcgaaatttgaaatgcccaactctgtttctcgaaagagcatggttgagcccaaaacacattgaagtgagcagacgatcgatttgaacaaatatttaaagtgcacgctactatgacttttccttagatactcctagttcatactactatgaaaattttccggtcttctcgagtacctaacatttcagatcgtatctatttggcaaaacaaaagaggaaaatatcatatgtacgtctaagtatgcagtcttgttttcgattaattaacactacttaaaaaaggtttttatatgcggctaaatttatttttcacagaaaattcacgctataatgtctaaacaaggcttgtgaaaataaataatttaaggtggttataggcggccaactctaagagacctacccgtgaaaattggatttcacaaactgcccaaattagttttcctaggcggtcctctaaagtgaaccatttcttcaaatgtttttgacggaaagaaaaaaagaatattaagatccaatcataatatgcaatttcccaaacttcttataagtaattgtaggcacaatcacaaattcccaaaactaaaaaaaaaaattgcaagttctccaaaatccaagaactcacaaattcctcaagcatatgagcaagcggatggtaataggtcttgcccgagactttggtggcctatggagctaccgttgacaccctaaccgacctttattgacgccatcaagtcatttttgtcgacggcacgcaagccacgaccctcaccaaggtcttaattgtcaccaatccatagtcctgatcgtatatttattttgcgacggaatgactagtactaaccaaacaaccccaataccaatttgagcacatacaagaaacaataatccttcgggaaaacattaaaaaaaagaagaaaaaaaagggggcaaaactgcccagccgtgaactgggcctggaggacgtgaactggactcatggtaatcttatctcatggcccaccttatatggaaggctcgatctcgcttcccgtcgtgccgcccctctcctcccgacttctctccccgatggcggcgcttccccacgtccggcgacaagcagccagctgcagatgcgccatctctgctccatcggccatactctccacggcatcggcaacggcggcggtcgggcggcgccaagcttcagctcgggccagatcaacggcgccctcgccgccgggcctccatggagagcaggtaggcctcgtctctactcctaacttggtctgcgcgacgcgctgaatccatcccgcaattagttttgtcccacctcgctcattttgcgacagagcgacctctttttaaactctgattgattctattgtgttgcctccccggagac

SEQ ID NO: 41905 - DNA, 1501 bp, Oryza sativa
gaaagaaaaaaagaatattaagatccaatcataatatgcaatttcccaaacttcttataagtaattgtaggcacaatcacaaattcccaaaactaaaaaaaaaaattgcaagttctccaaaatccaagaactcacaaattcctcaagcatatgagcaagcggatggtaataggtcttgcccgagactttggtggcctatggagctaccgttgacaccctaaccgacctttattgacgccatcaagtcatttttgtcgacggcacgcaagccacgaccctcaccaaggtcttaattgtcaccaatccatagtcctgatcgtatatttattttgcgacggaatgactagtactaaccaaacaaccccaataccaatttgagcacatacaagaaacaataatccttcgggaaaacattaaaaaaaagaagaaaaaaaagggggcaaaactgcccagccgtgaactgggcctggaggacgtgaactggactcatggtaatcttatctcatggcccaccttatatggaaggctcgatctcgcttcccgtcgtgccgcccctctcctcccgacttctctccccgatggcggcgcttccccacgtccggcgacaagcagccagctgcagatgcgccatctctgctccatcggccatactctccacggcatcggcaacggcggcggtcgggcggcgccaagcttcagctcgggccagatcaacggcgccctcgccgccgggcctccatggagagcaggtaggcctcgtctctactcctaacttggtctgcgcgacgcgctgaatccatcccgcaattagttttgtcccacctcgctcattttgcgacagagcgacctctttttaaactctgattgattctattgtgttgcctccccggagacacccacaccgactagatacagcggtaagatccccactgtggccacggtttggcggacaccttctgctgtaaaaaaataaaaatggagcagtcataaggtcccctcccgttacggggcacggcaggcgcctaccggttaggctgcatccatcatacacgttaagatgtcaaatacggcatacatacagtcgggtctctcggtggagacagcgctagacattagcgctttgccttttttgaaattttgtatcatcaaattattatttttctgttgattaatcacgatagcagcaatggaggcctgcatttgaaccccctctgcgtttcaattccaatttcctttgcatttgtatttgaataccatatttaccagcttaaattatctatggtatagactacggaatgtgtatagcaaactggaaaaattagagatgtggcgatagaggagagcctatcatcagcaggtatgcaaagaatttcctgtgaaacgaagtactgaaatactcttagcagaggtgattttttttaagccagagatgtgaatgatttgttcacgctgcaagacaatggaaataatgattgaagtgaaacatcaatcaaatattttc

SEQ ID NO: 41906 - DNA, 1501 bp, Oryza sativa
aagccgtagcggtatagtttctcacccacggatgcggaccacaaacagaagtttggcctcagggctgacgtagaacccacccttcatccgagcctcacgcttgagctgcacaagctccttctcctgcaaagaacacaatcgtcacaataaattcaaaaagataatgatcatttcagaaaggaactatcccttgaacaatgccaacgaacagattaactacacttcaaaagcaaaaaaaaaaacataatccaatcgcccaccagattaagtgtgttggcattaaaacaaattcatgggataattagaccatttaatcataccagctctcagcaaaacagattaattagaacatgactacaccgttggtttttaaatctaacgcaagttgctaattactggcatctagctaaaagaaactgaaatcttgaattaaacgggttcagcatccaccacggacacctgcagacgcgcattagacgcttctaaacaatcaatcgtcacaggagaaaacaattctcatattttttagcggacttcacgatgcgtcgatgcgcaacgcaaatctaaacgaaccattcctagacgccacagggttccgcgaatcaacgggcagcggggaggttgctctgctcacctgcgcgtcgtactcctgggcgtactgcttggcgcgggcgaagatgagcttgcggctctcgacggccttcttcttctcggcgagcgccttctccttcctgtccgccgcccactgctcctcccgcttccgcttcttcagcaccgactccggcaccaccgccgccttcgccacctccgccgccatctgcacacacacacacaccgctcagagatccgcacggccgagcagtcgctggatcgagctagggttcgggagcttaccgcgatcgagtcctgcgagagagagaagacgagatcgagaggggagagagagaggaagaggcggcggcgaggagggagaaggggatttatgggggaggcgggaggttttagggttagggtttcgggcgcggctcggggtgtggatcggacggctgtggttgccgcggccgcgtgatcggacgggtgaggagggctctgggagggatgggaaatggcgaatgggagatcttccgagggggtgtgcggaaatgtgacggcccaggttggtcaaaggtttgttgggccggctgacatccataaatgtgacggcccagattggtttgggccgaatgagatggtgttacgggccacatagttggctggctagagccgataataataggggcaattgcgtttttggccatatttcgaagactaactactaatttgactaactctaatttcaccctgttttttcaagtttgctcatttaaccctctttttttaaacgaagatggaacttggccctattccgtgaaggcaagatgacggtgttaactcaagacaaaagtttcatttatacccttatgaatttaaccatgtttctcaaagttttttattacactta

SEQ ID NO: 41907 - DNA, 251 bp, Oryza sativa
tttcttttttcatcgtcctccggcacagtttctgtcaacagttcggcacagttgtcagttacgaagccggtaggggataaccagaccaggttttaggcattagaaagtgagacagagcacggagggtgagaaagtttagtcatatggcccgcccaaccggcctacaattatatatagccaaagtgcacggccaaacgtcccgttggtcgctccctctcctcctgtctcctcccgacgtccgcctatggagc

SEQ ID NO: 41908 - DNA, 1501 bp, Oryza sativa
tagtcttagaaaacacatctccacacccctgtgaagtctaatataataaaaatcactttacaaaagtattttataacactacctaagactatactactataaaccgataaaacttctaaaattcataactccctaatggaataagataaaataaaatttctttcacctaaattcattttagaccagtacctaatcactgtgcattaatcatgcattttagaacattttggattttcagctcttttggtgtttaattgcataacgtgcgtgtcctttatctagataattgcataatcggtgaaggagtggattaggtgctaacatttctctgatcaaggcaagttttctcctcccatactttgaacacattgaatcccatgatttgaggaatgaaaatatttgtttgcaaagttgcatgtgaacttagactatatcggtatttgaaattgggttaaggtagttatgacctatttgctgcatatcccaccttgaataatggatcctcttgctgtttgaacccctagaaatggttagagtacactctttatgctcaaatgggtttatatatgctctttgtgcaactacttgcttagccatgcttagaactatgcaaatgctcattccatctataattaaaatgtgattttgattcatgaacctttgcttgaataaaatgaatatgatgggtatttgtgaactaaaatgtgtaaaatgtgattttatacttgggcggcaagtggtgtgcatatggtgttagttgcataccgatagggggagtgtttgcccaagtccataaggaccgaacttgtgtcacccatttaaagttactaggtgaaaccccgcgcattgctgcgggaatttagtatgataacaataaaaaattaacatgtaagatagctagataatatcagattaagtaaattaatgtggtttatgataatttaaatttaaatagtatgtagaatggtgattcaaacgtaaaaagtaaggtggtatgactttatggaagaagaaaagtagggagataatttggaccgtagattaatcatctaaaggctaaaaacaattgatgtgatatgacttaattagaggaaaaaaaggagaaagataatttggaccatagattaatcatttaagcactaactaagtgaggatgaactatataagtatataggatatcataaaacataataaagatatacattgaaacattatgtgaattatgttggataataatttaatatgtttgtatttgaaaagctcttaaattataaaaactataaagatataagcatgtttgcatgatgtttaaatgtgatgattgttaatggaagatgatgtggcatctttgcatgttaagcttaaggagttagtgggggataactttatagtaagatatgattcgtacatccacatgtgctagtatgggatggcctaagctgattaatatatttaggactagccttgcattctggtaggccggtgtgtatgaattagtcga

SEQ ID NO: 41909 - DNA, 1501 bp, Oryza sativa
tagttaatctagccctagtatctcaatttagccctatcggctggttctcgttttagggttcctgctggtatcggctaaattgccttactagattagattaactaaggcatctaccatcttgaaaagctgttaattccttgattgcttagactttaggtttctctacttactttgagatgcatcatccctagtcttgtttagaaccctgaaaactaacctggaattaatcataattagagaaagtatcggagttttagccgatcttacctaatatacatgcttcttttctggttttatgtatatttgccacttatatagacagatcatcctatataatcgtatcaagtttgatcagtatcgtctcggctatttgaatttctaactgatcatgatttgatatgctcatatagattgatttgtttatataagtttgtactagagtattagctactactttatcgttatctacatattcagctctaaatatttttccattggctattttcataatattgtcttaaatcttctttcttaaacctaataggcagtgttacagccgatgaggcatgtttagggtcttttattccctgatctatcccgtccatagccgatttggtctaactacatcggctgagaccaccaatgatacgctatcggccatcgactgactaattatgcttttgtctttcttgttgattgcatgatcaaatcagctggcacgcctttgacacactcgaggctatccttggacctgcactggagttaagtagatctcccagtgtaacgccccgattttcgttcgggattaaaaatcatttaatatattcatagcatagccgatcagatagatctagcatgtatcggttaatactccgatactactttatataaagatgttaaagcaagtagaatataccaaacagaagcccaatatacttaaatgcaacaaaatcttaatgtaaagggcagatttaacatatcgatcaatgtgggacacccaatttaggcttggtgccccgaaaatccactcgtgatcgtctaggatttcgatcacgtacaaattgatatacagaacagctttcgattaattatacaaatttggttatacaagctaattatacaattgttaaaaggtgaaaagatccaaactaatatatccttatttgaaatacaagaaaatccatagtactaaactactaaactcctaagctcttcaactactaaaactacagccaataaactgcaaagaattcaaagaactccataggcaaaagctcgagtgtagactagtctagacaaacttgtcgatgccgtagatctcgcttccttctaatctccttgttagcatgttttctctatatgtcaaattatgcaagggtgagtacttatgtactcagcaagacatattataaataattaaatgtgaagagatatgaataaataaaacaataataaagtaaaggaataataaaaaccataaatcatctttatcctcaacatt

SEQ ID NO: 41910 - DNA, 1501 bp, Oryza sativa
gaatcgacaccgggggagctgaggtagccatccaattcttccgtcgaaaccgtcccgagaggttggagtatgacgccgacttccctggagctaggctggatcggagccgaagctggatcccgcctaggcctacggggagcggacgcccgtgtggtgaagacgacggctaagtcgtcggggagtttcatcaggattaagggataggccccatcgtcttgatcaggttgtgttggagtagattggatctcgtccgagtggtttggagccgacttggttgagatgatcttggagtagatctcagccgagttcgggataccgaacgggatggagacctggcctctccccgactggttcgaatccgagtcgaggagagaaatcttgccgaagtcgttggtgatgaagtcgaggctgccgaatcagaacgcctgcccgggtgggaagacgaagtcgtcgatgccggagacgaaacccatcgcactagtcggcgaagaacttgacgctacccctacctggcgcgccaactgtcgaaacaagatttcggcaatactaaaagggggtggctatcaagctagaaaagtggatgggtttagagaaggaattttatacaggttcaggccttcttaatcaagaagtaataccctactcctgtccggggattgatccgccgagtgtattattgatcgtatgatctgggaaaaaaatcgtacctcaagaggcacccggacccctccttatataggggaaggggtccgtattacaaagtacagcccatatccctaacggaataggtagttacagataaaatacaatcgtaaccaactaggataccggatatttccttgacatacaagtttgaaatttaacccgagtctctttaaagatattctatctacatatggcaccccatacccagtcggatatacatgccgtgtaggtatggggtatccataatctccacattcctgtatgcaatggaaaagcccactgatttatctgttgtgatgaaaatatactatggttttaactatattatatctataagactatatgtaatttctagctcattacagagagaagcctcagttcgaccttctccttagattgccaaaattatgatcccattgtacatgataagcagatctaacagtgaacataccagatgtactatgtcgcaattctacaccatcctcgctatttgtatgattcgattagcataaacgaccgaccaaaaaatctaggaaccatctcttcatcccactgaacatctaacaccaaaaaataggattgaacaattcacttagcatatgtttggtttggggatgggatgggatgggttggatccatccctattttttggaatggaatggttctggtttttgcttggttgaagggatgaaacgaaccctgtttttttgtttggtttgagggatatgatgggttggaatgatcctatattttgtttgaatggaggtatcaaaatgggttgtactactacaaaaca

SEQ ID NO: 41911 - DNA, 178 bp, Oryza sativa
aatgttactttaattactcaacagttttactgttttgctcaataaaatgttttacaaccgcctttatgcaaatagccacaaacccctccttgtatccccttgcacgtctgcatcgttggtgtggcttgctgagtacggtggttgtactcagtcttgctattattccccctttttcaga

SEQ ID NO: 41912 - DNA, 482 bp, Oryza sativa
atagtctcatttgcataaatagcatttaataaatatttcagaatttaataaaacagtcagagtattaaattaaacaatattaatccaacgctatacaacataccctgttgcataggcccaaccattctgaacaaccaacctcggctgcacagttctatctccaagccaggaatataccattccaaaccaggagttaaacaagttattaaacagcatcatttaatatggtaagaagtgtgagactaatcacgaaagacattgttagacccgaccataaccgcgggcacggctattcgaatagttttaactctagccagaggtgtaccactgtacccacaagacacaacctcaacatcatgtcaaccaagcgtcgcgatacttaacaagtacccgaatagagattgtgacaataccctctatataatacaatttaaagcagtgcaccgttcctggatcataatcacccccttataaacaaggca

SEQ ID NO: 41913 - DNA, 160 bp, Oryza sativa
tggggtgaatagaagctacatctgtttcatcaatcagccacgatgtatatgacagatctgtcccccgacgtcataccctaggtaaacattgttactatcaaattgcgtagtcaattaatcgatttattacttaaccaatcttttgctcctgctttgcaga

SEQ ID NO: 41914 - DNA, 1501 bp, Oryza sativa; identical to SEQ ID NO: 32027

SEQ ID NO: 41915 - DNA, 913 bp, Oryza sativa
tctaacgatatcgccatctaaactactatcggtcaatatctgtatgcagaaggcagccgattaggttagatcttgatgttgatctagattatataagatatctaccattctatgaaactgctagcggcttgattgtctagatatggttcttcttttcatacttaatgctgcatcagttgagtttgatctattaagtcgtgtttagaatatcgatctctggcctgccttctagttgccgataagaatagcatcggggtttcagccgatcgtatctgatttagccatatttattctacatgtctcatcgatatgctaaatctgcccttgctatcaagatattgctgcatctaaatatgttagggctttgtttgatatattatacctgctttaatatcctgatatgaggtagtatcggagtattagccgatacacgctagatctatctgatcggctacgctataaacatatataatcctgttattgatatatatttcgatctaagtgatttatactgtctcagcatggtgtccgatctatgccaatcactcgatttaagtatataccaatataaggagtatatatcgttaacatctacagccgatcgagtagatttagtgtttatttacttattcatgactgccgatcgatacacagatgacatcggcccaaagataaatgatatgtcatcggcatctagccgatcggctatcatttatagatttaaccacggtttcgttgcttttatttcttgttgattacagaatcaaatcaactggcacgctaatacatccgaaggcgagttttggacctgcactggagttaagcagatctcccaggccacgtgttttctgtcaacacgcttttggcacgcccagtgggacttgattagaagtcagacgtcagttcttcctca

SEQ ID NO: 41916 - DNA, 1501 bp, Oryza sativa
tattctgtgcaagtaatcactagtatgtaaatggactagagtaatacatcctgaagctaacataatctagtaaaaaatagaacttcattgaccaatacaaaatatataaatagtgatttcttcttgtgcaaattaatacattgcttgcagcaggactaagaagaaaaaaaagtattccctttgttcttttgtagtgatactccagacattctacagtctctagacaagatagaacattagtttccttatattagagtcgacaactaaatactatattagtattttccaagacaaatctaactgtggttctcttctcagtggccaatctaaatagtaaatacttctacatctttcaatgttcaaaattaagaaaaaaagaatggaccacaacacaaggcttctaaaaggtcatctcgcagaaacaggtattgaatgaaaaaaaatagtgtcactctctgaaacgagccagtaaattacttatttgatatgtcggatgaattaatctgttctgcagtcaaatgctgaaaacacacctaattttactgcattgtaaaaacataagtacctgcaacataagtacttgcgtagggatgaagcgaggacataatattggtttcccaaagcttcctggactgcagtgaatcaatttgtagcatgaagacactggaatcagcacatagaagcatcaccttaacatcctcagcataacccaatctcactaaatgacttgtcttgaccccagagcccagttcaagaaccttgtttagctcagctgtcctctgcagcacccatctggtaacaccttcagaacagaccttcctctcccatatttgaaggctgtcgtacgacagagtgacaaggccaagataaccaccttctgccagaaagatctgagacatgtagtggctataacaatttggattggaaggccactcaatcacagcaagggtttgcctatccaaatcaaactgaagaatggcactgccaagaccagtggggaaccaatacagggaatggccaacgagtatgccaggatcaacaaaagcaaagaccaagaatggagcaggagtgaagatgagattgctccatctgccggtctccgatgtgtagaagcaagcgaacatttgtgtgttgttgctggccacgcccaccaaggcaacattgaaggggcaacagctgaatccgccgtgaacgtggccgtcgtcgtcggcggcggcacagagcgccgcctcgttccagacgatcttctccttgccgtctatctccggcggaatgcccacccggcggtggtcgccggtgtcggggtcccagaggacgatctcgttctgcttccggtccaggaggaggacgcggccatggcggcatccgcagaacatccgctctttgcggacctcgtcctcgccgagccgcatcgagaagcgctcccttgggatgagatcccgcggatccatcacggaccggaagaaggggaagccgaagtcgtcggcaaagacgccgatga

SEQ ID NO: 41917 - DNA, 328 bp, Oryza sativa
ttgactacatctcggcagaacacaccacataccatgtcttatacggaaaccgacctcagatatggatggagttccgaataaggaaagacaactagagttctacatggaaacgacaaggactactcagattatatccatataggtttccctagttctacttggacaaggggacacctatgggtagggataaaagtggtacggataatttccgagttccgatcctgtttttcggatgcggattgttgcggtcggattttttcagatattttcggattcggatacgaattcggatagtttttctcggatacgaattcaaatacagtagcga

SEQ ID NO: 41918 - DNA, 1501 bp, Oryza sativa
tctaacaaactctaagataccataagtctttacggcagacttttgtctataaggaatttacataaaatatcctaattaatagatacaattgccttcccaggactctatccatgcgtggcaatcatcttgaagtacattaacttgaacccgatgtcgcgtacaagtcgtattgtcggaatcggctacatcgacttacccaacacgactcagacccagccgatcttatcgtagccgatctggatttcagccgattcctgctctgctttcaaacccgatttcctcttccgactttgcttcaatctactcttctctcccgacgctgatgttacccaaattcggttgttaacaggaacgcacacgtggaaggccaggatcaaaggcgccggtggtggttcggccaaaccttgggccccacctcctggccttccctttggccaggagactgactggtgggccctgatggcggttatgacagttatgacgcattccatggcggtttcacctgacttatgggcccttcaatccgtgtacttgcgtctaattggccagaggtgtgtttccttgcatgactggtgtgttttctcattaaaatacccgcatacacatatttcaccaacactagtggaattgggtagtaataatccctaccactaagttgaataccatattttatttcattattttatttcattatatgcaggtattgacggtcaaatattatgatttaaagaccatcaacatttggcctaatttgtggtcccatcaatccgtgtgctcacacgtgattcgctggtggtgtgtttctttgcatgccagcttcatttctcattcactttggtgtataatctccgcattcatgttaattctcttagtctagtacaactacattatttattattgatatacgtataagaaatgttaattttccctttattcattgtatacgtatgtcacgcccagaagttcttctccttagcaaaaattcaattaataaattgttgcaagaaattatttgtttaaaggcaagagagaaaccctaaattaataaatgcatttaataatcggaatcggcatgtgaaatttttcttagattctacatgctctactacattaacaggatttttagtggaattttcagagccttggaaataattttaaccaattaaaataagcaaagtgcaatattaaatccctgggaaaatcctttttcccttttctcttttctttttcctcctttttccttttcttgggccgtcggcccattccttcccgcgccggcccgcttctcccctccccgaagtcctccctccctccctctctccttcgggcgccgacaggtggggcccacctgtcggtcgtcttcctcctctagccgttggagccgtagctccaaccgccggcgccccacctcctccactccgcatctgcgccccaccccacacccacgtcgccggctcgccgcccgcttccccctcctctcccgcacgcgcgagccccgcaa

SEQ ID NO: 41919 - DNA, 1501 bp, Oryza sativa
gtcggtttcctttaggcttcggtacagcatatcccgtcgtgtccgacaactcgttggactcggtcggcgcctcggccgcggtatgtgtttatatgtaaaccaaaaggaaccaacaaaaagcacataagcagtactaaaagacaaaaccgatataattatgattagaatcagatttagaacggttaacctgttaacgatggatttcaagatttcggcggtggacgtcggctcggatgtggttggaacggagcaagatctcgtggctgacgacgctgaaccgatgtcctccgcggtatctcccaaagctgaagtcgagagtttcttgtcgggaaatccatctcttaaacccatctcatcaaaatcttgaagcaccaaaatcctcctacctggcgtgccattgttgacgtttgatgtcgcgattctggtatttgcatagtatggggatcgtcggtactaggatatatgcgagattgaggtaaaagagacagagatagggatttttatacaggttcgggcccctgaattgtcagttaataaccctacatcctgttggccggagccggtgttgctcttattcactataatcacaccagtacaatatttggacagcctatctaactgttgtcaacatggcggtctgaaggtctgactcgtagtcgacaacagggtagtcttcctcctcgaatccgtgcccggcgagatcaaagatagcgctttcgtctctcctgacagtatctagagataccgtaggggactagtcgtgcttatccctgaagtcgatatccggcgtcttgtcttggcgtatgttggcttgtatgttgttccgtagattgtggtgggtgttgattgtggtgatcttgtcccctctcctcctaggggtcttgtatttatacccatatgtaggaatgaaaacggatcaaatacggtcggaaactagctttatcatattcgttttcatattttttctcggaatcaaaatcggaatcggaaacccggatacgaaaacagaatcaaaaattatcgaatacagatacggagcgaatacaaatcgaaacgaatacggtaacgaatattaatcggaacataaaagtccctcaaactgaccttcacaaatcaatgaagaaatataactcgttactttttctaatagaacatatcaacattttcaaattttagtgttaataattttgttatatccgattttgtggttgaggaagatgattcaatctaagagtaagacattatgaggcaaaatcatgtcaataaattggatgattgtttttttctaaatatttctaaaatcatgttctatcgagttattgtgttcttactgcaactagtttttgataaccttttcacatgagttcatttagtatcataaaatttaattcaaagttgagggacatcatatagacttaatagctaattcttaggcccgttggcccagggatatataaacctatccctagtttctcccgcctcccaatctcccacacctccc

SEQ ID NO: 41920 - DNA, 1501 bp, Oryza sativa
tgaccggagtagtagctgactgccctgactctgcttgatttgctatgccacctacggtttggaagattcagagaaatatcccttttacttgtacatgtactaataattgtcgacatgcaaatgcaagtggttgctgttcgtttgtggcacaaacaaagttgttgaggtattattgaaatcaatatttgctataggatatactccctccgttcctaaaatactattattttaactagtcgaaggcaaaataaataaaattgtaaaagattactatgcccttcattagattttattagataatggaaatggattacatctccgacttctatcataagacacataaccataagtttgtttaatataaaataaatcaaaatgagaaataagatgatgggacaaatccccaactcccctttattattgatagattttttagctagcaattctaatgaaactagaccacacatagtgatagtgaagtaagagacccttgactaccgattacaagagtgtaataccgatgtatattatcatgttcttcctcgtgtgatagcatcgtaaactaaaagtaaagtcaataagaatatatgaagataacccgcgtagggttagataattgtttatcattatggcaacatcaaattgaccaagatacaacactagcttcaattagaataatatttttaatggatctagatacctctctaagccaattaccaaaaatatttttgatgttacggggtggagggatattaaaagaaaaaaacacacatctcaaaacaaactgagcaacgtaacattaaaaaaaagatgttggattgtctcttgtccataacagacagaatagtgtttgcctccttctattttcttttatccagtttatatctttcgttagaattactttctttagtggaacgtacatatcgataatgagccgtctttgatgattttgtaagtctcaagatatgccggctgagcttttagagatgctcgtaagggtatgacgtgtgttagtaaggattagtgtgcatacggttagacgagcatttgtgtctgtgtttgtactgtgtttcatcgaaaaaaaaaagagaaagggataaaacaaagagggagtatggcgtgtgttcgtacaggttagcgtgctgtttatatgagcgttgtattgttttggggaaaaatataagcagagggggataaaacaataaggagtactactgattaagtggttaattaaaggaaagagtatgaattaccccctaacaatcgcaacaatacgaattaccctcgtaaatcacaaaaccagacatttgacaccccaaactattgaaaccggataaattactcccttggctaaatctgaagtggttttggtgctatgtggcatacacgtgatgttaatctggcaatccaataaaaaataataataataactatgggcccatttctcatatactcctacctcacccctttctcttctctctctgatgctgggggcgcggca

SEQ ID NO: 41921 - DNA, 260 bp, Oryza sativa
attatgtttctagggtatcctctagactttcgctctacaagttacatctctagagctatgggtttgtttggaaagagactacttgcaggaggttgatgctatccctggtcgtgttctgtgcaggcatattttgatggtgttgatttggtccaaggaagaattgttcttaaatagattcctaatcatggtggtcaaggggaatcgcggacctttggagtgcttaacttaaataataagtttgctaatccacaaccgcaaga

SEQ ID NO: 41922 - DNA, 1501 bp, Oryza sativa
caagccagcatgggcaacggctttatcttttatatagcatggttcattgcggagcaccagactgagaagtggcggagataagcccacgggggtcgctggggagtccatgccttgttttataagggggtgattatgatctaggaatggtgcactgctttgagttgtgttgtgcgaagggtactgtcgcgatttccaccaccactgcagtgccgtggtggtacttcagggcatggtaacatgtgtggaatcgtgtcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatggtacattcctggtttggagatagatctgtgcagccgggtatggttgttcaggatggttgggcctgagcagcatgggtgtgctgttcagtgttgattaaaattgatgattaattactctactgttttataattcccaaatgtttgctaaatgctgcttttgcaaatgagccatatattatgccattctttggtatccttgtgcacttgcatatttgctgtgtggcttgctgagtatgtcatatgctcaccttgcaataatcaatcaaacctcagttgaagacaagttgcgaaggagaagacgtttgtcttataccccagttgagctgcctgtgggagtggagccggagcttcgctagaccgtaattccactgctgtttttcttttattttgtaagtatgtaacgttattattatgatgaatctgtatattaaattgtcagtttgtgtacctcggctgattcctagacgaggatttaatgcacaaataagttcagaaattactagtgaatttctgggcgtgacaagttggtatcagagccatctcgactgtaggataagccaaatggtcaaaccttaaggactaatttcccaaaaacatgatttgtgaaaatttctcctttcttccttatctagaattctttgcaaattgtttcattgtctactcccctctctctttcaacttgagtagttctgaaactagttgttgaaacttgaagacgccaatgtggtctacttatggaggttaagtcaagtggatcgacgaataagaaggtaatggtcgatctaaagtgcccagatgtcaagatggaatgaagtttgcatcctaccttagaacctacgccgccaaactgtcgtggaagaatagttagtagggtagaatgtttgttgcttgcttgtgtgtaggtatggttgcattctcgtcattggtgtggttcaatgatgagcgtgtaactatacaaggttgcttgcttaatcaacttgaacaatataatggtctacacacaccagatcagtggtaacctggttaaggtcttaactctagtgtaacccctctccttctatcttctctaatatgcaacaaa

SEQ ID NO: 41923 - DNA, 248 bp, Oryza sativa
agctcctctaccgactgttccggccacatcccacactctctctgccggccaccacccttcctgggtgcgccaccctcaggaacacgtttggccgccggcgtcgcaaccacccagccaccggagcaccggcgccccgctcctctcctcctggtctcgggtctacctgtgaagaacgaaacagagaagaaagaagacgagaggaaggatgaaaaataaaaataaaaagaatagaatattccctgacaagt

SEQ ID NO: 41924 - DNA, 917 bp, Oryza sativa
tttattaaattctgaaatatttgttaaatgctatttatgcaaatgagattatactatgccattctttgttatcctgtgcacttgcatatttgctgcgtggcttgctgagtatgtcatatactcaccttgcaatcattcatcagaggaggagttctacagtgatgctgatggagtggatgattaggcgtagccctggtcaagctacctgtggagaggaatcgcctacgctgtttcttttgattgagaggaactatctacctctgtaatgacattttattcgcttattaattagagtaataattgtactgtattatcaatttgttattgtgtgcctcggctgattcctggacgagggtttacacacatgtaagcgtttggaattttggatagaaattctgggcgtgacaagttggtatcggagcctccttgaccctaggttttgccaaatggttacccatagaagccctctaaagatattggaaaagtagaactgttctcctctctctcttttaattaaaccaaactaatggcacatgcaattcatgacctcttttattgttctcattcaaaatttatttattattcctgtgttgttagtactgtacatctattaccgtactaatggcccatttaccatcaaaagttttataacattgttttatttaattttgctgcaatgaactaagcttagcatatcgattttataactctcttttatttattttctttgatacctgttattcaaaagtgcaaagtttgtgaacctatttctaactgtttcaacttatcttgcaagcttggtttgctttatttatttactttttactttgaatttctaactttattcaagctaacccaaaaacttgtgctattaactagataaatgacttaactccctcatttcacttgtctttaga

SEQ ID NO: 41925 - DNA, 1132 bp, Oryza sativa
ctgaacggaaggatctagagtttttgtcaaattccacacgtaagttacgtagatacgtagtacagttcttcaataggagaactaggcaactagcagaagagaattgagaaaactgacgaaaaaaaacgcaacgcttccttgatcttcaccacaccaactcaccatctccctattgggaccaagtcagtgcaggcagcacaagatagaagccctcgatgcgctaccatgctgctggccgccgaaaactcatctttagaaaagatcgacgaaagggggctaggttgaggagatcactcctcactcctcagtgaagccagcctcatccttcagacattctcctccttttcagtgcaaatccacggcagcaaaggtcgagctacaggctacctatagcagagacgaaggggacaagatgcggtcctactcgtggagtcgtggttggtctgtgtatcccagaacccagagtcagatgcaaaagggaaacaatgaataaatgagtagggacgataatgatgaggactggacggttaaattttttttgactgtaggaaaacgtctagggctagattggtttgagatctaaattaatcttaccaatttttataatttcaataatatttagtgtttatttggtttgaaattaaattttagcatgccttaaaaaaaggccatttcaatagttaacttaggttattttgatttcgattcaaacacaattttagcttgccaaaatttggcatgacaaaaattgataaaacctcaaacagcccgtagtgcatccatcatcagcatgtcctgtacatatgtgaccctgttaaatgcagagaaaaaggctataggcaggatgtgtgttttaatatgcatatgtaaatagtgtagcaagtattcttttaaataaataatttagttaagtacttatatgcatatgtactaattactccctttattctaaaatgtacttagatacagtgttacctttttacacaatcttttaacattatactttttttagggaaattttaacattatactttaactactactaatttctttcgtttattatcgataactacgaaatcaacgttacataaaaagatttaaatagaaacctgacggcactcccttatcatat

SEQ ID NO: 41926 - DNA, 823 bp, Oryza sativa
aaatggatccccaaaattcctttaaatagacgcactactgacggtgcgaattccaaggaacaaagagagattgtcgcaccctaaaaatcccaaatatataaattgttgtttaattggaattattagattttattttaaaagcctagaagagaagatctaattttaaataataaaatccaatataaaattgggccagataaaattttattaaatactttgcttaattctatagtgcctagatttttctgggatttatttgagctaaggaagtatttttaataaatggaattgcatttcatgaataatttaaattgaaaaaggttttaaaaagttctcttctggctttgggccgaaagtcggcccaaaacccccctctctctctctcctcggcccaggccggcccgcagccaagccgccgctcacgcgcgcgcgtccgccgctgacaggtggggcccacctgtcggggtcgtcgtcttcctcgcgcccgaaccctagccgagccgcgccgccgccgcccatccaattccgtcgcccctttcccgatccgatgaaattgattgaggggaaaggatccccgagatctcctctacctttttccttttggaagcatcgtctatatcgctttggaaatcatcggatttgagctcgattcggattcccctttcctcccgaaccctaaaactttccttctcgtcgccggccgccgtgggacttcgccgccgccccctagcccctataaaaggacccccaagccctccgctacccgccgccaccctcgccttcgcctctcgttgccggtagagccctagcaccgtgcagccgt

SEQ ID NO: 41927 - DNA, 226 bp, Oryza sativa
ctgaacggaaggatctagagtttttgtcaaattccacacgtaagttacgtagatacgtagtacagttcttcaataggagaactaggcaactagcagaagagaattgagaaaactgacgaaaaaaaacgcaacgcttccttgatcttcaccacaccaactcaccatctccctattgggaccaagtcagtgcaggcagcacaagatagaagccctcgatgcgctacca

SEQ ID NO: 41928 - DNA, 158 bp, Oryza sativa
acacgccacgcccttcgccatagtaccaataaggcacgtcatcaaaggctgcgggtgaacaggtttcgtccgtgacgcccttcgccatagtgccaataaggcacagcgtcaagggttgcgggcgataggtttcgcccgcccacgcctttcgccatagt

SEQ ID NO: 41929 - DNA, 1501 bp, Oryza sativa
gtatatatcctatgcatgtatacagttgatggatgtacatgtttgttgcacaatctctggacaaactcctcatatctagtcctgcgtaccaggcaattttacaattgtacgctttcgccgatggacagaagagaagattttcagatacacttagctcgtacccgtcaaatgaaggtaaaaagcaacgagtaacattgttttatgtgtactattgagtagtccttcataagataacttagttgtgtttgtagcatactatggcgtagtagacgagttagtaccatggctagcttgcatgccatgtgagaccatgttagtttagttaggctccccaacgtgagtaagtgaccgataggtttagaaatggtatatttcatggtctagctagcttgcctatgtaggttaatgtgtgtgtatattatcgcacaaggtcggaactttttggaaattcgataccgtacttcttacaaatactacctccgtttctatgaataacacacatgctcgtttttgaccgaaagaattgagaaagaaaggaaaaatcttatatttagtaattggaggcaccaataaagcttccatgctagttaattgatgtcacgtaatttttctagcccatgcaagtgcacaggttgatgactagtaatatatacatagaattgttgtattcgtattgaaaaacacattgaaatgatgctaattttctatcaaatatctttgtaaatttaaactaattcttggtcaaagataaatcttaaaatacatgcgtgccatatttattagaatggatggggttttgttggtgccaatgaatcttattgttatcgaactactgctcgatgcccttgtttaactacagctgcaagaagcgtatagcatgagagcctttaatgtgttgtcttagtcccgatcctgcatgatgtccatttgggaggagcaatatgtacatatgcatgaatcacacttcagcatttatctctttttaccttggagttttaagaatgctcacagttagggcatgcaagttgatccattgatatattcacaatattcgcaacgccatgatgaaggctatgaaaatgacaatgatacatgacgaaacaagatttcggcaatactaaaagggggtggctatcaagctagaaaagttgatgggtttgaagaccaggaagtttatactggttcaggccttcttaataagaagttataccctactcctgtctggggattattccgccgagtctattattgatcgtatgatctaagagtagaatgttgtaccccaagaggcacccggacccctccttatataggagaaggagtccgtattacaaaatacagctcatatccctaacggaataggtagttgcagatatgacctaatcgtaaccaactaggatcccggatatttccttaacatacaagtttggaacttaacccgagtctctttaaagatattctatctatacatcacattccatacctagtcggactatacaga

SEQ ID NO: 41930 - DNA, 198 bp, Oryza sativa
aattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtc

SEQ ID NO: 41931 - DNA, 1501 bp, Oryza sativa
aatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataacgcttctgcctatatataagagcagcagcttacattcaagaatcacctctcaacacacaactaagaaacatagctaggtaaccagggaaggtagcatcagcagcgggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgatttcacttccaatctcacgacttcaggcatatatcttgcaacatgaagacatcttatgctctacttccactacaaaattaactaatgcgctattgggatttccatattttaatttcatagttgttgctaagatggacgaaatgggagttcttgctaagatggatgaaatgggagttcttgctaagatggaaggacaagcctacactacaagaatcaatttaatctgtgacgaaatttgacgaaattttcgtgatgttttcaga

SEQ ID NO: 41932 - DNA, 455 bp, Oryza sativa
tcacatatacgctacccctccgactccgagcacctccgccggcggccaccgctccgaatcgacgacctgaccacgaccaagcagaagcaggcagtcagtcagtcaaacctccattaccacatccaacaaatcgagggaaagaaagagacgatcgatcggtgctcacaagtagagagctacaaaagagaatttgcaaaacaaatttgacacagatgataagtggcaatgtgaaaagaggggaggagattgaacttgaatccggaggaggaagaagaagaagaagacaaagaggaaacttgcagcaattggggggaaaaacaaccgagagtccaggctggccatcccgactacatccaatacaacaactatataataataataataatttaaataaacacggaaagaaggaaattttaaaaaagaagagacacaacaacacaaggggcgcgtcggga

SEQ ID NO: 41933 - DNA, 425 bp, Oryza sativa
aacactatgagaaatagatgaggttcacagtggcgagttggcttgattaatcactactacagggacccttttagattccgtgcaggcagcaactcgtcgcttttggaaaaatcagctcattttcacgtgcggtccttttaagaggacggcacggaaaaatcgatttttccgtgcagttctcttaaatggaccgtacgtgaaaatgagccaattttcccgtgcagacctattaagagagccgcatgcaaaatactaactccctcttttccctctgacccactttaaaatttcccctctttctctcctctcccctcccctcaatccccttttcaactttaaaatttgcacgcagagcttctcctctcagtcctctctctctcacacctctcctctcctctctccactctactgtcctgtcctcctga

SEQ ID NO: 41934 - DNA, 1501 bp, Oryza sativa
agtaaaaatgatgagaggtatgtattaaacttcacatattctaacttggtctctcttgtggatccaaaatatagtgtgagcttcctatttgatctttattgattatgtgcatatgtgttccttcatatccatatgtatgcacatcttgagggggagcttattctatattttgtttattataagatttctatcttgatttgaaatcatttttcatctcatctctctgtattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtataagttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgaagttaatgaatactcaacaaacatatccatatctttcatatgcaaccggttggtcttcaagtgaaggatgacaaccgatttgttgagactaatgttctcctttgaggtgtgaaaaggaataggtcccactatgatgaggctaatgaatgacaccatgggttagtggtcatcaagccaaggacatcgtcatgttaacaagaatgaagtcaagcttgtgatgagaataaagtcttgacaaaggatggacaagacctcagcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagatagacgtcgtactatcaagaggggtctatgaagcgagcttgtggatgatcttgtgccatattagttcatatgcatgtaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaag

SEQ ID NO: 41935 - DNA, 328 bp, Oryza sativa
tcttataatagaagcaatcgaccgaggcaagcgagagttcctatccatcagagattgggcccggtgaatcaaggtcgtgatcaggaagatgatgaggacagaaaaactcaatggtgtccttctagtattattaaaaagaatcaaaagagaagggttcaaagattaaggaacatggagcgctttcatgaggtagagcaggagatcaactatcggctgtagaaaacaaagccgaggtaagaatggcgtgttaagaaccaagctgccacaaccgatgaggtcaaagccgatgaagcaaagaggttagctaaagggaagagcattgtgacta

SEQ ID NO: 41936 - DNA, 1501 bp, Oryza sativa
cagggctacgcctaatcatccacaccatcagcatcgctgtagaactcctcctctgatgaatgattgcaaggtgagtatatgacacactcagcaagccacgcagcaaatatgcaagtgcacaggataacaaaggatggcatagtatagtctcagttgcataaacaacatttaataaatatttcataatttaataaaacagttaaataataattaaacaatattaatccaacgctatacaacattccaaaccatgagctaaacaagttattaacatcatcatttaatagggtgagaagtgtgagactaatcacgaaagacattgttagacccgcccataaccgcgggcacggctattcgaatagtttaaactctgatcagaggtgtaccactatacccagaagacacaacctcaacatcatgtcaaccatgcgtcgcgatacttgacaagtacccgaatagagattgtgaccgtaccctctatataatacaattcaaagtagtgctccgctctcggatcataatcacccccttataaacaaggtatggactccccagcgaccctcgtgggcttatctccgccacttcacagtctggtgcactactatgaaccatactatacagaaagtaaagccgttgcccacgctggcttgtggttggcacggtaaatgtttcacaaccgaaaatcgtgaaccggtccttaattgtcatgagcacaatcatcaaaaccatatgctcacaacccacctttatcaggttttagttgacaaattaattaattaaccaattatgattaaccatcatgagttatcattaagccatcattaaataatagtgtagcataagttatctagctgaacccatatataaagctcaactagtcaaattataataacccaaggtatcaaagaataaagtaatcaagaacaaaagggccataacaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaagtcttctcatgcaaaatcggactctccgggaacgtcggaatctaaagagaaaagagcaaaattaccaaaacaatacataaacaagtatgaacattacatgtggatatttttaacatatagatctcaattttagaaaaatttagagacttgaaccaactaaatccgagctaagatgaattagttatgaatttttaaagattaaatcggattaaatcatttatatagattttaattgaattatgacacaataatgaattatttttgaaaaggaaaagggatttattgcgttagcaggctcggttcatggtggaccgggtgcacggcagtggctcacggaaacgaacggtcgggatctatctttccaaaacgaacggccgacatctatccgtccacggccggtctacggcggacggcaacga

SEQ ID NO: 41937 - DNA, 460 bp, Oryza sativa
ctttaatttctttccaaaaagggtttaataaattattaaatcgtttttcctttgattagaaaatccaataaacttcgaaaatccatatcttctcaaccgctcatccgattgaccccgttccacttccagtaattctgtaaaattgtgatctatctaatggtactattatttagtctaaataggatattttttcttggtcttttgtttaggtttttgattgtttgcgtatagttgcggtcaccggattttcatcgatcgtgggttttctcgaagatacgtgaagcttcgtgaagaccttgagcaagacaaatcaccctttgaccaattgctcctataattggaaaatcattattattttgtttgcaacttgcattagtagaatcacacacttaacttgcttggcctcggtttgcgtgccaaaccgacagacctacccagtagtcgcactaatttttgtagg

SEQ ID NO: 41938 - DNA, 1501 bp, Oryza sativa
aaaggtgggttgtgagcatatggttttgatgattgtgctcatgacaattaaggaccggttcacgattttcggttgtgaaacatttaccgtgccaaccacaagccagcgtgggcaacggctttactttctgtatagtatggttcatagtagtgcaccagactgtgaagtggcggagataagcccacgagggtcgctggggagtccataccttgtttataagggggtgattatgatccgagagcggagcactactttgaattgtattatatagagggtacggtcacaatctctattcgggtacttgtcaagtatcgcgacgcatggttgacatgatgttgaggttgtgtcttctgggtatagtggtacacctctgatcagagtttaaactattcgaatagccgtgcccgcggttatgggcgggtctaacaatgtctttcgtgattagtctcacacttctcaccctattaaatgatgatgttaataacttgtttagctcatggtttggaatgttgtatagcgttggattaatattgtttaattattatttaactgttttattaaattatgaaatatttattaaatgttgtttatgcaactgagactatactatgccatcctttgttatcctgtgcacttgcatatttgctgcgtggcttgctgagtgtgtcatatactcaccttgcaatcattcatcagaggaggagttctacagcgatgctgatggtgtggatgattaggcgtagccctggtcaagctgcatgtggagaggagtcgcctgcgctgtttcttttattttccgctgcttagaactttattggttgagaggaactatctacctgtgtaatgacattttattcgcttattaattagagtaataattgtactctattatcaatttgttattgtgtacctcggctgattcctggacgagggtttctacacatgtaagcgtttggaattttggatagaaattccgggcgtgacaaattggtatcagagcctccttgaccctaggttatgccaaatggttgcctatggaagccctctaaaaatattggaaaagtagaactgttgtcctctctttctcttttaattaaaccaaactaatggcacatgcagtttataattcctttaattgttctcattcaaaatttatttattattcctgcgttgttagtactgtacatctattactgtactaaaggcccatttaccagcaaagagttttacaatgttattttatttaattttgctgcaatgagctaagcttagcatgttgattttataactctcttttattttatttcttttgaaacctgttattcaaaagtgcaaagtttgtaaacctgtttctaactgtttcaacttatcttgcaaacttggtttgctttatttatttaccttttattttgaatttctaacttcattcaaaataacccaaaaacttgtgctattaactgggtaaatgacttaaccccccctcctttcacttgtctttaga

SEQ ID NO: 41939 - DNA, 1501 bp, Oryza sativa
taacatatgattaattaattaattattactataaatttgaaaaataaatttatttgatttttagtaacttttatatgattcttttatgaaatatattgtttagcagttcgggaattatgctaattaagaatgagatattaccttaagcctagatgccggaacaaaaacaacctaagtgtgtgttaaaggcgtgcacttatatggatgcgcatgctaataatagtgcacacacatattttccatgtaataaaattaggattcacccaaaaaaacacattatattcgcagcctgcgctaacctgcagggagccatatataaaatttcgttttttttttatcaaaagtgggcaatctgtaagaaatcgttagctcagcctatcgtgggctgaagtactaacagagagtaacaggctactgggctcatccccttgtccttaaccaagtttctaccggttctctcgcccaaaagacaatatcaacgcgcctcagctttgtccaatcatactcactagtcgccatatacagatgaaaaaaaaatgttccaaatattggtcgatgagaaatcgcgacatatcattatcgtttccgtcaagaacaagaactccgcatatacaaatggagtaatggaaacaggttgaatcgaatgatcgccgactcgctacagaacattactagcaatgattccccagattaagcggacggtctgagcaagtaaggtcgatgaatccgtcttcctcctccgattgtgaagatttgcgaggagtacacttgcatgaatacattctcggattaaaggatgaaccgcagtcgtagcaaaacacagtgccacatctgcaaacaaaatttatcacatgaatgtaagaaatttcatgccgacttaggaagcaccagtgatgtggtggtaaagtcgtgggtgtatgactctacccaccagagttcaaattaatgctggtgctcacaaatattacgcatatatatgtgaactttctaaaaaactttagtgagatcatgtatgtgctcctggtttctatttcttagagcatgtgttaggagacgtattcgcggagatgtgagtgttgtgttgcgtgtgtagtgttgtgtgtgcgtgtaagtttgccgtgtaatcgtaaaaaaatcaaagcataattccataactacgggtctacggctctatttgaatagctgaaagtggtttgatggatcatttattttttttctacagttatttcaaagcataaacaaatgaattataactactgcaaaattgaaagtagctttataaaagcattcaagatgtcacaccccaatccggcaccgccgtacaacagcacctgacaggagcgtgtcgtaggaaaaacggcgtgaaccgcttcctacgaaaccgcgatctcagtaccagtcccaggacatagcgctggtacccacggtgacaaatatgaatcattgcaatccttataataaatagaggacttatttaccttaacttaggttgcattttaga

SEQ ID NO: 41940 - DNA, 1501 bp, Oryza sativa
ccgccgtcttcccacatcccgccgcctcggtatctccgccaacatcggcgaggcgtgccagtctctccacaaccaccggcaagacccgtcggtcccttcgcaaccaccggcaaggccgccaatctctcgacagcctccgacaaccgtcttcctcctcttgcgttcaacataatcactggtaagttcccctcacgtcgactcggtttttctcataatcgtagatcaagttagatccatcgtgaattcctatgcccttacttccatgttgcttctaacttccactccccccatcattctctaccaaaatcttggcgtacatgaccttcaccgctactacaaacctcatgctagtttctccctttggaaacttgtcttccacctcctagcattattcattgtctctaaatcttttcctcacaacctcttagtaaatgatcgtcgttgttcaaacaattattctttctattgaatcaagatgcataggtttctatgtttgagtgaaaatagacgggtagatgagtagaaaattgttgatagcttttttagtagattttaatttctttttaacttcaaagaaatcaaaagttgaataggagtgaatgagtaggagaaaagtcaaataagtaggtgggtgagatattaaaataggaggttggaagagacaatttatggggtactaatagatatatccaagagattttggcataaaccaaataaatcgtggctgtcggatctcaatcaatcggatatactcccattgaagcttatagatttctccctcaaaccctaacgcctcccaatcccgatccgccgccctacccctttatcgccgccaaacaccggtgaagcctatcggcttctccgtgattgccgacgaggcccatcggtccatccacaaacaccggtgaggaccgctagtctctcaacaacttttggcgtggctcgtctaccggtggcaactgtgtcttcctcctcccttagttcttcatagtcactagtaagttaccttcatgttttctcggtttttctcatcatcgtagatcagactagatccattgccactgctccatcattctctactgaattcttggcctaaccgacatttcttaccatggctgattaatcacactttcaattcaatatatgtgtattatgtacttgcattcaccgtatttatgcttgcgcaagacaactatttgcatatttacatatttgcaaaactatgtgtataatatgtaggaaccactctaaatccacatcccgatctatttcattgtatttgtgggtttatcatttttatcagattatttatgtgcacaccatttgtacaagggccgattttgcttaatataagtgagaacaaaatacaacaatatttgaacaaaaagcaagagtagtatatattcatcaatattaaccgatgaagtcgcatgcacacgtgtttttggaaatatatgcaattctactcccgaataaactttgatctacctcctgttattca

SEQ ID NO: 41941 - DNA, 1501 bp, Oryza sativa
gttcaaacgggcggatttgcccccgcaaatctcgccggcgccattgatggcggccgacctcccgcgccggtttcctcccttccccggccaccccctctctccccggctctatttaaaccctccccgcacctcctccgtccggttccgcctctcgccgcccttcctcctcgccggatttgagctcgcgacgtcgctctctctctccgccgtcgccgccgagctccggtccgccgccgtcgtcaccccggaccgcctcccacctcggcgccgcctccttcggcttcgccgcatcctcgccgacctcgtccacctctccgtttcggtcgccgaccgccggaacgccgccgtccccgtcgacccgagccgcgccgccgcctctctccgctccggtcgccgttcccgttgtcgccgtcgacccggggtgagccgtggaccgccgtttcgcttcccccttcccacccctctctcgggcgccgctccgccgcgccggtggtcgccggcggcgaccataggggcgcgggcgcgttgccttccgccggccgcgccgacgtggccgccttcgggcgcggcgtgtggctgccgcgtggggcccggccgtccgtcgcccgtgccctcgggtgcagctgacgcatggggcccgcagcgccagccggtgtgagcccgggtgcacccggtccaccgtggactgtgaggctgccgcgtgggccccactcccgtggacccggtccgcgcgccctctcccctcggctgacgtaataaaccctttttaaattaaaatttaaatgaagaaattcttaaatactcatttaaagagcatataaacttcaaatggccataacttggccatttgaactcggaattggaccgttcaagtctctaatttttccttaagaagtcaagaacccatttttgtgttttttttcctgcttgttatatggagtttattagagtaaaagactttttcctttctgttggtcgtgtagacgctgcagcatcggaagatccgctcttcgtgaaggttgaagccgacgtttgggaaagcgagcaaggcaagtcacatcatctttgaacatattggatcctagtttgtgacattattttgatttaaattaatgcattatcgctttacttaaatttccgcgttatcactgttttatttagctatgcctgtttacctttgttatgaccttattattattgctattgttattattaccttgttcaccctagaataaacaaaaccccagctagtgggtactctattcatggtgccactagtatgaatttaggtagatgcttcgctaattatttaggcaacattaggtggttttataactctagactttgggaatattcatatcacttggacattatggaatggttggattattgcggaattggatgcacaccttcccctctattcaaaacccccaaaatggttttagactgggctcggggtgcatggttttgatagtagcacctcggccacataaggaccggt

SEQ ID NO: 41942 - DNA, 1501 bp, Oryza sativa
ctgcggcccggtagtcgagatgtcatggcacagggctggtgtcctgctgctgggggctcattcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaattggcttaacaactaaaatgtggaatggttggcctgggttggcttgggacgagctgggacccagggtcgggttgccagttcggtctgaatcatcgtaggccttgggttaaggcaggttcgtgaggggtcacggccttgattaataatactgtgtagctctaggatcgtctttttaaaatggctttgggcaactaagtgacttttaaatgctgttttctgcaaaacttaatccctatattatcaccccttgtaccccttgcattaatcatgcatccgccggtgtggcttgctgagtactgtggttgtactcattcttgctctatctttcccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaaggtaattttctcggtcgcgacaagctggtatcagagccatctcgactgtaggataagccaagtggataaaacctaaggacatattttataactaaaactatttgcgaaagttcctctttttctcctttccctaatgctatttgcacaaggtttacccttttcttccttcttcaaatttcaactagtactagttggtcagctttgtgaagaagaagatgtcgtcaattgtctgccgaagctccagaaggctgcaggatccgctagtgaagtgaaggaagcagtgaagccagctgtgaaggagtgaagatcttgggaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacctgcagaataagcaaaacaaacaacacatcaacaaaaagagttagttcctttaaggtcttgtccctagttctggtcgattctttccttgtatgcttcccctctcaacctctaccttgtgacagatggataacactggtaacaaaggct

SEQ ID NO: 41943 - DNA, 644 bp, Oryza sativa
atttttgggaatgtggtaggaaaataggtggaggcaaaaggataggatttgaaccctaaaatatatggcataagtttcaaggaattgtttgaggctaaaaggaaatttaggtgacaagggtataatttattttcttagcacaagaggaattattcacaatatttgtaataatattattcttgtgccgagaaggaaatcaagccacaggaattaaattagtggctagatcaaaaggaggaatttagatatttggcggcaaataagaataggtttggaatcaacggataggtttaagatcaaaggatgggtcgacaattaaatccaaatggaatcgtttggtttaagttctaggacaatagtggagaatttcttggaccataattcataaaaatagaaaggggttttcaaactaaatttgaataaaagaattttaatcaaaagaaggttttaaaccaaatcaagaaatacctcaatttaaccaaatatatatttttaaatgaaaaacacaaaagagattaaatactagagaggttttgagcgagttagttttaggaggtacctctaattacattgtcctaagtttaggaggttattaaaaacataagaatcggcatgatgcaggattagaaaatgacacattttca

SEQ ID NO: 41944 - DNA, 1501 bp, Oryza sativa
aagattttactctacttttgaatagggtaaaaatacatgatcgaccaatctggcaaacatggcttgataatttctaataatccctcgtgcttcgccttctagagtacataaactctctgccctttaatataccgtagtagtaggagcctctcctactgttttctcgtcaaaaagaaaaggaagagagaagaggctaagcgaggagtggggagagagtgaggagtggacgtaggaagttagatatttgaaggtgggcctcttaaatggggttgcttgtgaaaatatacttatttttatatttgggtatatatgttaagaggtcagtctctgaaaattgatttttttttcatacggatcttttaaaggagcttatgcgaaaatgtaagttgatttttacgggcgcaatcagttacaatccatgtgtaaactataggggttctcgtaccgtttcggtagtagtgtcagttgttgatttattcggtgatacttattaactgttacatcgaaggaggactgtctatatgggattcatatgattttttaggcttccatcatgcagtgtttcaccaaataaatcgaaaatgttttaattttttaaaaaagttggaacacaatcaaatcactccatgaaacattttgctacgatgtatgaaacaacggttcagaatatatatatattctgaaatatgaaacaaatccaaatacatcaagaaaaagtctatatgggattcacattattttttaggcttccatcatgcatattttgaaactaatcgggcgttgtttcaccaagtggatcgaaaatatttcaccaagtagattgaaaatgttttaatattttaaaaagctaaaacacaatcaaatcacctcatgaaacatttttctacaacgtataaaacaacggttctgaatatattgaaacatgaatgatttagctatcaaaaatcattcgacagccatttagccttccgataaaaatatacttttgtgcgtgtagggttgatcagttgggtatgcacacgtctaccagcattacatctcttgcgatgtttgaatacgtgaagcatcttttgttccgagtactagcagatgtttcgtctctttgttgcaacaatatgtctgtactatactgtattacttaatatcatctactttgtttaataacaaaaacaaaaaacatgtgcctctcggagactatatgggtgttcaaaatgtgaaaacaaaacggaaacaacatgatatattatttaaaaagagaatgaatggattatatgatgcatgaaacgtgtcattcgttgttcttaatttatagcgtttcgtgatttcgtcaagactcaacaacttaagcactcctctaatatataagaacccccatcaaccacacatgcaaaaagcatcctcaggcaaaatcaataatttagcttgcaagcaaattcatctcagtgcagcatgagcagtacaaacaagagctcgccagctcgaaatgagagcggcggcgacg

SEQ ID NO: 41945 - DNA, 280 bp, Oryza sativa
ccgtcccgggttcggccgaacctccaaattttgcgtggacggccctggtcacatcctaatggcggttccggggtagtttggtcatttcacataggctgtaaccatcatacctgcctataaaaggagctcactctcatttccaacacacaactttgagctgaattacaagaggctctattgtaacctttgtacattagaataaggtagagagtgaggggaagctctggaggagtgcccggaagtttggcgctcatccgacttctacctcgacgagtgtagc

SEQ ID NO: 41946 - DNA, 494 bp, Oryza sativa
tctttttataaaatcattttaactttgtttatttcttaataattattatttgtgctctgaaaattccactaaaatttgagggctctttttagaccaaggagattttaacaaaaattatccaggccacatttgaatttttcttgtacgtattttagtgtttgccaatttctttccgaattttaattaattctattattccttttagcgaatgatttttaattttgggatgaatttatcaggacgtgacacatctacctctgacaaatccgtgggatacacaacaaacaaatctaatctctaacctaaacaccacgtctaagttattaattactactctaattcttgcgcaggaacttccttctctatccggagtcctagtactagagcacttagtatgaatactaaataatgaacccgcaaagatggaaatctatcttactcagactaaataattaaataacaaaagaaatgaacacaaatgcttactttataga

SEQ ID NO: 41947 - DNA, 680 bp, Oryza sativa
cgtggacattaattttgaggccctcagcccattggcaagatagttgggcccatttggagttttttagttgacttatggggcctccaatccatgtaaatgtgtcctaaatgcgcggaggtgcagtttgtcgctttacggatgtgttttcttctcaaaatacctgcatacacatatttcaccaacactagtagaaatgattagtaataatacctatcactaagtgggataccatgttttatttcactatttgtaggtattgacggtcagatattttgatttaaggaccgtcaacagttcccgatcttccgaaaggttataataaacaacgatttgggcggagtcgcgacactcttaacgaccaaatttggtaatccaagtatcagagatgaagataggattgaagcagaattcaagatggaaattgttctggaaacagagtgaggatcggctaaactccgaatcggctatgactatgatcagcagagttcgagtcggactaggttggccgattcagccgatactgtcaatgtgacgtggtacatgttgtcgggttgagttaatatgcttcatgaggattgccgtgcatggattgagtcctgagaaggcaattgtatctattaattaggatatttcatgtaatttccttagagatatgtttgggctaaagtctgccacaaagg

SEQ ID NO: 41948 - DNA, 1501 bp, Oryza sativa
ttcctctttgtcttgaaccttaattattagtatagcagttttcccccgccaaaataatctggggggtttcaactgtaacccccatgaccaacgttaggtccgcacctgttgcagaaccttgttttcttgctgacttcaatttgtgggttaggtttaatgcatgatgctgcagcatctatgcacacgatttcctatgccccactttgtagtgcaatcagttgagaaaaaaaaccatggcgtagaaaatgcgtgttgataatcacagttattttaatatatatttttacttcaaattgcagttggaatgcctgcctgcgtgcatatgatagtcatcggctcttatatatttttatgtcatctcaagtaagcggtacaattacagcattctcatgggaattctgtagacagttggtacttataatgtagtaatatgagcataatatatgcaatcagtagcaagtattttgttattttcaagttcattcagtcggcacataagaactgtgctttattaaaagaaaggaaagctatgccatcatgtactatgggtataggagaatatgagagatgggattgagaggagttgctgcattactcctcaatttacagaaaagagattggctgtggattttaaactccaaacatacaacgatataccatagcttctattgcatctgatcattggatagtataagatgttatgatatcttcataagctatagtatatgatctaataaactcaaaaatgcaccaaattattaaacaggtcattactcattaccatgttaagtactatcaggtactactccctccgttccacattaaaagaggttttggcctctccatcccttgtctagattcaccaatatccacatgaatttggacacatatatgaagcacatacattgaatcatgcatgaatctattcaaaacccaaaatgttttttaaggtgaaacagaggaagtacactgtttagatggccttttataaattataacaacatctcgaattgttttggctcttatccatgaaaggttcggaagatgatgagaaacaaccaaaacacacaagtagaaggagcaagcgcaactaagaagcggaagacctcatactctaactccaacagagaaggtgaacaaagtgcaatcacttcgggctcttattcttttctacactaattccaattagtgttaatactctttgttgttcattatttgcagattcgtcaccagttgtggatggttagttttattttggcacatttcatctatcttcttgtatatggctttttattattaattgtgtcaccttttcaccctgttgcaccaggcctcacacgcatattgcgcagaaatcttctcccccgtggttatcctatgccatctgagttcactggcaagtacttgtgttttgatccttcacttcctttctttattttgatatatgtttcttggaattagttacataacacatgttatcccgtgtttctttgactagatg

SEQ ID NO: 41949 - DNA, 625 bp, Oryza sativa
tgcgggagcaaatccgtccgtttgaatgcgaggcagagaggggaaaaaggggggaaaggaagaggggatcacggggagtaattcccccctattaatttcacgcgggggtggcgggatgcggcgtattcgccggcggcggcgacgcttggcgcatgtgggcggcgggaacgccgggaggaaggggatgatgggtgggccccacccgtcagcgagggtggcgggcgggcccacccgtcagcggcacgcgcgcgggagaggccgagtgggccgcggggagaggagagagagggggagggagatgggccggattcggcccaagagagggaaggggaatttttagggtttttctttttataaaacctttttaactttgtttatttcttaacaattattatttgtgctctgaaaattccactaaaatttatttacacattttaggcttttaggaaatatacaaaaatcctctaagccttatttgacttttaactttgcacattttaatttttggaagctttcacaaggattttaattattctaggcataatttaaaggatatattttagggtcgttttgggacgcgacacctgggaattcattatcaccctggaaaggctaatgttgtagc

SEQ ID NO: 41950 - DNA, 1501 bp, Oryza sativa
caccgttgacttttttaaacatgtttgaccgttcattttattcaaaaacttttgtgaaatgtgtaaaactatatgtataaaaaaagtatatttaacaataaatcaaatgatatgaaaaaaattaataattattttttcctaatcggccacctctaatatatctgtccttttggtccctcctctttatttaaacaaataattttccttattatccaactacagagaatcctacttatgcaaaaagcttgccaagccccaataattacccagaatttctgctccacttggccaaaagcatactaaaagaaagcactccctccgttctaaaataagtgactaactttatcatgtatagtctaaattacaaggaaagctgagaggtaaatgataccccttattaaatgagggatgtatatgtgtgagagggtagttggaggtaagatatatgagaaaaaaagttaaataagaagtactctctcattccctaaatatttgacaccgttgacttttttaaacatatttgatcgttcattttattcaaaaacttttgtgaatgtgtaaaactatatgtatacataaaaatatatttaacaatgaatcaaatgatatgaaaaaaattaataattacttaaattttttaaataagacgaatggtcaaacacgtactaaaaagtaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgcttccgccttcgacgtcacatatcacgatgcgcttgcgagactgaacaaattaagctggagtactatattatcatgttgtttgcttgacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttcgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaacca

SEQ ID NO: 41951 - DNA, 1501 bp, Oryza sativa
acatgatttgagttgatatgtttaatttcaggtacttagtgctgggaaattatcctgtgatacatttattgccccactagtccagcttttgtatgactcgtctatgtcagttcaggtaatgtaaaattgtgaagcaaccttcagtatcatttttaaggggcaatgaatctgtaattgaaagcatggtttcagaaaccacaaggaactggccagctcctgctggacagcgcatgattctaatagattagggcttctttttttacatgatctggcaagtacttggtggtatatgttgtttggaataaaaaggtcttgagcaattcaatcaagtcgagttatagttctaacttggtcagatttgaccagtaagcgactatctgtccatgtccaagaaattttcaaaaaacaaattttgaaacactgcttggaattgccttccttctttgtagagggttggtcaatgggtttttgaaaggaaaatcttggaagcatggcagcttcctcctttcctgatttctctgcaattttaccttctttctgcccatcatgggctctactgtaattcttctaaagcatcatgttgtactaactgttttcgtgttagattgtaaacctacatatcactaagtaatcaactgtattagtgacttaaaaagtaagatgttaacttaggagaaactcttttggtcgttcatacctaccatggactcattttatttgagcaacctttccacttaagggacactacattagctatattatgattgtgaaacgtcattattttaggtctttaatcccttgggactttgtagaatatctactaaatgtctgtgttcacaaaatggtattacaggttgctgcccttggtgctatttgcaatattgctgtgaatttaacacccaggaaatcgattcttcttcaatctggggctgtctcccagcttgttcatttgtccaagtctatggatccaacattgagattaaaagctgtgtgggctcttaggaatattatgttccttttgaatccaaaggataaagactttattctcaaggaactaactttatctactctttcaagcctcatatgtggtaagtctaaatgtgcagctatgatattaggtcattgctgaatcagccacactgctaatgcaacatttcttgcagattctgaacattttgtccaggaacaaactttggcactggtgcacaatcttgttgatggatatgtgaactcttttaattatgtcattggtgaagatggcatgattttaaatgctatttcaagacaactgaataatgcacctgccccaggagtatgcatacaggtcagtatttcctaaactacattatactgagttaccttatttaaaattgggcaaaaggaacatcttgtctgacaaaaccgtgtaattttagtttcacattctttatcgggatactatttattatcatagttaatcattggcatttctgttacctctcttcagggtatgtttgtgctt

SEQ ID NO: 41952 - DNA, 512 bp, Oryza sativa
ttaatagtgtagcccactccggcctccaattcatctatacccaatctaatagttcattcatacaatagttatatactacactattaatacctagtcccacctatcatacacactgcgtcttggagtccgtgctacagctggctacaaatctgtagcccgctacccttctctctcctcatttatcttcttaaaatatgtttgcagctggtttatagcctgctattgtacctgccctaagaaaaaacacagagatcaaaaacaactaaatcattatgtaattaattcacatcggttaagatactacactagtaatgtatcccatggattgcattaaatttttaatattgcatgtagttgtaccaccaatagtaattaatcttggttagttgtatgcagcgcattcaatgatgctaatttactctttatataaataaataaagatatatttgttaaatgatgatcattttggaaagatctcaaaaatcttagctgatgatcaaactggaatagga

SEQ ID NO: 41953 - DNA, 498 bp, Oryza sativa
agatttttggtcattagggtaagttcaacacgcagtgaccccttgctgtaattacacaacactcagttcatttgcaattaataaatattaaatgatgttctgttgatttttctttttttacattttacgtacagtttgtattaggtctgacatattcttgtgctgattaaatgtgagaggccacagacttgatgatattaggtaaaaacgttactaaagcccattgttagatgcgaaatataaataatggacaactagtttctgagcttttagtggttccacatgcaagatctctaaactcatttcactagcatcgctacaagttaaatgtgcttttagtatacataatctgcattctgcaatgctttacttgtgctctgactctgaaacaacccaatttgttaacgattacctcatttcttttattgttcaccactcaacttcataagaacagaatgcctattggctgctcaactcatcgttctgttgcttccttct

SEQ ID NO: 41954 - DNA, 1501 bp, Oryza sativa
ggatattttcttcataattcaatttaatatgtttactttcacaagtgagttacaacttacaagttcagagtaaaacctagcatgatgacttagtgttttccatctttttgaaatagctcaattagtatctggtaccattgcaataatcttaatttgcatgtctgcattttttttgggtaccatttattttgtaatgtaggcaatagaagtcaaaatgtgttggtaagataaggtagtaacgatgtctttacttgctgtatgtatgcaaaacagaataatacatgtttgcatagtttccctttttgatggatttcagctctaatttttcttatcagttctatgagcttattttggggaaatcagaagatattttgcgacgtgatgaagagatgcttttcaaggttagctgcagtgcatgttctaaggatttgttaattgttataacatgcgtacattaattattttttatgacattctattgcatatatggaataggtgtctattctaaggccaagtaacggtttaaccttccgtgcaattgtcaatgctgaagtggttgacatgagtaggaagaacaggtttatcctaacgctctacagctagtcttgcaaatttatgttctaatgtttgtattatgtctcttaattgacagatggcctgtacctaaggcggagtggctatatccatgtacggacgatagatgtgatgaaattgtcgcgcctgatccgatagttattcgaacctgtgaagatagctattatttacgtaaggatcttatttcttacttttcactatattataatagattaatgaactaaaatgcgtcaaatatataacattgatatggcctctgtcaatttgaatgaatttagtctgtactgcagcttataaagctgtcccatactatcagtctaaactgcatgaaaaccacactctgtttctaacattttttcttgttacatgacgttaatgttttacaatgtgtttaaacactatttttttgccatatctttcagccgcccttgatgagtctgaactaagactatattacggtgaagaatgaggtggagaaatcttgcattaatcgagaagaaatcttgcattaatcgagaagatatgctgagatacttaatggaacatgcaccgcaagtttttgttgacattcatatttggcaactgaatagggctacaggagtgaaaaaaaattgcatgtctactaatattagcaaattgcatcctttgccagctgagtaatatgaattgtgttaatgcggagttgttccagcaagatgttttgtttggcttttctgtttttaacaagtttatgaaagcttgggtagtatagcatgatttataaattataagccttgtgacttgtgagacgcaagtcctatcgcatacgcaaaaccctagccgcctccgcccgcatggccgcatcccctcctccctcgtctcgccctctccctctctcgccgccgccgccgcctccgcttcgcgccgt

SEQ ID NO: 41955 - DNA, 731 bp, Oryza sativa
ttaaattaaaatttaaatgaagaaagtcgcaaatatccatttaaagagcatataaacttcaaatgaccataacttggccatttgaactcggaattggaccgttcaagtctctaatttttccttaagaagccaagaacccatttttgtgctttatttcggtttgttatatggagtttagtagagtaaaagccttttcttttccgttggtcgtgtagacgctgcagcttcggaagatctgctcttcgtggaagttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatggctatttacctttgttatgaccttattattattgttattgttattattaccttgttcaccctagaaccaacaaaaccccaactagtggacactctactcatggtaccactagtatgattttaggtagatgcttccctttaattaggtaacattaggtggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatataaggaccggt

SEQ ID NO: 41956 - DNA, 1501 bp, Oryza sativa
gaaagcgagcaaggcaagtcacatcatctttgaacatattgaatcccagtttgtaaaattatgttgatttaacttattgcattatcgctttatttaaattcccgcgttatcactgttttatttagccatggctatttacctttgttatgaccttattattattgttattgttattattaccttgttcaccctagaaccaacaaaaccccaactagtggacactctactcatggtaccactagtatgattttaggtagatgcttccctttaattaggtaacattaggtggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggattagagatggacgaagtcgggggtggatggacatctctaggacaaatgaaggctacacgggctgcggttcggtagtcgagatgtcatggcacagggcggtgtcctgctgctaggggctcagtcctgcctacctgtcccgggagtttcggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttagcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggttgtactgagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgcgtgtgctgggccttcgctgcccatgtaataaattaactatttacgcttccgcttgttaaactctgaattgtatcaatcggctcggtcttgattcaggagcttgaggggaagg

SEQ ID NO: 41957 - DNA, 309 bp, Oryza sativa
accattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaata

SEQ ID NO: 41958 - DNA, 482 bp, Oryza sativa
tgttatatccccaagctaacaaaggaacaaggtaacaaatagtatggctgagacagtaggtaatcatctcatggtagcattgtaaaataatgcagtatttaaaggaaaacaatagggcatttgcaatatacgatcaacatgtccaagtgacaagcatgacttgccttgctccgctgttgaagggacctcggctacaacttcgaagtacaccggagcgtcgggagagccggattctacacgacatacaaggcaaacaatgcagacaggctataaggctactgaaacagagaacaaaaccatttttaacggattctttgtatttttcttgatttactgagccttgaatgggcttaaacggagctcggatgaattttctatgaattttagaagattcactgtgtttttactataaacagaaaaatccttaattgatttattgtgcaattattaaaccctggagggagagacgggtggtgccgaca

SEQ ID NO: 41959 - DNA, 1501 bp, Oryza sativa
cccggtgattattgccttcattacgtcgtgggggtgaccgggggtctcttcatccccggttctctcggcggttgcaatttttatggtaactggatgataccccgcgcgttgccgctggaattgaaggggaatcgaagtcaaatttctctaggttaatataaagatcagtatatttgtaaaacgtaacagtaaccaagagagaaagtactaagatatgaagagaatttggagctgtatttgcatggtgatacattagattaagtcatcaagttagttaaatggggaatatccatataacatttattcataaaatgtatatgtaatcgttgcattgtgctgtctggcaaaagtgaagtgatgcaatccaagtcagacatgcacgaagacctcttttatcttaattaatttgctcattatctttttgttgggcagtgtactgcacactgtagagcgtagacgctgagttcaggtatcaaattatcaatgcaagtttcttttaacttaattataagaaaaaaaatgactattgggactaatgaatctcagaacagcgtatgatcgagtagacaacaaagctcctctagcattcttatcatgcacaattagataggaaaaatattgactaatgattatgatcagaatcatatccaacaccaagtaacatttctaattcagaaaataggacagcaaaattttaatggcacgctgttagtagcaatacgtgaactaaaaacagccatagcttaggctgtatagaccctcacaaggtgtagaggccgggtttattataatccattatctaaaaaaacagccatagcccatagctaatgcagaataacggtcctagtaaagaatagatgcaaaattgaatttaccgagaaacgttaagtataaaattaatctagaaaaaaaaggcaaaatcaatcgaaagattaaatccatagcaaatgaagatgcgccaaaactttcagcatccacctaaggactcatttaaatctagcggacataacacacaacacacacatcacatgatagcgaaaatagtaagcgcacctgaggttctgcttgctagagagattagttgccatgcgtacgaatgacctcgctcactctgtggtatctagcgaagtgcaagactccagccgccgccggatgacggcagactcctctccttgcagtgaacctccgatcctacaaccgccggatgcatgtctgggatctggattttggaggcactgcggcacaggcatggcgattgcaggcacacatgcaatgaggatgaatccgactcgtagagatcgatggaatcatatagtaatcacgtagaagagtgcgaattaattaaggatattaattatccgacgctacatctacgtaactggtgaaagttgggaaaaagtgtattgctgttcggatgcatgagttacgcaggatgaagagatgaagcgacgcaacggcgaggcaccaccactggtggagaaaccctttgtagtcccggttc

SEQ ID NO: 41960 - DNA, 806 bp, Oryza sativa
gtaccaacataccccaataccgtctatatccggtctacgggtgccacccgtcgacaaagataccataatccttttcggcagacttttgcccgaacatatctctaaggaaattacatgaaatatcctaattaatagatacaattgccttctcaggattcaatccatgcacggcaatcctcatgaagcatattaactcaacccgacaacatgtaccacgtcacattgtcggtatcggctgaatcagccaacctagtccgactcgaattctgccgatccttgtcatagccgattcgaactttagccgatcctcactctgtttctagattaatttctatcttgaattccgcttcgatcctatcttcatctctgatacttggattaccaaatttggtcgttaacacatgaccccaagtccggaatatttggtaatgtttcggatttgccatatctcatctccgagagaatatcgcacttccgtttttccgaccgttatcgcgctgctttaaatactaaccgtcgtccccgagaaatttcacaccattagctcctttttcaccgcttaagccaacttcgtcctctctctctccggcgatcccctgggtgcaccagacgaccctaagatgatttcctctccggccaagcatccgctcgcaaagatgtcgtcctccgccagtccatccgtcgcgccatcggaaaaatacgcagagttaagtacccatcggctagatcctcttctttcgcaatagattggttcttccttgcctcatcttattttcttcttctctattcttgtttacatctgtagc

SEQ ID NO: 41961 - DNA, 625 bp, Oryza sativa
taatgtttgttataccctaaagaaccgtgtgctttctttttatgtattgtaattgcttctttatagggtttagctttgcttgtgtgcttcgcgtagcttctgtcgttccggaaggttctcgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgacattattattgctattgttattattaccttgttcaccctagaataaataaaaccccaactagtgggtactctattcatggttccactagtatgaatttaggtagatgcttcgctgattaactaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgttagtagcacctcggccacataaggaccggt

SEQ ID NO: 41962 - DNA, 1501 bp, Oryza sativa
ttctattagaatcattgtaattaaggctattgtgtacatccaaagaagccactgagaatgcatcagactctttaggggttgtgtgcttaaagaatttgtgattgacttcccaaacacttttctcttatacgtcagttgtttcattgctattatttcagttttcatttgcttcattcttaccatcacctgaggccctgagctggctcatggcatatatggcaagccaaatacatactgtattcaggatatataaacataataagtgatattagagccaaggcaatgtcaatctgatttacaaaagaattagcaatgcatcaggtgccacaaattcaggaacagccttaaacaatgtggccaagcagaaaaacttgatagcaatgaagtcgtattaagtgagagctacaaaaatctcccagtttttttggctactgatgtgataaatgaatcttgtgttgcatgtacttatgtgaagttgtatgttgatctagttgggaagcgcatgcggaaatctccgtcttttaacagcatgattattatctatgcaccacaattaaaatttatcggacatgcatttttctaacaagggtaatttggatgaaatacctcctgcagtaaacacatattacacagaagctagctatgtgaatagagaaacttacacacgataactgaatgggtggagaagtgatcgatgataatcttcagtttgacagacaagttatatatggtcagggattagccagtttgatatgtttgaggggatgaatgcaattcatgcatagttaagtgccacacacaaatatatcaacatgcatgcaaaatctgatgcaatgcctcccagagggttaaggaatcaagaaaagatgtcattcatctgatacctgcccagcagcaagtaaaggataaaagtaaactattctcctttttttccccaaaaagaaagtggagtataagagtcaaatcactaacgctgtatcactttataacgatgcctcattttccttttcatctacaataatatatggttaacatcacatcacaacccctctaaaagaggacctagaactgaactcgtataatctcattattttcccatctaattctccctaacctccattgctccacttacacatgggcccacaagtttttttctcaccaaacaacaaagaaaatagttgcatagattccaggaaacttggtcctgacatctcccgcggtcctgcggcatatgctaggttcaaaactccaggaaaaaaaaaacagacctccagtacatgttttgaagttgccatgggtagccataagcattaagatcccatagactgtgatgttaattgaatcatcaatctacagatatttaagacctcgctggaacccatgattctcaaggcatatgaatagaaaaggattagagtgctccaactcctacggagcgttgaaaacatagaagaactgcacaacaaatagctgtttgaatagagcacatgaaaaacacaag

SEQ ID NO: 41963 - DNA, 1501 bp, Oryza sativa
tcaagacaaatctattcatataatttttacattttcaaactcaataactcgagagttattcatgatttatattttcaaggtttgacttaaacattgtcataaacgattttctttacgagtacggagagaggacatgatttatgattaaagtctgttgaaatcaatcatttggaacatgctattatatgttttttttaacttactcagacttctctgtaatttttttctggttccatcactgacaatgatttatttgctagccagtagggtccggacacgtgtcatattaactggatatgcttatctcggagcatgttgagctgctgaccaggacaaattctttctagtaagctttgtcatcttctttttctcccatctgaatgaaagcgttgtcgcttttggggctttctgcatcatataatgttcacctgcaggtttgctgatctgtaggatttctcattttgtttgtgtctgcttgacaaatgacagccaaaatttattagtgattactccttttgcctcaaaagaaattagtgattgctcttttttttcctacaatgaagtacataatgtctaaaatttcagcatccatgttgtttttgataggtcagcattcatgtgttacctaacgtgaaaaggaaatcatggactgatagtccttgcatgaaagatggcagcattcgtctggaaaacatattcggttcagaaaattcatatgccatatgttagcttatgtccaattgtgaaattttatgcaatcattgggacaccattaaatttcattacgacaaaactttgaccaacaattattctattataacatattttttgtgaagcaaaattgatgtgattggattaattttcaaaagtacttttatatgattatacttttgtgtccataatatattagagaaatgtagggactaacatgggataaacaaaaatattcgaaggattttatacctctgaatgtatggacggagaaaaaaaaaactctgtttttagccccttctcgctgcttggagtctgtttttagccgccgtagtttctctatgcttaagtttttttttcttattttgctttttcttccttcccctagcataagccagtctggttgattgcgtggtgtaactaaaactctttttcttctaatatattaacgtgcaatttttttgcgcgttcgcgaaaaaaaaaccctactatctcagtagattcattactcgaaccagattgtaaactgtgaaattcggttcgatatgaatgaattctgcaaaattacatgaaaacccattcatctatgggccttctgttgctctcttcaacaactgtatgggcccaagcccaaaactgcccatgggctacaaacgaaggcccaatttggcctatacgatccacacctgaagcaacaagaaccagaggagacgacggtggcggcggctggggagagagaggagaggagaggagagagaggggaggagaggtagaggaggcgagagctcga

SEQ ID NO: 41964 - DNA, 1501 bp, Oryza sativa
ctataatcaactcttagtttcaggttaaacagagctaagtgttggaaaaaattcaacccgcggtgtttaattcttctctcacggcatcacacctttaattttctttacatgttattaataaaattaatcaactccatatatgacttgatatgtggcaaagtggtagcgtagcggcggtcgtaatcaccttagatgccttagacacgacgctttgtcacgcgtgcaaaaggcaaaaagtgcagacgtgcattgtgtagcgggccaaaaaagagaacttcgaacgctttatttataagaaaacaatagatccgatgatttaaataatgggtccactggttctagtgtaagtgtaaattagttaatatagattttaaatttttaatttaatgggtatataatataatagtgtagactttattttgaaactatgcattattggagaataatagtccaatgtaataaaaaataaatccagtgatttaaataatgagtccatcagcttaaatgcacgtataaattagttaatatagatcttaaattgtttatttgataggtacacaatataattgtgtaaactttatttttaaatagtgcattattggaaaataatagcacaaagtaatgagtacaccggtttaaatcaaaattatcttacattattattaatttaatgggtaacatataatggtctaaattttattttcaaaaattgtagagctaatttagttacatgcaagttgcatgatggtagattctttgtttgtaaaatataattatttaaaaaatatatatctattatataaatggaaaaagaaaaaaaggaaaaaaagaattgaaagaagaagcgtacgcatgaattatgattatttaaaaaaatatatatatctattatataaatggaaaaaagaagaaaaaatgaaaaaaaaaaagagaaaggaaagaagaagcgtacgttcatggtcgtatatatctagggaggaggagaggtggggcccatagtatttggtttggtttatgttaagatcaatttcatctaacggggtataatattggacccaccaatttaagtgaaaattaaggggtagatgttttgcttttttcttagaatttctaggattttctctaatttattagagcgccacgtggcgacttgagagcgtttgtaggaagtttaatggacttttagtatataatagatagatagatagatagatagttacatactacactattaatatctggtcgcacatgtcatacacacaatgtgtcttgcagttcgtgctacagttggctgcaaatctgtaacccgctgctctcctctctttttatttatcttcttaaaatatatttggagctgacttataacctgctggtatacatgctctaagagaaactatagattatccccgatgatggacagaatcacaggaggttcactagcagcttagcttgggagattgaagcccacaaggtggatagaggatttttttggaggcggaga

SEQ ID NO: 41965 - DNA, 548 bp, Oryza sativa
  unsure (1)..(548): unsure at all n locations
aaccgctgcttcttgccctatggtnggtanttcaaagaaaaatctctgggggtccaactctcgaaatccagtctctcttgggtgaggcccgtgattctgaagccgtcaaaaaaaacctagctcgattccatgaccggaaggcaaagttatcaaggttttaatttgcacagaattctccatctgcattccacagtgtcgcacccgccagcctaacttaacggcgcggttagtcgacgtgcttgacaccgacatcgtctaagctatcgaccctaacgtcctatgtgccatctctatactaaccaccgcgttgaaaaccagttgtggagcctcagatattcgacgtttcgccgaataaacagctgcttcctggcctatggtaagtaatttctagaaaaatctctgggggtccaactctcaaaatctagtctctcttgggtgaggcccgtgattctgcggccatcaaaaaaaacctagctcgattcaatgaccggaaggcaaagttatcaaggttttaatttgcacagaattctccatctgcattccacagt

SEQ ID NO: 41966 - DNA, 653 bp, Oryza sativa
ttagacgtttcgcggaaacaaccgctgtttcgtggcaatgggtaagtcatttctagaaaaatctctggggtccaactctcccaaatccagtctctctagggtgaggcctgtgattctgcagccataaaaaaaaacctagctcgattccatgaccggaaggcaaagttatcaaggttttaatttgcacagaattctccatctgcattccacagtgtcgcgcccgccagcctaccttaacggcgcggttagtcgacgcgcttgacaccgacatcgtctaagctatccaccttaacgtcctatgtgccatccctatactaaccacctcgttgaaaacccgttgtggaccctcagataatcgacgttttgccgaataaacggctgcttcctggcctatggtaagtaatttctagaaaaatatctgggggtccaactctccaaatccagtctctctacggtgaggcccgtgattctgaagccgtcaaaaaaaacctagctcgattccatgaccagaaggcaaaattatcaaggttttaatttgcacagaattctccatctgcattccacactgtcgcgcccgccagcctaacttaacggcacggttagtcgacgcggttgacacccacatcgtctaagctatccaccctaacgtccta

SEQ ID NO: 41967 - DNA, 296 bp, Oryza sativa
cgacgtttcgccgaaacaaccgctgcttcgtggccaatggtaagtcatttctagaaaaatctctggggtccaactctccaaatccagtctctctagggtgaggcctgtgattctgcagccgtaaaaaaaaacctagctcgattccatgaccggaaggcaaagttatcaaggttttaatttgcacagaattctccatctgcattccacagtgtcgcgcccgccagcctaacttaacggcgcggttagtcgacgcgcttgacaccgacatcgtctaagctatacaccctaacgtccta

SEQ ID NO: 41968 - DNA, 1501 bp, Oryza sativa
gagatgttatttttcttccaccatcctttaattttcttctatttctttcttgaagtggatagaaccaattacttcatattataggtttatcttgcattgccctctccattcagttatctttaattcagttgtgtttcgaggcgtgctacagctcctgccttgtgggtttaattaggaatggaaatttcttactgatgcaggtttggtctcttctgtgcatggggtcaaccccaggatggtgatctgcatctatggcttccccaccaatgtcgctgccatctaggtacgaatcaattcagtccaatcatctcctctagcatctgttcttgatataggaaaaaaaagtatttttttggtagatcatgttatgtgatagtcgtccatgacctgttctacttccttcctcagcatttactgttgtaggtttccacattcactaggtttccatactcttaacacgcaagaagtagagcccaaggtttcttatatattttgcctgttctacaagaggattgagatgtttagtgtaatcctttgtgactcatggacaaaaccatgtaggtccttgttgatatatatggtgatccagaactccttgttgcatatggtattgttttttcttttcctttgtgcacacttagtttgtgaggcagttgattttgaccttcctttccatagaaaaaatatttccttttatgttgttttaaattccatgtgctaactcagatttattgtgattagttgttgttgtgctaatcttcaaatgtttagtatattttgtgcattttgatgctctattgctctgcaaaccatggcttttgaatgcactattttggttggacaggtaaatgtgttgtaggactattttagctaggattcataaactttgcactacacatcgctgctggtttttgtcctaaatagggacagttatttaggacataatttgaagattgaatttttctgctatttgaatcacaattgagttgctggtgataaatgttatccaaggcttgagtgctcgacactatttattatttcattctttttctgatattcctctagcaatttgcattaaaaagtttctgatatttctcaaaatgtacataaaataatctttagtcaaatcatgaattcgttgacgtgtgattggttatattgtacgaaacaatgctctctagcagtcatgcaaggtgttcaatacatgtgtcttggatattgaaactagattccatggtttacatctcaatttttttgccgcaccacatgagttaacctctttgcagcttgctgcatataatttacttgccacgattaattacccatacagcttaccacgaactaggggaataacctcattatggaaaatcaagacaactttcttaatgttgtatcttgatgtgcattcttttgaatctaggcttatttttatgcagttaaatttatgatttatactcctccaagttccatcagcccgctttgtataatattatgctttaga

SEQ ID NO: 41969 - DNA, 1501 bp, Oryza sativa
tatgttaggctggcgggcgcgacactgcggaatgcagatggagaattctgtgcaaattaaaaccttgataactttgccttccggtcatggaatcgagcaaggttttttttgacggctttagaatcacgggcctcaccgaagagagactggatttgcagagttggacccctagagattattctagaaattacttaccataggccacgaagcagcggttgtttcggcaaaacgtcaaatatctgagggtccacaactggttttcaacgaggtggttagtatagtgatggcacataggacgttagggtggatagcttagacgatgtcggtatcaagcgcgtcgactaaccgcgccgttaaggaaggctggcgggcacgacactggaatacagatggagaattctgtgcaaattaaaaccttgataactttgccttccggtcatgaaatcgagctaggttttttttgatggctgcagaatcacgggcctcaccgaagagagactggatttggagagttggacccccagagatttttctagaaattacttaccataggccacgaagccgcggttgtttcggcgaaacgtcgaatatctgagggtccgcaactggttttcaacgaggtggttagtattgggatggcacataggacgttagggtggatagcttagacgatgtcggtgtcaagcgcgtcgactaaccgcgccgttaagttaggctggcgggcgcgacactttggaatgcagatggagaattctgtgcaaattaaaaccttgataactttgcctttcggtcatggaatcgagctaggttttttttgacggcttcagaatcacaggcctcaccgaagagagactggatttggagagttgggcccccaaagatttttctagaaattacttaccataggccacgaagcagcggtttattcggcgaaacgtcgaatatctgagggtccacaacgggtattcaacgaggtggttagtatatagatggcacataggacgttagggtggatagcatagacgatgtcggtgtcaagcgcgtcgactaaccgcgccgttaaggtaggctggcgggcgcgacagtgtggaatgcagatggagaattctgtgcaaattaaaaccttgataattttgccttccggtcatggaatcgagctaggttttttttgacggcttcagaaccacgggcctcacagaagagagactggatttggagagttggacccccagagatttttctagaaattacttaccgtaggccacgaagcagcggttgtttcggcgaaacgtcgaatatctgagggtccacaactggttttcaacgaggtggttagtataggaatggcacataggacgttagggtggatagcttagacgatgtcggtgtcaagcgcgtcgactaaccgcgctgttaagttaggctggcgggcgcgacactgtggaattctgtgttaagttagggtggtttttcttgaataagatgttactcttcctggttc

SEQ ID NO: 41970 - DNA, 1501 bp, Oryza sativa
cactagcttcaacaggattagtggtactagagaaaacaggcggcctcacacgaagaaattctgctaacttgttctggggaggtgcatgattattcccttggttttgctgattctgaaattgctgcatcatcatgttcataagctgtgtttgttgagcaagaacttgagcaagagtgggattctctccattgttgttattggggttgttgggaccattcccattgctacgagtgttcaccatctggcatggacagggcacaagaagagaaaacggggaaaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctatgacaacgacttaacaagtcactctagttcttccaagcatcggaggtcgattgaaggctcgtcttcatcatcttgggttgctacccactcaatcttggaattgttgcgcttagattcttcttcttcatcactacttaagatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccatgattccggtcttcacgatcttgagctgctaacacagtctccgcacgactttcatccatagcccacaacatctcaaccaaatgtcttgtggtaacataattctcaattccttcagtctcaagataactgccacggtcacttccctggggttggcgaggatggtaacgatactcagtgtcggccaattgatcactgtagcgatcacggagctctcctatggcgatccttgccacctcctgacatgcatggatgtagtttcttcctccagcttcgaacatcactgagggaatatcttcactattgctgttcaaggtgactttgactcggcacttctcttcatgacgatcatgaggaatctgggtataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcaaagtaaaaagggaagtaaataaagtaaaccaagctttgcgaaataaattaaaacatttggaaacgaggtcacaaattttgtaattttgaataactggtttcaaaagagatgaaag

SEQ ID NO: 41971 - DNA, 1501 bp, Oryza sativa
taagtaatttctagaataatatctggggggggtccaactctccaaatctagtctctctagggtgaggcctgtggttctgaaaccgtaaaaaaaacctagctcgattccatgaccggaaggcaaagttatcaaggttttaatttgcacagaattctccatctgcattccacagtgtcgcgcccgccagcctacctcaacggctgtcccaccgtagcgcacctgcctcgctcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttgtttagttttatttctcctttcgcaaatcatgtcatcaatatcgtggcaatgtggtgctcatgtctctacatgccgcatctcaattaccttcccaaaggtaattgcccaagcatatagtatttgataaatatgagtatgcatgattctagaatagcatttctaagcatttgtcatagttgactagggactcatacgtaaacatggttacgaaggaataaggggtaaacaataatcaaggcatggcataatcgcaagtaggatgttcaccattgcatgcaattttatttgtaaacaaacaatttcgcaattgggatcaacatgttcaaggaatagtgatgacttgcctgctcagaatagtccttattcttgatacaatcttgatcaaccttcacctcctgtaagctgcatacgttgcctcacgactaaccgatatacaaattctataatatgcgagaaaaaccaatattcaaacaacaatcaaatatgtacaaacaaaatatagttgttggggttgctcatactactcgtgtttgctaatggattctaatcaaactaagaactaaggtttcttaatctttatgttgtcatggtggtctatataggagctaaccaatgtagggcctgtttggcacagctccagctccaactccacccctcctggagctggagctcagccaaacagttttagctccaccaaaactaggagtggagttgggtggagctctctcacaaaatgtaatagagttgtggagctgggtttaggcagctccacaactccactccagactcaacttctggagttatatttaggagttggagctgtgccaaacaggcccgtagtatgaatgagatacgtatctggctactatgtggtttagtctagcaaatggctattcatgcgtctatctaaatagaatggttatacactagaggttctgttgccggatggatttggattggttaaataattactgtgaatcatttgtattattattttattgatggaggctttattttaattatgtacatattttacttgtaaaaataaattataaaggttaacaattaccca

SEQ ID NO: 41972 - DNA, 1501 bp, Oryza sativa
tgaaaaatattggaaaagtagaactgttctcctccctttctcttttaattaaccaaactaatggcacatgcacttcataatttttttttaatggttttcattaaaaatttattccagtgttattagtactgtacatctattactgtactaatggctcatttatcagcaaaagttttacaatactgttttatttaatcttgctgcaataaaataaatttagtatgttgattttataatttcctttcatctcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatacccagattcctcatgatcgtcatgaagagaagtgccgagtcaaagtcaccttgaacagcaatagtgaagatattccctcagtgatgttcgaagctggaggaagaaactacatccatgcatgtcaggaggtggcaaggatcgccataggagagctccgtgatcgctacagtgatcaattggccgacactgagtatcgttaccatcctcgccaaccccagggaagtgaccgtggcagttatcttgagactgaaggaattgagaattatgttaccacaagacatttggttgagatgttgtgggctatggatgaaagtcgtgcggagactgtgttagcagctcaagatcgtgaagaccggaatcatggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcttaagtagtgatgaagaagaagaatctaagcgcaacaattccaagattgagtgggtagcaacccaagatgatgaagacgagccttcaatcgacctccgatgcttggaagaactagagtgacttgttaagtcgttgtcatagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagttttccccgttttctcttcttgtgccctgtccatgccaga

SEQ ID NO: 41973 - DNA, 1501 bp, Oryza sativa
caaggggcctgaaccagtataattcttgtcttttgattgctcgatgtcgtactacgtagatccttataccggcgtaccccaatactctctatatccggtctacgggtatcccccgtcgacaccatccattgagcaagctttgcgtgaagaagagattgaagaagatgttgatcaagccgcagccgaagtaagtgacacagaaaaaactccatcggcttcatccaaacaaactcctccaactccttctgccccagctcatttctcaagggtaaacatctctctctgatttccttttaaaactatttcattcacagccgatcacttataaatctcatctttgtagaaaaagaaaactgctgtaagaaattggcagcaacaacacttaaaccagctccaccagaaagactattgtgtataattattttcattaatccaatcatagctgatatttacttaacatttgtctttttacagcctcctcccccatcttcacctcctgtacaacaaacatcaagtgattgaactccattggctataggaagtcaccatgttgaggaagaagaacaaccagccgctcctgccatcccagtaagtcttgtctatgaaaatcttgaatcggctgaataactcattttgataatcaactgtcttcaaatttcttcttgcaggccttagccgatctgttctctttcgatatcaaagactatcttgatgaacaaacagaagaagacacccccagcaaggccaaccattccacattttagttgttaagaaaattttaagaattaaaacactaacttgggtacattgctaggcttgcccataaccgagggcgtggctattcgaatagattatactctgatcagaggtgtacatctttacccacaagacacgtcttcctcacgtgtaaccacgtcccaacataccaccacggcatacggacgtaagacatgacatagtgtcacgcccggaaattcactagtaatttccgaacttatttgtgcataaaatcctcgtccaggaatcagccgaggtacacaaactgacaattttaatatacaaatccatcttaataataacgttacatacttaaaaagaaaagaaaacagcagcggaattaacggtctagcgatggcttcagctccactcccacaggcagctcaactggggtataagccaaatgtcttctccttctggatcctttatcttcaactgaggtttgatgattattgcaagaatgagcatatgacatactcaacaagccacacagcaaatatgcaagtgcacaaggataccagaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaagt

SEQ ID NO: 41974 - DNA, 1501 bp, Oryza sativa; identical to SEQ ID NO: 31737

SEQ ID NO: 41975 - DNA, 438 bp, Oryza sativa
ccttgagcatattgaatcccagtttataaaattattttgatttaaattaatgcattatcgctttatttaaattcccgcgttatcactgttttatttagccatgcctatttacctttgttatgaccttattattattgctattgttattataaccttgttcaccctagaataaacaaaaccccaactagtgggtactctattcatggttccactagtatgaatttaggtagatgcttcgctgattagttaggcaacattaggtggttttataactctcgactttgggaatactcatatcacttggacattatggaatggttggattattgtagaaatggacgcacacctccccctctattcaaaaccctcaaaatggttttaggctgggctcagggtgcatggttttgatagtagcaccttggccacataaggaccggt

SEQ ID NO: 41976 - DNA, 245 bp, Oryza sativa
  unsure (1)..(245): unsure at all n locations
agtcaggagttcccaatatcagcacgaaagacccctgtcaaaatgcagtccagatcccggaagataacgacagccaagtcaacgtcagacaaaagnccagtaagtgctacctgttatgactgtggtgagcaaggtcattatgtaaggaactgtccatggaaggtgttcgccaggtcacctgaaaaagacgagaagtagtgcccagggagtaaccaagctccaagtcagtctaccgacaagaagga

SEQ ID NO: 41977 - DNA, 1501 bp, Oryza sativa
agctctacggtgtgttgtgttttgcatattcttgttggatcgacgtatccaacctttgctccagttctatcagcttcgtggaattgcatactgtacaatgaataaagaagaaatgagcggccgtttccccctcatccgaccgccctctctcactcccaaccctatataaacgctccccgtgcctccctccgccgtttccgccactcgtcgctctctctccccgccggaatcgagctcgcgccgtcgctctctctctccgccgtcgccgccgagctccggtccgccgccgtcgtcgccccggaccttctcccgtttcggcgtcgccttcttcgggttcgccgcaacctcgccgacctcgtccacctctccgtttcggtcgccgaccgccggaacgccgccgtccccgtcgacccgtgccgcgccgccgccttcctccgctccggtcgccgttcccgtcgtcgccgtcgacccggggtgagccgtggaccgccgattcgcttcccccttccctcccctctctcgggcgccgctccgccgcgccggtggtcgccggcggcgaccatcggggcgcgggtgcgccgccttcgggcgcgtcccgcggctgccatgtggggcccggccgtcagccgcccgcgccctcgggtgtggctgacgcatgggacccacggcgccggccggtgtgagccgggtgcgcccggtccaccgtggccccactcccgtggacccggtccgcgcgccctctcccctcggctgacgcaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttggaaaagcgagcaaggcaagtcacatcatccttgaacatattgaatcccagtttataaaattatgttgctttaaattattgcattatcgctttatttaaattcccgcgttatcactgttttatctagccatgcctatttacctttgttatgaccttattattattgttattgttattattaccttgttcaccttagattaaacaaaaccccaactagtggacactctactcatggtaccactagtatgattttaggtagatgcttcgctgtttaattaggtaacattaggtgattttacaactctagactttgggatgttcatatcacctggacactatggaatggtttggttattgtggaattggcttcacaccgctccttctattcaaaatccccaaaatggttttaggctgggctcggggtgcatggttttgatagtagcacctcggccatataaggaccggt

SEQ ID NO: 41978 - DNA, 176 bp, Oryza sativa
gttatccaccctacggtctattgtgccatctctatactaaccacctcgttaaaaccccgttgtggaccctcatatattcgacgtttcgccgaataaaccgctgcttcctggcctatggtaagtaatttctagaaaaatctctaggggtccaactctcaaaatctagtctctctagg

SEQ ID NO: 41979 - DNA, 1501 bp, Oryza sativa
cagattctcctgacgcagctccaggatcttcatgttgttctcgaccatcccacgacgcaccatctgatggaagtcgatacgagccgcatcgtacgcctccaccatgcgcgccaggtgcatgatggtagcgtcatcctccgagctagcatcccggaaggtggcgaagtcgcgggctcctccgcgacgagggtggtagcggtagggcgagtgctgcaactcgtccgggtagccctggtgaagagtgccgatggcgaggagagcggcgctctggcaagcggcggggaaagaatctccacccgcggtgactgccaacgaagtccgctcgggagagccagtgaggatcactgcagtaacctcccaagcagcatggggctctgcatcgtcaccctcctgctccgggagcggcctgccctggtagtccactccatgcggataccccaggacaacgcacatgccccgcagctccaagacgaaaccagtcatgtccagaccacgacggctgacgctgccggccatctacaaacaaaaacaaaaagaaaagcaacattttaaaggtcatattttggcgataaatgaagcagcaggacagagagagactagaggattttcacaaataagaagggatttttattttgaaaatattgctaaggcttgggatctaaggctcgtcctagggtcaagggggctctgataccaacttgtcacgaccggaaataacccaacgggtgttccttacgtgcgtgcattaatccttgtcccaggaggcaaggtacaccaaaagttgatacaattcagagtttaacaagcggaagcgtaaatagttaatttattacatgggcagcaaaggcccagcacacacaaagacaaacgagaaacagcggaagactagggcgatgaccacaggcgcttgacggcaggcacgagctagacaccaaagccttcatcttccaggggctcctcttctgggtttgggaaaaattgagcaagactaagtacaaccaccgtactcaacaagatacacccacaagtgcagaataaatgcaagggagtacaaaggagttatactataaagggttagggttgcagtaaatagcatttaaagatatttagttgctcaaaactatttagtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagc

SEQ ID NO: 41980 - DNA, 560 bp, Oryza sativa
gacgtaagacatgacatagtgtcacgcccggaaattcactagtaatttccgaacttatttgtgcataaaatcctcgtccaggaatcagccgaggtacacaaactgacaattttaatatacaaatccatcttaataataacgttacatacttaaaaagaaaagaaaacagcagcggaattaacggtctagcaatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatatagtctcatttgcaaaagcagcatttagcaaagatttaagataagtaaaacagtagagtagttaatcatcaattttaatcaacactaaacagcacacccatgctgcttaggcccaaccaaacctgaacaaccaaccccggtcgtacagatcaaacctccaaaccatgaattattcattccaaaccagg

SEQ ID NO: 41981 - DNA, 202 bp, Oryza sativa
atattattttagctattcggaaattgaatttcgcatgcggtctacttaagacgcccgcatgcgaaaatagatcttcgcatgcgatcttcttaggtcaaccgcatgggaaaatatatcttcgcatacggctgcgacatgcgggccggccaaccgcatgtgaagatcgattccgcccgtatgcaaaaacgctttctgtagtagt

SEQ ID NO: 41982 - DNA, 407 bp, Oryza sativa
tatgggttataatttgattagcatgaaccttatatattggtttggttcagctaaatgctatatgtatgtttgcttagccatgcttagaaacattagctaattaaaggggattaaatataaattatattatattattcttattaattatggttatatttaatggtagctcacgatgataattaaaacctggttaaggtgggttgtgagcatatggttttgatggttgtgctcatggtaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccatttgcctctggttt

SEQ ID NO: 41983 - DNA, 735 bp, Oryza sativa
aagatgcacgaaaatgctgagaaatgcgatggagttgggattcaagtgcaaaagtgaaagcccatagaagtttaagaccagcaaaaggaattcagaggggggaggaagaaacccgcagacaatgtaatcctcaatcgcaaccatgcgacctaggacgggctggggagtagtacctcctgcttccctctctgccttgtcgtggccagggaggccaccctcctcctgaagtttcttcagggtcgcggcggtggaggtcgacttcccaagatccatggccgtcgggagatcgccggaagatcgccggaaacggacgatgaatcggtgaggctagggctttttgcggcggcgaggaaggcgaggaatgcaaaggagcagtgtatacttaatgaagtaggcggacctcaaagctcacgccctaaatacctttaaatagacgcactcccgacggtgcgaattccaaggaaataggagaaatccccgccggagatttctatgtccgttgtgcatggtggtttttggacttcagttcaaaattcattcgtgaccgttggacttcaaacggtgcgctcgattacacgtcatctccttggttctcgcacctggaatggcaacgttctcgacacctggagtcgcaaacggtctcacgagttcatttttgagcagaagtcgggggctactgtcagggttacgggttaggcatacccttcaccctacgatatacgtcacgtatcgaca

SEQ ID NO: 41984 - DNA, 897 bp, Oryza sativa
acgccggtataaggatctacgtagtacgacatcgagcaatcaaaagacaagaattatactgggtcaggccccttgacaggtaatagccctaatccagttgatatgggattatatggtggaaaacacagattacaaaggaaaagacttaactcgggagattcgacgagatcgtagtcgagatgatccgactagctctcgtcgacttggctctttgtaggctctgacttcgtaggctgtgttggttgtctaggctttgagattcgatgagctatggctccgcggggggtcccttttataccgtaggttgggcgatatctgagtaggactcggatgtaccaaacctggtacgatacgtaggtaacccaattcttgttcgagaaggtttctccttgtttgttgtctttacgaagaatttccttaagtgctagaggatttatccatatacacgtggatataccttgtcgatacgtgacgtatatcgtagggtgaagggtatgcctaacccgtaaccctgacagtagcccccgacttctgctcaaaaatgaactcgtgagaccgtttgcgactccaggtgtcgagaacgttgccattccaggtgcgagaaccaaggagatgacgtgtaatcgagcgcaccgtttgaagtccaacggtcacgaatgaattttgaactgaagtccaaaaaccaccatgcacaacggacatagaaatctccggcggggatttctcctatttccttggaattcgcaccgtcgggagtgcgtctatttaaaggtatttagggcgtgagctttgaggtccgcctacttcattaagtatacactgctcctttgcattcctcgccttcctcgccgccgcaaaaagccctagcctcaccgattcatcgtccgtttccggcga

SEQ ID NO: 41985 - DNA, 1501 bp, Oryza sativa
tattacgagagttagctaggctgcgttcggtagttggtgattgagagaagatttctctcgttcttcacgagcacgttttcctaactgctaaacaacgtatttattgtaaaaaaattatatggaaaagttgttttttaaaaaaatcatattaatagagtaactagtacaagcgcagcgcgcgctaagtactactccaagcatgcatcagccaggctcaccattattagagtaaacaatttacttcgataaagcaaattttctacttccggtatatattctatttttcctgtacccgaccaacctctttctccaccacacttcatttttttatttttttgggatctgaatcgatccaccgtcccaacccataaatcggtaacgcaccatgcaggaggacgatgcaccccgacggttgacagcggtggtcggcgagcgatgcgcaccagggaggaggatgatgacaccatgacggttcatggtggtggccgacctttttttatgggggggcttcccaccctcaacctcgtccgtgtgctcccccatctcgcacgcagcgaagacgggagaaccagccatcgccatcgtcttcatcagccccctcatgtgcgtacgcgcctccctttccctctcctggtggcagcggcaagccgtggtctctggatagtgagtagagacatgctcaatcgacggatgcaagaggggatggtctctagccagcggagttcgcttctccttccatcgccaccacaggtgagcccatcaagcgattgattcctttctggcaatttagtgcattcaccgtcggtttgtcgctgtacgtttcttggatggactgcactgcagtgctgctgcctgaaccggtgaggtgaggcgtggagcataaaggccacgatgaagctccgggcctcgccgccggacgccgggcagtgccttcgccagcaagggggagatgttcacccaggccaagagaaacaaccagcgggtactccacatcatttaccacggcgacgacattgactggaggagttaataaggtaatggcaattccatttggatatggatattatacttcacattcacgcatgtaacaccaatttcttttttaaaaatcaaattagcgtgcaatctgcacaattaccttatctgaattgatgtgctgcataggttctacatgtgcacatcgttctccatgtggctggctgcagagtatatggtggagtcagccggtgacaaaggttgtttgcttttttttttgctcgtcgtctctgtgacatgaacaagaatgtttttttttgcatttttttctggttgctagacgatggatggccttatgggtattgccgagctcatctctataccgcgccactacatccttccgtgattccatagcccaccgtcacttgccacccggttgccttctccaccaccagtcacaagatatagaccagcctctcgatccttgtcgcaagatccagcaaagccactaggatcccaacttcaa

SEQ ID NO: 41986 - DNA, 1501 bp, Oryza sativa
aactctcgccactggccgagctgcagcgcgcgcagctccttcttcccggcgaaccaggcgtcgtcgagctcgaggtatttctggtcgatgttgtagatggctctcgcctcggcgctgaaccccgaggacatcctgccggcgttcaggcacgcgcggcgcgcgagggtgaagtcgttgccggagtcgaggtcgaggaaggcggtgcgtttggccacgccggtgaggaggtcgcgcatccatggccgcaccgtgcagcggtggacggtggcgcagagatggcccgggatcgggacgatgaggcccttggcgatgagctcgtcgaagcggctcttcccctcggcggcggagcggacgaagccctcgccgagccaccagtggatgaggaggcgcttcttgatcacggcgcactccgggaacgcggcgagggtgagcacgcagccgcggagccgcgcctcgaagccgccgatggcgaggccgaggtgccgcatctgcgggccgcgacggatctcccccatcctcctcgtcatcaccacgcccgtggccggcgcggtcgacggcggtgggggaccacggcgttcgtcgccgtcgcaggggaacctgtagacctcgcggatgctggccttgatgacctcgatgtcggcgtccacggcgaggagagcctcgtgtacctgctccacgtcaagcccaacctgcgcttgctggagcgcgtcgtcgatctgctcctcgacagggtcgaagccgtagaggatgctattttcggcttcgtcaatgcggcggaagacgcgctggaggtaggacatctctccttggaccttctccagcagcgcgcgggcctcgaccctagcatcctcttcggcgtcgcgcacatgcactggtagacgacggcgacttggagccggcgcgttgtcgaggacggtcctgatggttgctagtcgggcgaggagtgggacgaggatgtcctcctcgacgccgcgggccgcggggttaccacgctccttggactgagcgacagacatggcgccgtgatcgggactgaatgactgactagcctctttgcgatccggatcccctacgttaatcccctacacaagggtctgttctgggacaggctaaatccaattcccccttcattttcaatttaggtgaaactaaatttgtttagctagacttaattagctctaggagaaatgaagttgaaactaaagctctgccaaagagaccctaaatctaagtctctatttacccctaaaaatttggagagtttgattgatccattcttcactcagtaaattgataatctcatctctatgctcccaattgataaagctcctagatcagatggttttaatggcctatttgttaagaaatgttggcctataattacacatgacttttaaaggcttgctgcccactttcatgcagaatgcactgatctgcaatgcatcaacacatcctacattactattgttcctaaaaagctttctcctcaaaaagtaaatga

SEQ ID NO: 41987 - DNA, 1501 bp, Oryza sativa
tatttccattacaactgcataaagttgctattggcaataaaagaggtgaattttcattgcagcaaatgattttttttatttatcaaaaagggggacaaattcaattgcaagatggaaaaggaaccatggattcacgtcgaaaaaaaagaaccatgagggatttaccagactgcttggatcattgaaccattgtggggtatcaaatttaggtaaatttggggggaaagagaaaagagtagggagattatggactgaagacaattaagatatttcttcctcgtccctcaatctacattacaaattcaagccctcagcctgcttccgtgaaagagagatgagtgaagtagatgcatgcaagaggtgagagaagtaggagggtctagatacagatggagaacagatcggggaacacaagatgacatttgggtaagaagatgcattttctagagaaattagatttggaatatttgtccatcctactcgcggagaagattgcactgatcttgtttcttcttttttttcatctcaaaaaagtgcactgatcttgtttcaagattcaatagaaaaagaaatgaacaagccaactgggaatctctttcatttaacaaaaacattaagagagagagggtaagggagagaaatagaggttttttctctctcgaaaaagtgcactgatcttgtttcaagagaaaaagaaacgaacaagccaactagaaatctattcttttaacaagaacattaagagagagaggggtaagggagagaaatagaggaagggaacacaacagttgaacaacaagtcaacaacatataagtcttcatgaacaaattttggttaaaattggaagaataagaagaagttcaaacaaatcttctaaaacaaaactaaaaactctgaagaagatttggaagaggcaatatgcaacattctggaagagggcagagagagagaacggtagagaatgtgaacccctgaaaccaagcatccaaatatttgaccactaactacacccaccagtgatcctggcgaagatcatccggttgccgcacaccaacgaaatttctttggatgaataaaagatgtgattaaaagatgattgaacaagaaagtttcttagactctatttagatcggactaaaacttttaaatccctttcacatcggatgtttgaacaataattataaatattaaacgtaaactattaataaaacctatctataatcttggactaattcgcgagacgaatctattaagcttaattaatccatgattaacctatgtaatgttacagtaaacattctctaattatggattaattaggtttaaaaaatttgtctcgcgaattagctttcatttatataattagttttgtaagtagtatatatttaatactctaaattagtgtctaaatacatagactaaagttaaattactggatccaaacatcaccttaatagtagtactacccaacacaaatggaagactggaagaggggcagct

SEQ ID NO: 41988 - DNA, 1501 bp, Oryza sativa
  unsure (1)..(1501): unsure at all n locations
gagcggcgcaatccgccgacggaggtaatcgccgtacaccatggccccggtgagcccctgggatcgcaggcccgccaggcggtcgaggacggcgtcgtactcctcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgtggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccacttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgaggggggggtcgggttgcgcttgcngnggcnnngagggcnggggcaccccgaccccctttaggaagtctgcgccacgta

SEQ ID NO: 41989 - DNA, 1501 bp, Oryza sativa
acgaagttacctcaatttctattttaaattactcctttaaatccactaaacattgtcccccaacgtgtatcaaaagggcacttctgtgtgatgataaagttagtgatagtcatacatcaaaacccacatatcaatgcagataagctgccacagctgcaaccaacaacatcataacgcaacggtaaacaacaagcaagcaaacaggctattagaagtagatgacgtctgtttacagctctgctcgaccggtcaatcgcgcccacactagggtttaccagactgtatggttattgcacggttattacgtgtggtaactttttcagttttgaaaccacggtatatctcgtgataaccgtatggttaccgtggtaaccaccaaaccgcgaggtagcgataacctcaccctcaccctaatctgtttggtaaaccctgacccacactattgctgcctgcatcatcggatatgtgggattgtgcggaacttttattatattgtttcaacgtttctaatattttatttgtaaaataagccctccaaaacatattaacttttcgaccgcaccatatcatagagggcatgacaaaaataaagagacgtgacaattttatgttggacaaggtagaagcattgttttgtcatgctagtccaattggtgtactggtgtgaccaaaagacttagatataaaaataaattttagaacagtttatttttaaaatagaaatagaaatgttaagaaaatcgactgtgggactggaggataaaagaggtctgttcagattcgttgtactagattatgtcccattcaagttctaggttggctttttttatggagggagtaggagtttgtgccaatacagtctcttgcataactacctgctcctctctctcacatctcctctctatcctccacatgagataatgctgagctggatagttttatcgttagcttaaacatttttattgtatttgttctaagggtgttgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcggcacggcgcgtccctttatccggtctgtgaccagtcacagaccggtcagatcacgggttaggtggcgactggcggtctgacgcacgccatgccccatcccgtcaagacgaaagcctctagtcccttgtttccaaccggggtttaggggggttttttttaaaaaatgccaggttagacccggtcgatatatgccaggcttcatcttaaccattacaggcaaga

SEQ ID NO: 41990 - DNA, 268 bp, Oryza sativa
ccgctacctttgatttgcgttctctgcaagtagttcatcagtggaccctcatatattcgacgtttcgccgaataaaccgctgcttcctggcctatggtaagtaatttctagaaaaatctctaggggtccaactctcaaaatctagtctctctagggtgaggcccgtgaatctgcagccgtaaaaaaaaacctagctcgattacatgaccggaaggcaaagttatcaaggttttaatttgcacagaattctccatctgcattccacagt

SEQ ID NO: 41991 - DNA, 1501 bp, Oryza sativa; identical to SEQ ID NO: 31735

SEQ ID NO: 41992 - DNA, 1501 bp, Oryza sativa
ccttttcaaccaagggccgatgatccccactttacttgacattaccatgatcaccggtttggacgtgacctcatcggctaaccccatgagcttaaacaccaagaaccagttcgacttcagaactaagagcataggtggctggtccggctatgtagcaacatatatgggaaaaggatttgtcacctcctgagaactcgaagccttccttctgatgtggcttgagaagtttctcttttgtggatcaagttgcggccccacaaccaactggcaatttttagccgaagccctggaaacaaagaggcaatttcctttaggcaagatcctcctcggctatttgtatcaaacactgaacaacgcatcggctaagattgctatcggctcagttattagtgcaagcgggccatggtggttgtcgcaaacttgactaaacctgatagccatgaaagctgtcaaccggccacctgtgacagaagctgaattcccaagattagagccgactacaaatgatgatggagaagagcgcacccatcgcaaatgtatgtcctatggagaatatgcatccacaccagccgatgctggagcaaaattatcggctgagctactcaaggattggttctgcagcttttatgaaggctttcagaaagaacctcaggtttggttcccttatgaagactcattgaatcttgatctcccatcggactttagatttgaagatatcaatcatgagagatatcagaaatccagagaagtcttctcagctgcgatcagcccatgcatccttcgtgttggcatccaccaaggaagaaatatacaagtgtccaacgaattctaccatccgatgagctcagccaggcaatttggaatgggacagctaccaatcggcatgttctttgccgataaaatccaatgccgaggagatatttcatcaaccctgatgatggatcggctactcaacatcccaagacctcctttgggcatcattgaaaacatagagctggcaaagttcaggagcaggaacttcgatagatggtggggagaatggaaacaacacatattccatcagtcggcttccatgtatatgacagatctgttccctgatgttatccctccggtacacctttactttgttaatttcgcttgaataattgttagccgacttagatcttgactgacttttctttgtcttgcagacaacagaatcttctcctccccacaaaaggaacagcggcagggatatagagtatgctccaggcctcttgccaactggtggtggattaacccctccaggcctctgcttcaatggcaaatgagagaaccaaccgatgttggcaggaaaagaaagatcaagacactggcaattgatccatcggccctagctcctaagaagaaagctaagaagccaaaacccaagccatccgatgacctacctaccttagatccatctgtcagggttacgggtcaggcatacccttcaccccacgatatacgtcacgtatcgaca

SEQ ID NO: 41993 - DNA, 280 bp, Oryza sativa
ggcctatggaagtaattttctaaaaattctcgggggttcaacttctaaaaatctagtctctctagggtgagggccgtgattaagcagccgtcaaaaaaaacctagctcgattacatgaccggaaggcaaagttatcaaggttttaatttgcacagaattctccatctgcattccagtgtcgcgcccgcaagcctaccttaacggcgtggttagtcaacgcgcttgacaccgacatcgtctaagctatccaccttaacgtcctatgtgccatccctatagt

SEQ ID NO: 41994 - DNA, 567 bp, Oryza sativa
agggtcgggttgccagttcggtctgaatcatcgtaggccttgggttaaggcaggttcgtgaggggtcacggccttgattaataatactgtgtagctctaggatcgtctttttaaaatggctttgggcaagtaagtgacttttaaaagctgttttctgcaaaacttaatccctatattatcaccccttgtaccccttgcattaatcatgcatccgccggtgtggcttgctgaatactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaaggcaattttctcggtcgcgacaagatggcaggtggtgacagaga

SEQ ID NO: 41995 - DNA, 1119 bp, Oryza sativa
taaaaatctggcagatcagtttaccaaggggctaccacgtaatgtgatagacagtgcatcgagggaaatgggcttgaaacccacttagagttgcacaatagtggaaacctgtccattgtgatcggagatcccgtgaatttggatggcgaaacaaactattgtgtaaccgagagaagagacccttaaatgggctcattttcatgatgtacttctcttctactctgtgtggtaggatggcttatgcctcggcttttattaagcagagatgttgacctgcaaaacatattagaaggagtacacctatatgagttcgactactagtcacagtctatgagatttgggtgatctctagatactcatgaaaggcctggagtatgacttataagctccaacctgagggaatactaacggttgcctagtatcagttatggaattgagtgaaacctaactgcacaagactgacaattcaaggcatagtccattgttcagttgtggtccggtgtagctccttttctaggtgaaagttcaacttaacagtcttcaccaaaacactggtatataaaagctgctatggaatagagagcattctcatgagccttgaaatttggtggggattgttagatttaattgggtaattgatccaattaaatcaattaaatcatataaattccaaggctcattatgctaggaattcatgtgtattcatcctcttatgggatatcaatgggatgaagagttttgagaattaatccatttgattagggaattggtaacttatatcaattactcctaattgatggatggttgatggttgtgtagtggaggatggttcatggctagttgatgacaattagttgctctattcctcttcctattccatttgtaacctacatcaattactcataattgacggttggttgatggttgtatagtggaggatggttgatggctaattgatgagaattagttactctattactcttcctattccatgactcttactcttcatcttccatttctcatataaaatgagaatggatttgatctcccaaaagagaaagtgagacacactttcatccattttccaacgctgttgctgctacggtaatcccatcccga

SEQ ID NO: 41996 - DNA, 456 bp, Oryza sativa
gtgaagctctaggatcgtctttttaaaattggctttgggcaaactaagtgacttttaaatgctgttacttgcaaaacctaccctttatattattaccccttgtacccccttgcattaatcatgcatctgccggtgtggcttgctgagtactgtggttgtactcattcttgctcaatctttccccccttcagtaagagaagctttggagatgaagtcctaggtggagtcctggcttataccccagttgagcgcctgtgaagatggagctgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggactaatacactagcgttcgggaaaaggcaattttctcggtcgcgt

SEQ ID NO: 41997 - DNA, 176 bp, Oryza sativa
accataaaaaaaactaacttgattccatgcccggaaggtaaagttacaaggtttttatttgcacagaattctccatttgtattccccagtgtcgggcccgccagcctaccttaccggcgcggttagtcaacgcgcttgacaccgacatcgtctaagctatccaccctaatgtcata

SEQ ID NO: 41998 - DNA, 353 bp, Oryza sativa
  unsure (1)..(353): unsure at all n locations
agggccatctctatactaaccacntgttgaaaacccgttgtggaccntcagatattcgacgtttcgctgaataaaccgttgcttcccggcctatggtaagtaatttctagaaaaatctctgggggtccaactctcaaaatctagtgtctctagggtgaggcccgtgattaagcagccgtcaaaaaaaacctagctcgattccatgaccggaaggcaaagttatcaaggttttaatttgcacagaattctccatctgcattccacagtgtcgtgcccgccagcctaccttaacggcgcggttagtcgacgcgcttgataccgacatcatctaagctatccaccctaacgtccta

SEQ ID NO: 41999 - DNA, 614 bp, Oryza sativa
attcttctacggtggttagatctactcatttccactctatgtatacattttttaagcttttaaacctcaatttgtgatggatctatgcatgcataattgtgaaggaaaagctccatgtttttttatttactttattttgatatgtttgtgtaggctgttaacttcaaatctcagggggatttttctacgatggttagatctactcatttccactctagatatgtaattttttttatgcttttagaccttaatttgtgatggatctatgcatgcaaaattgtgaaggaaaagctccatctcctaggtctagatctagacacatagagaagaaaattttttatgtatgttaatttggtcgattaaaaaaattatttgtgttatgatgatatgattttgttagatttttctatgatattaatttagtatgaaattaaataatctttgttcttatgaatagtgctatgtcatttttagtgaaccctagaaatttggtatgaatagcgtaaatatttgttggtcattttttgtagagatatggacaggcggcaatggatgtatcattcgccgaggtatttggctttatatagggaagaaatgtaaatttattagtattg

SEQ ID NO: 42000 - DNA, 340 bp, Oryza sativa
caattcgagctcggtacccaaattataacccataggaaaataagatcatcttcggccattaattaacggggaaaggctcaccacccgatgacattaaaaaataatgcatagttgaaataaaataatagctttaaacgggttcaacatgctcaaagggttatttgggatctgtgtgacttgccttgagcttccgcaaacacttccgaaccttgctcaacgaaaacgctctcctccggaacgtcggaaactaaagcgaaagaataaaaatcaacaaaacagtacaaaaacaagcataaacagtacatgtgaatatttttaacatgtagatcttgattttaga

SEQ ID NO: 42001 - DNA, 1501 bp, Oryza sativa
ttaaacttgacaaattgatatatttgatattttaaaacaactatatagaaagctttcacacagaacgtaccgtatagtaatttgaaaagcgtgctaacgaaaaccgaggtaaaatctatatcttcatgagaaaagaacaaggactctcatgttaaaactaattatacattactccaaaatatatacattaaatatataagtttcagaaaaaattgaagactatctcatagtcaatctattatacatctttaatatgtttgaattgttgtgttcccccgcaattaaattaacagttcatcacccatattgaccatattttaactttgtctcatcacatttgttatgtcatccaaatgaaaatttataaaaaggagctgatacagatcatattatcatagattacttcacatgcacgcatagttaaattatatataaagaatattccaaatcgttgtattagattttataaaagcaggtccacgtggtgcaactactgggtgcaagccacctattccacagtcccatcacggcgcgtcacgcatgcacgtttccttgtgggtcctgaccttctggcctctcctccgcttcacacattctccttttctcccccattattctctttcagtagttgagttagaatatatttgtaacaataaatttttgaacagtcgtaacttttaaattatatatttaattttttatctcttagcaccatcgtattatttatgattaaaattacaacttaagcctcatgttaaccatttttttttgaaacgaaccatataaaatagtgtgagattttatattaatattgtagagtgtgaggtttcatattgatataacataaagaaatagttacaagaccatagccctaagatgctataatgagaaaaaaataacaagtcacaccacgcgtttgcaaccaaaagaacacgatatggaagaaaccagagtgcaacgtcctggttgcactcaactccatccacgtctttggattggagaagcaaagggcgagagaaaagatagatccattatcccatgcacacaacccccgctaacatgctcatcttatgacggacggaagcgccaccacaacaggacagatggaatggaaatggacgttcaaagtgatgcatgatcgagtatgctctatttcctaacaaaggttcctatctgttgacgcaaaaaatgttgcagacatcaaggcctgagatatttggtttctctagtgcaggtactatcaaattgggttcagagcgtgtcagttagtttgatcctacaactaccaaggttataaaggaaatattagtccttgggccaattggctttgaagccgatacgaaatcgtatactgagagaatgccgatagtgattgctggtctatcggcaacaaccaatggaaataaatagcatcggccgtaatatggatgatgatgatgatgatgatgatgatgatgatgatgatgatgatgatgatgagatacatacatacatacatata

SEQ ID NO: 42002 - DNA, 1501 bp, Oryza sativa
  unsure (1)..(1501): unsure at all n locations
tggtggatctgcgtatgaatgagctacaagtgtgagctgacttcacccccgttctaagctcataatctgggaaagaatcaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtaagtgtcagaccggtcacaaatcggtcattcttgtccaccgcgtgtaatcttggcaacgtgcatgtttgcccttcttcacacaacatcttgcctgtaatggttaagatgaagcctggcatatatcgaccgggtctaacgtgtcatctctaagagataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgccgcactgcatgcagcgtgacacgcttgaccagactgcaataaatgctgttaggtgagcacagctgtgctcacttatcccatatacgtggcgcagacttcctaaagggggtcggggtgccccngccctcnnngccncngcaagcgcaacccgacccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagtgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgcca

SEQ ID NO: 42003 - DNA, 402 bp, Oryza sativa
atttgtcgatgagatttgatagtatatttgtaccatgaattacaagactgactttgcgtagaccggttcactttaatagcacccaaagttcaccccgttcccatttttaacacttttgtcaattctcaatcgttttccgtccgccttggtcgctattgacagccacgtacgcgatatgacgtttttacccctcacaagtacaagtagaatgcatggcaatgaaagacgaatgtatctctattatgccatctaccattctcgtgactaactttctgccactggtcctcccctatactcatggttctcgtgtatgggctgaaacacgcgtgaagatgatttgaagcgaataaatgtatgtaattgattttgcatataaaaataattgattaaaacgttaccagt

SEQ ID NO: 42004 - DNA, 1311 bp, Oryza sativa
atttgtcgatgagatttgatagtatatttgtaccatgaattacaagactgactttgcgtagaccggttcactttaatagcacccaaagttcaccccgttcccatttttaacacttttgtcaattctcaatcgttttccgtccgccttggtcgctattgacagccacgtacgcgatatgacgtttttacccctcacaagtacaagtagaatgcatggcaatgaaagacgaatgtatctctattatgccatctaccattctcgtgactaactttctgccactggtcctcccctatactcatggttctcgtgtatgggctgaaacacgcgtgaagatgatttgaagcgaataaatgtatgtaattgattttgcatataaaaataattgattaaaacgttaccagtgcacatcgcgtagaagccaaatatatggtgaggtggaaaaagatatgattatctctttatatggaaacaaacaaaactatgcagttactttcgcgcgaaacggacaatacaccgcgcgttacacgtcagagtacgtggagaatgtgggagtggaggagaaaagctatgagcatgaaacaataccgtgagcatcgaaggaaaacaatgtggtgagatggcatgagtaatagcgtagaaaacaagccacattacacgagaagaacatttgcagctcggaaaaagaccaaaaggaacaattgattcgatttgcagcttatttttaaataaactgcaccatgaagataggaaaaaaaatctaaattttcaatttaaaacaatgcaaagtatttcgacatcatagttaagggctaaggtacattaaaaatataaatatgacaatcctagcgacaagtagatattaaatcaatagagatcgaatcaaaatcgcattattcacaaaatatcatcataacttaaatcataaaatacacaatataacctgataagaaagatacatgagaaataaatgtatcaacatcaacgatcacaaacgttacacgaagccaaacaccaaacagaaaaaaataaataaaggaaaataagtccaaaaaaaagaacacaacacacagctatatactataaagctctgcaggacatggaaggagaagaaaaaaaaagaaaagaaaagcagaggagagagtagcagagagaaagaaaagaaaagaaaataaataaataataaaaagcaaaggaagggaaggaaggagagagagatagaatagagagagacacacaaacacctacaacaccaacaacaacaagagaaagagagaaagaagagaaggaaaggagaggaagaagaggtggtgg

SEQ ID NO: 42005 - DNA, 1501 bp, Oryza sativa
tttcttcgacttatatccctcttggcttggaccattacctcttcatttcttctctcttcctcaagctcttctcttctcttttttatggcatgagcacctcgtctggtgcaaactctcttctccttatatggcgtgaggtgagcaagaaagaggaacgaaaagagtgacgttttcaccgtgcttgattgctcaaagtttgagagcattgtattgacagcgcggattcctactctgtgcagcgcaactgtgctgcggtacgggcctagctcaattcaagagtattcagatgaatacccaagatttttagataaaaaatacaatatgaggtatatatttcgtatctgttttagatgaaactatcatcagaatggccagttttcagttagatcaatgtacttagctttaattaacaatggttacattgacagaaataagttaatttggaaacttaagatgccgcttaagatcaagatctttatgtggtatttgcttaagggagttgtgttaaccaaggataatttagcaagacgaaatttgaatggtaatttaagatgttgcttttgtacgaaaaatgagtatatccaacatttgttcattgaatgtcattttgcaaagtttatttggagagcagttcagttttcttttggtttatatattcctactagcatatctcatatttttgatgatcggctttagggagttgtaaacaaaaagagtaaactgatacttgttggagcttctgtcttgtgttgggctttgtggttgagtagaaatgatagggtttttgacaaatcacctacaattacttatatgcaggttattttcaaggcaatatattggcttcgtctgtgggcacagttacaaaagtatgatgaagatgaagaattcctaattgttgtgtgtcgtatgcttgaaacgacggttatacaactgtttgtcaatcatggatggagatttaccaatacactgaaataatgttattttatctttattggtttccttttaattttaattttggttggtgtgtttgctttcatttggactgcactcttacagagtgctagtttgtaataattggctgtaactcttttgagtaaaggtcgggatgttatttcattccattattaaaaaaatatattttgtatctgtgcagagaaataaagaaaataaatactattgatcaaaagaagcctaacaagaaagcctagcacactggctccctcatcccacctgtcttatcttctcattatgtaggcccaatagcccaaaagaaggggcaaagtcaacctagaccaccactggtcgctgttggttgttccaacttccaagtcgcaacatgtccctccgtcttgctcatcaacgcaacgccgcgctgccgtcgtgcacgcgcagatgtggagtagcccgcggcgtgccgacgcctatcgaggcctcaccctcaacaggtcgcggacgcccttccctcgctcggtcaaaccctctctctctctctctcgtcata

SEQ ID NO: 42006 - DNA, 1501 bp, Oryza sativa
gatgatagtttcatctaaaacagatacgaaatatatacctcatattgtattttttatctaaaaatcttgggtattcatctgaatactcttgaattgagctaggcccgtaccgcagcacagttgcgctgcacagagtaggaatccgcgctgtcaatacaatgctctcaaactttgagcaatcaagcacggtgaaaacgtcactcttttcgttcctctttcttgctcacctcacgccatataaggagaagagagtttgcaccagacgaggtgctcatgccataaaaaagagaagagaagagcttgaggaagagagaagaaatgaagaggtaatggtccaagccaagagggatataagtcgaagaaaatagaggtaaattttagtactttaattattatgaagtatagatttagcgatgatttatgtattagatgaaaatattaagtgttggataagtaataattaatgtagtgtgcatatattacatataaatagtttagttatgtgagaagtttagaatttttaggtactatgtatgttaggactcaagaaatattatagtatgaatgtagtagaaatataaaatggttttagtattatgtttcattatacataagacatgcataaattttattaatatataaaaccgtgtgaaaaattgtatatatgattaaaattttctttagttgtgtgtacgatttttgaacgagtaagagaaatgaggaaaatatatagtatgaataacaaactctatcagttatatagccgttgacctgaatcttattggtttcggttaggcccacaattccatatagaccgaaatagccaacgggtcattttaatctaatctatctgtattttatcttgttagttgtatgatcaaactaactaacacattctgaaatccataggacctatactaaagctaagcagaactcacacgcttccgtctgttcttttagattttacgtcaacaactgcacatcatttgtacaatatttttaacatgcatgtttctatcattttgatagtagcactactacttaagggcaagttctattaattaataggtaacaaatacaacatatcacatctaatacacaaacttcaatattggtttattaattctcacatcgtcttatattttcttaaagattgtgtggaggttgcctcttgtatgaggctggcacattctctctcttctaacttctctccttcatatcatcacctaatcctatgtgacatctttaggagcaacatgtagaggcttatagtacttgccctaacctatgtttattcagagcaaggccaataatacagccaactgcttactgtatagatttttatagcctatctctaagcttactcatatagtggttaacttttcagtataaatatatggtccacctgtctgtctcacagatttcggccacctcaataggggtggaaaaaaaagctcggattcatgagctcagcttgggcttggctcgagcttggttggct

SEQ ID NO: 42007 - DNA, 1501 bp, Oryza sativa
ggccgcagaatcacgggcctcaccctagagagactagattttgagagttggacccccagagatttttatagaaattacttaccataggccacgaagcagcggttgtttcggcgaaacgtcgaatatctgagggtccacaactggttttcaacgaggtggttagtatagggatggcacataggacgttagggtggatagcttagatgatgtcggtatcaagcgcgtcgactaaccgcgccgttaaggtaggctggcgggcgcgacactgtggaatgcagatggagaattctgtgcaaattaaaaccttgataactttgccttccggtcatggaatcgagctaggttttttttgatggctgcagaatcacgggcctcaccctagagagactagattttgagagttggacccccagagattttactagaaattacttaccataggccaggaagcagctgtttattcggcgaaacgtcgaatatctgagggtccacaactggatttcaacgaggtggttagtatggagatggcacataggacgttagggtggatagcttagacgatgtcggtgtcaagcgcgtcgactaaccgcgccgttaaggaaggctggcgggcgcgacactggaatgcagatggagaattctgtgcaaattaaaaccttgataactttgccttccggtcatggaatcgagctaggttgtttgtcacgaccggaattgacccaacgggcgttccttacgtgcgtgtattattccttgtcccaggaggcaaggtacaccaaaaattgatacatttcagagtttatcaagcggaagcgtaaatagttaatttattacatgggcggcgaaggcccagcacacacaaagacaaacgagaaacagcggaagactagggtgacgaccacaggcacttgacagcaggcacgagctagacaccaaagccttcatcttccaggggctcctcttctgggtttgggaaaaattgagcaagactgagtacaaccaccatactcaacaagacacacccacaagtgcaggataaatgcaggggagtacaagggggttgtaatataaagggttaggttttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccaactcgtcccaagccaacccaggccaaccattccacattttagttgttaagcaggttttaagaattaaaacactaacttgggtacattgctcggcttgcccataaccgagggcgtggctattcgaatagattatactctgatcagaggtgtacatctttacccacaagacacatcttcctcacgtgtaaccacgtgccgcataccaccacggtatacggacggaagacgtgacatagtttccaacccatccta

SEQ ID NO: 42008 - DNA, 1501 bp, Oryza sativa
ctccacctgctccggcggcagctggtggaggtgcgacacgtcggtctctccgaaccccgggagggcgaccgccgtgggcttggagaaggagcgaagctagcatcaaaacaaggggggtgcactaccattgagaatctagaaaatttcagtacaacgctatacattctagtgtttttaagtgagaaattaggaatttagggggttcatgtgcaccccccaaacactatataccttcgccactggcttggagcggtcctccagggcctcgcggagcctgctctggccatccatcatgctggtccaggtcttgatgtactcggggttcgccgtgtagttggccaccatctccatgtcgatgagctcgttcacgtaccgcgccgaccgctctcgcgccttgtccatgaggctctgcacggcggggcggcacgacggctgcacctgcgggtagctgcgcgagtggcgctgcagctccttgagcaccaggtcctccacgtagtcccacacctgcctgacgagatcgtgcgggacttgcgcgatgctcttcaccttccggttgagcagaacgtggagcgccgacctcggcatgaagttggggaggttgatgcccttggtctccttgagcacccgcatctcctccaccaggaacggctcgccgtcggtcgcggccgccgccggcagcctgcgcgcgaagccctcgagcatcttggcgaggcgcgccgtgccgtggtggtggcggtcgttggggtactcgtcgaactctcccctgacgagcaccttctccagcgacgcgcgcatctgattgacgatgtggaagaattccctcaccgcgtctgccacggtgcagagctccggcggcatctggccgagctcgtcgctgctgcggctgagcttgtcgttgatctgcttgacgatgtcggggagggaccgggcgatgattctcgcctggatctgcgtcagcctccgcgccagcgtcgggacgcccaccatggacttgtcgatcctggagagcagagggtgctccgcgaacagccgcgcctccgcctcccgggcctccttgtaagtctcgtcgccgatgcggttccggacgcagacgtagcccaggccgatgcgcacgtcgtccacggtgaccttctcgagcaggccctcgggggccttgtcggacttggtgacgacggccagcgtgcggttgccggtgcggtccacctgctgcgacatgcggatggactcgcacgtcgggaagtcgacggtggcggagagcacgttgaggatgatgctctccctgggcgcgatgtacgccttgatgatgccagcgatctggtcgtagatgtcttccggctgccccttcacgggcacgcgggtgatgcccggcaggtcgacgagggtgaggtcgggcacgcccttcttgcgcaccaccagggtgatgggcgcgttggagatgcccttgccgcacccggcgatctcggcggtggcggcgttgatggcgtcggcgacctcggcctcg

SEQ ID NO: 42009 - DNA, 1501 bp, Oryza sativa
ccctctctctctcgcgttcaaacgggcggatttgcccccgcaaatctcgccggcgccattgatggcggccgacctcccgcgccggtttccttcctccccgtccgccctctcccccttccaaccctatttaaaccctccccgcacctcctctgtccggttccgcctctcgccgcccttcctcctcgccggattcaagctcgcgacgtcgctctctctctccatcgtcgccgccgagctccggtccgccgccgtcgttgccccggaccgtctcccgcctcggcgccgcctccttcggctttgccacatcctcgccgacctcgtccacccctccgtttcagtcgccgaccgccggagcgccgccatccccatcgacccgagccgcgccaccgcctccctccactccggccgcctcctccgtcgccgccgtcgccccggggtgagccgtggaccgtcgcctcctttcccccttccctcccctctctcggtcgccgctccgctgcgccggtggtcgccggcggcgaccatcagggcgcgggctcgccgcctcccgccgaccgcgccggcatggccgccctcgggcgcgccgagtggctgccgcgtggggcccgaccgtcagccgcccgcgcccttgggtgcggctgacgcgtgggacccaccgcaccggccggtatgagcccgggtgcacccggtccaccgtggaccgtgaggctgccacgtgggccccactcccgtggacccggtccgcgtgcccctcccctcggttgacgcaataaaccctttttaaattaaaatttaaatggagaaattcgcaaatattcatttaaagagcatataaacttcaaatggtcataacttggccatctggactcggaattggaccgttcaagtctctaatttttccttaagaagtcaagacccatttttgtgctttgttcctgcttgttatatggaatttattagagtaaaagcccttttattttccgttggtcgtgtagacgctgcagcttcggaagatccgctcttcgtggaggttgaagccgacatttgggaaagcgagcaaggcaagtcacatcatccttgaacatattggatcccattttataaaattattttgatttaaattattgcattaccgctttacttaaattcccgcgttatcactgttttatttatccatgcctatttgcctttgttatgaccttattattagtgttattgatattattaccttgttcaccctagattaaacaaaaccccaactagtggacactctattcatggtaccactagtatgaatttaggtagatgcttaggcaacattatgtggttttacaactctagactttgggaatattttcatcacctggacactatggaatggttggattattgtggaattggattcacacctccccctctattcaaaaccctcaaaatggttttaggctggactcggggtgcatggttttgatagtagcacctcggccatataaggaccgct

SEQ ID NO: 42010 - DNA, 231 bp, Oryza sativa
tcctcggctctagttttcaccggcgaggtatttgctcaaaagcgtatgtccggttgcaaaaattttttgccgacgtctgcgaaaatgctttttccagtagtgcgtaggtcgcatgggacatgcaaacaagcaaaacaatctcagattagccttaaaaaaactaattttgtagatgcaatgggcatgcatgtatcgatcaactatgcactctgtttgccagatgtgcatgca

SEQ ID NO: 42011 - DNA, 1501 bp, Oryza sativa
aagcaatagcaatacatcgccagcgagaacacgagctatctgcatcaatgcggcggcgcacttcgtgttcgtcccgctcatggcgcagggccacctcataccggcgttggacaccacactgctgcgggccacccacggcgcgctctgcaccatcgtcaccacgccagccacggcggcgagggcgggccccaccgtcgactcggcccggcggtccgcctcgccgagttcccgctcgactacgccacctcctcctccacgctcgcccgacgtgcctcgtggcggacttctgccacccgtgggcgtcggagctcgccgccggcctcaccgtcccgcggctcaccttctttagcatgtccgccttttgcctcctctgccagcacaacgtcgagaggttcggcgcctacgacagcgtcgccgacgacaacgcgccggtggtcgtgcctggcctggcgaggacgatcgaggtcacgcgggcgcaggccccgggcttcttccgcgtcgccaggtgggacaagttcgccgacgacgtggagcgcaggtgatgggcggtgatggcgcggcgcggccgtgcttgagcgctggccggctcggcgcggtgtggagcatggcggcaaggtggaacggagggaggcggcatgggaggaaggaggtcctccagcggccaccggtgccgagtagaccgcgcgcgctccgggcatcgccgctgtcaccgagcaagccgcgaccgagaggaagaagaagaagggagaaagaaacaaagagaggagagctgacatgtgggcccaagggtatttttgacatttcacgtaatttctctcacctctttaaccgaaaattattattttaatcagcgcagtgtccactggcaaattaccacgtttatggagtgttttcccccaaaagtgagtttaggcagtatcctaagattaaaaccacacattagcagtgtcttgtagcaaaatttgccttagaataaaatctataataggtttagaatattgaaccattacacagataggttgtcgtcagtaaccagtgtttgatcctacctctatctataacagtctatataattaagtgttacaggttatgtccttgcaaactgtcttagctaagcggttacagatggccgcggttactgctggttacacgttccgtagtagtgtgtggagcccaccagcaaagatccggccttcctccctaaggatggaaactaattcttctgaacgcgtaaaagactcattagtatataattaattaagtattagtatattttttaaaaaaaatagattaatatgatttttgaaagtaacttacaaaacttttaaaaaaaatgtaccatgcgatgcaccatgcaccatgcaccaccatggacggaaacgcaaatttgtccgtccatgcaatgcaccggaccggggagagtcatcgtcgatcgtcgtaccctcaccccctctctttttctcctttttcgagaggaaagggtaccatattgttccttcgt

SEQ ID NO: 42012 - DNA, 1501 bp, Oryza sativa
gcgtgacgtacggatctatccagacggatcaagacgtacagatctatccagacggatcaagagcacgtatgttcctcccacatcgaaaaaattactgcaccacgtggtccaataaaaagctggcagaagtatatcaaactactgtagcctacagagcacaaactcctttcgaaatcatcggtcaacagtgcattccttttcaagcttgtctagcacaatacagaattttagtttgaccaaaccaagaaagataatatgaaccatcggtcaacaatacattccttttcaagcttgtctagcacgatacagaatttaagattgaccaaaccaagaaagataatatgaaccattagatcggaatacatgaaaagaactcagatttcttgattaaccagtttaagcacatactacgtgtctcattacacactactgccaatcaactattgatagtttaaacatgcaaccaatcatcttgtggcataccaaatacatgtaagcattaaccaccaattaagtgtatgtttggccaatcgactgaaataaatgaggatacatgtgggccttactgaagcattttcctaccagccgactcgcatagccacagatttattcacaagactgactcccaccgcatggcatgacgcattccctaggcgcaagttcccaactctcaacccacggatgtttagcacataaacgaagaatgttatagatcgcgaaaacctctaatctaaatcgagcacaccaaactgtcattgaacagatatcagaaatggatgacttaaggttaaaagaagggtcccttctttttcaatccatgtagtaatattagaacactaaaatgaatggttatatctcgaaaactaatatggctgttggtagagcatgtaaaagtatcaacattagcgtaatcatcttacaaaaaaaaatataaaagctatagagtaacttatacctcctcatcccctctttgtccgatgctcttcagtcaagatcatcgtagccacgatgacctccagttgcattgttgttgccagaaccggaagcatcagtagaaccaccaacaggatcctgattggtaggattgctgctctccgcctggccgccaaacgcagcacggagaggccatggcagcgatatcctgaaccttctctcagccagcctaggtggtggagctggagagggagaggcagaggcagaggcgggtgcggcggggcggtgagatccaagggttgggtgggcgtggtgagggtcatcggtgggaagctcgaagcggcaaacggggcaggagctgtgaaggtcgagccaggggaggatgcaatccttgtggaagacgtgtttgcaggggagctgcttggcggcagctccgaggtggaagtcgtccatgcagacggcgcactgggcccctccatcggcggccatcatgtcggcggagacggcgacgtcagggagcgcggcgacggcggacttggcggcaggaggggtgccgtagcggttgggg

SEQ ID NO: 42013 - DNA, 456 bp, Oryza sativa
ttttacggttgacagatatcccggcccctcacccatagaaaagactggatttggaagagttggacccccaagagattttttctagaaattactttcccatggccaccaaacagcggtttgtttcgccgaaacgtcgattttctaaagtcccacacttgttttccacaaggttggttagtatagggatggcacataggatgttagggtgaatgctcacacgatgtcggtgttaagcgcatcgactatccgcgccgttaagttaggctggcgggcgcgacagtatggaatgcagatgaagaattctgtgcaaattaaaaccttgataactttgctttctggtcatggaatcaagctaggttttttttgacggcttcagaaccacgggcctgacagaagagagactggatttggagagttggacccccagagatttttctagaaattacttaccatagg

SEQ ID NO: 42014 - DNA, 782 bp, Oryza sativa
aggcccctccgattgtacgtaatccccaaaataaattcaatagaaattttggcacgacctcccctcttttttgaagaaattttgaagcctgctcgggcagctggaggaggaagaagacatatatataggggtgggactttagtcccggttggtagcaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaagaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggat

SEQ ID NO: 42015 - DNA, 1501 bp, Oryza sativa
aacccgtcccggatcccgcccccacctcttgcgcggtaggcaccacagctcaagctcgaactcgccgcccccgaagccctcagatggtgaagcacccagcgggtgagtcacagcggtgggagagaccgtgacagagtaatcagcctggtcctgcatacatttgaatgcctcaagatcttcctcttgattgtcacctttggctttgtcatctttgccggaactggtttctacgtcatccttgttcgacagaactaccttatatttctgaaccatggtgccggagcgagtcggtgcgaacgaatgcagaaatcggttttgcaagtcgtctttcatcttttcaaattctgccttctgctccggggtcagcttgtccatcgttattgggatgacgttctctgggtcaacctctcctttcttgaggcttgccatgaagaagattttacgaaagtcagtcccactaggtgtgccaagaggtgtgttgacgcgaaaaacacgcactggactgagagatttgcttaactctagtgcaggtccaaagaaattgtcttcgggttctgagcgtgccagggtttgatcctggaaccgaaaagaaagaaaaaggaaaaagttaaatccatcaacgatagccgatcagctggattgccgatgacgtatcattcagggccatgccgatgtgacttgcatcggaccggcaaggtcagaataaacgtaggatcattagatctactcgatcagctgtagatgtcaacgatacataatctatccattgaaacacacttagatcgggtgattgggatagatcgggcgttatgccgagacagtataaatcactcaacaactaagtgtgccccaaagtacagattatgtaggttcacagcatagccgatagagcaaacataacgtgtatcggctagtactccgatactactgtatactaggatatcagcgcagatgaaatatacaaaactaagatcaatctaacaagcagggtgaactagtagactgataggaagcttaatatactttaaacggatgagatcttaatataaagggtaggtttagacagtccagaaccaagtagggaaacaggacggctaaatcaagtaagatcggctgaaactccgatgctatatgtattagcattcaaaggaagagctagataagacgtttcaagacaatacttaacagatcgaacctaacggttgcaacattaagcataaaaagaaacataagatctaagtaaatcgatgaaaactcattcaagatggtagatacaccacatagtctagcttgacattgacgcctaaacctatcggccgtttcgatgatagaggctagccgatgaagtttaggtgacggaatcaatctagattatgcggtatatatgataactcagcaattcacgtagacaggattagagtgtcataaagatgtaagcacgaatcccgagaacgcaatccgccataacaagctttacctcttcgtcgaagatcaaacccga

SEQ ID NO: 42016 - DNA, 173 bp, Oryza sativa
ttatgataatgagttgttggtgccttggtggtgttgatctgtgtggcatgcatatagtagctgcttgcaaatagtgattccatggttcagtttttttcttaatgaattttaggatactatgattgttgtgttttgaaaattcactcctttcatttgttcgtatatatactagc

SEQ ID NO: 42017 - DNA, 1501 bp, Oryza sativa
atggacctacctttcaaagtattgctgcgtgggaaacaatcaggtaacctattctatgttgtatcgttgcgaacaccaaagcaaaaaatctgctgttctcccgttccaactgcagcacttatttcttttcagggttgatgagcaatagggtaaagaaaaaactaatccatggtagctgtttccggaccaaaagtattctccagatggattcacttctgtggaggtgacggagatggaggcggaggtggcgtcggcgttggttgggacttgcatgccttgcaatcaatttgtggtgatggtgtcgtgttgtctggaattgttaccctaattgtttggtgtttcccatcgtcagtaggaacatcaaggatagcatccattaatagtatttcccagtcactgcgttgcaggaatgaaaaccaagactcatctgcaagaataagaatgacatgggattagaaataggctcctacaacatggatcaagacttgtagagactcaaaaaatatcaaaatcagttgtctaacaaaaatttcttcagttaaccggtacttcagttctgtatcaacatgatttttcaaagatagcatgccaaagggaaaaatggaaacaagatttcattggaggaaaaatctggaagtgatgaatttaagaactaacaggtcccagtgaacgcaatatcagtagcaacacgatagaatgtgctctgggcctcaatatgaagaaaaccatcaactgagcaatcaaaaacaccaatgggaccaaaagttacaaactactccctccatcccataatacaagggattttgagtttttgtttgccctgtttgaccactcgtcttattcaaaaaaattttagaattattttttttgacttactttattacccaaagtactttaagcacaacattttattttttatatttgtacaaattttttgaataatagttacaatagttattttaggctcacatcgaattggatacgggcgacgtaccaaaattccggcggaaacatcttcaatttttataatagtagagatatttgaaatggcttgaactgttattttgtaaatggcaatcagacaataggttttgttgtgcttactttgtttgcattgttgtgcatctctgggatagggtcccaactctgacaattttggcctgcctgcttgtgctcgtttgttgttagactgatttgggtggtaaactcaagtgagttactgtatgcagagagttagtttctggcttcattcagtgtggctggtgttcttgggagtgctctttaggttgcaagggaccttgatccaatttatagtaattcttgtaattaaataggttgcaattttgctgcattccctaaaaacaaccatgcaccacatgtcaaagttagagatcatctccctaactcacatcaagcacttgttgaaagattcatactcaaatcactcattttcttctgatctgatttgttatctaatcttcaaatggtttacacttgcagc

SEQ ID NO: 42018 - DNA, 386 bp, Oryza sativa
cgatttccgctcactgcaagtagttcatcacttttctaataattggattaaataaacactctttactagctcctaaaagatatgatttttacaaactatatgtgaatatcttataatacttttttcaatatatgtttcaatttcataatagtataaagattaggtcatatgtacactcaaataattccactattcaaccattcaaacagttgagcatacattctgggcctctttggttcacaggatttccaaatcatataaataggaaaaacacagaattctccatctgcattccacagtgtcgcgcccgccagcctaccttaacggcgcggttagtcgacgcgcttgacaccgacatcgtctaagctatacaccctaacgtccta

SEQ ID NO: 42019 - DNA, 952 bp, Oryza sativa
tcatgtaaaattgatgttactagatttattattaaacaaactatcataatatgtaactctttttatttaaaacatcttacttttatagatattgctggtcagagtagcatctcggaaaccgtgtcaaagttcaaaaattcttatattttgggacggagggagtagcaaactttcatgctcattaccaattagaaaaatgtggtatcaaactgaaaggctaccaatttcagttggcattactaatattgacttggttcacagtgttatcacagcaaatactcaagcaagctcttttcaatacaacaactgaatgctataagaaagtcaaatgaaaagaaaccatacgaccaaatgaaggcccacaagttttaaaaactatacaatcgacggatgacaaggttaagcatgacgtgaaaagggataacatataaatctcagataaagctaatactcatcaggaacctttcggttttggaacaaggtgaggactccagatgtaaccatgaggaatgtcattcccagaaccctgtgcaccacttaggtatgttaccggacgcaacttcagcttcttcttcctaaattcatttatcatatctcggataccaagccaaatcatagagtcaacaatttgataagaaagctgcaagtgtaaaccatttgaagattagataacaaatcagatcagaagaaaatgagtgatttgagtatgaatctttcaacaagtgcttgatgtgagttagggagatgatctctaactttgacatgtggtgcatggttgtttttagggaatgcagcaaaattgcaacctatttaattacaagaattactataaattggatcaaggtcccttgcaacctaaagagcactcccaagaacaccagccacactgaatgaagccagaaactaactctctgcatacagtaactcacttgagtttaccacccaaatcagt

SEQ ID NO: 42020 - DNA, 1348 bp, Oryza sativa
caggtggtgaggtcggctggccggccatccgcgcggcgcggtggtcgttttattcttagccaataaagaaactaaaattctgcttcacaatttttaattttggtagcggctgagaggcaaacttcgatgtgactttgtataaatttagtttattttgcttattttttatatactctctcatcctagaatatagcagtctataactaaatgtaacttacactactatgtaaatctagacaggaaaaaaaagtacaagagtactctccatcttatattaagtgcagttgtagaatttaattaaaaaccaaattagtaggacaaacgaattacctaaatgcccggatgggattgagagtgggatggcatgtaatttaaatgatgaatgataaaatgggaaggaattaatttaaatcaaaagtggttgaaacagaaaaaatgtgaataggttgccacttattatgtgatgaagtttgcatactaggaggtgtttagatacaggggtgtaaagttttggcgtgtcacatcaggtattatatagggtgtcgcatggggtgttcaggcactaataaaagaactaattacagtatccgttagtaaaccacgagacgaatttattataagcataattaatctgtcattagcacatgtttattgtaacaccatattgtcaaatcatggagcaattaggcttaaaagatccgtctcgcaaattagtcgcaatatgtgctattagctatttctttagcctatatttaatactccacgcatgtgtttaaacgttcgatatgacagagtttaaaattttggggtgagatctaggcaacttatcctatgcacacacctatcttggtgtactcatgcactcgaccactatcagctcttgtattctaatccaaaggctaaaaacctaagtgtggcgtttttgtaagagaaaccacgaggtaagacttcatgttagttttcctcaaaaaaaaaattccatcaaatggcccattccgtaggaattctgaagatgcttttcagagtcattcttttattcaaaacaatcacataagaattatttcccctaagaattcaatctttgataattcctccatttcccctttgttccgaaggagcccatagaagacagtgtcgatgtccaagactttacataattgcgaccacatagaataatctcacagtacacgtggaggctgacgtgccatggtcctatcatggtacactttcacagcccacttggcacgatcttatgaccttccaagacaataacgcccaaaagttgtggagattttagctgcaaatgttgccatccaacacaaccagggagggtacagtcagtagaaaa

SEQ ID NO: 42021 - DNA, 828 bp, Oryza sativa
cagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgctgagtatgtcatatactcaccttgcaatcattcatcagaagaagagttctacaatgaggctgatggtgtggaggattaggtgtagccttggtcaagctacctgtggagtggagccgtctgcgccgtttatttaatttccgctgcttagaactttattgattgagaggaactatctacctctgtaatgacattttattcgcttattaattagagtattatttgtactctattatcaatttgttattgtgtgcctcggctgattcctggacgagggttcacacacatgtaagcgtttggaattttggatagaaattccgggcgtgacaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaata

SEQ ID NO: 42022 - DNA, 1501 bp, Oryza sativa
tatttttatctctgttgtatactataccaacaaatctagctcttcagtgcatgcaagtaggtcatgttttgatcttctgttgtgtagccatgcaactttcttgcctatctatatggaacttacagttcggatgttctctaggccaccttgctatgtttcttctgctattattgcgcttttaacaccatacatttttgtgcatctgcagctttgtttcagataatcaggacagcaactagcggcgggatggcctaaaaacagagctgattcaagagatttgtgatacattgcatccaatgcaagtggcagcggcagctaaaatgtttggtgttgtcagtgttttgtatgcatttacatttctgaagcatcgagttgaagtacaatgtaacagaattacctgtcttacaatgttgaatggattagtataatattataccgttcatctccagttaacatctgctgttggaaaaggtccctgcttgtgcttgtgaattttgtcggtctggaattatgaattgctggacatgcagacctcatcttgttatcttcatgcgagcaaattgtatgcaaagaagtatgttgattcactgccattctcatcagcttaattgacagacaaacaaaagataaccataagcaagcaccgtcagcactaggcactattatatcaaagagagtgatttgatcgtttcaccttgaactctatgctatggttaatattatttagtttggataagaaccaaccaacagatctaacactgcagtttacttgctctaaacctttgtgagtatcatgttcagtttcttcagagtattcttgcttttaacactatacactttttacttctccgcagttctttttatttcacataatcaggcatggattagatatatcttattttcaagagattttcacataatatatgtattaactgtcatgaaatactgaatttcagctaatgtctgaagaactgtaaacagaattactagtcttacaatgtgatttgtgaatttgtcactccacatatttcagatcaacaaagaaacatttgacaagaggttgaaacttcatcagcatgaacaagtgaagcaacaaagtcacttgtggagtccttgtcaggaaggaccctcatgttaggtggtaataatcactgccattctcaccaggtagctaactgacaaaaagaaagctactaatcatgctaccctcactgataatcactgtcattctcatgactaatcaactccactaaggcactaactcaccactaatcttgcaaacttcgtatctcacttggctttgcatgcttgtcaccatcttcagagctgttcattctgatcacctgctgccacctgaagattggaacaagaacaacatctgcttcttagtagttgtttcgatcatattatacgctgttaatcttggtgatttttattttgtagagaatttcgtacgacagagatcgttctgtcctcatcggcggcggcgggcgacgcgcca

SEQ ID NO: 42023 - DNA, 1501 bp, Oryza sativa
gcgggttttggaatctgtaacaggtagcttctgatgtctaaatttgcagaatctcgcaactgatttgtaataggagttaagtagagttgaaattttgatttcattcttgctcccaaaggtagaaactgtgccatggaagatgtgtacctttgagcaagtggtcctttctcgcctttggtgagaagtgcctaattctaactattgtacttgtacaacaatacaacatatacaattcaataaagtgtaacaataaaagatcagttgataagttatagtgagattgggggatcataggagtatggtccttcacagtttgcttagctttctgtacatcctacctgttcatttgacaagttgcgctgtcattgttatgaactggtttcaaatcagtagatatattacatattttcatcattataacttataaatcaacctggcaacattttgcagtggtcttacatgtaaatccaatgattgaaaatagtgggtccgccgtatttaacgtaaaatcaatggttagatatatattttagtattattggaaattcatctaatttatttgagcaacttatgagcgtcatttggtgatttagaagcgtttgtagaaatcatacgtggtggtttgagagtgtttgtagaaagtttaatggactttactatacaatagatagatgatcatgtcaattaattactaatattgaccaacttaccagccaaattttcaccctattaattgtccggagtattagatgataaataattgaaaattgagttatatttgctacttcatatttactctctgattccattgcaaattatcaccatatcctttttgtcaatcatcatgtcctcccgttgatccttagatttctctcttgcaactacttcgtcagttcgtctcagttattgaatgatgtgctggaaatgagatacgacagttatagcttgatttggtcaaatatgagcaaagcttgctaaatcatgtttccgttaggactgtagttggattacggattcatcatggtcacgctaaacaatcacttatttcatccgttttatattgtagtaagtttttttattttttttaagtcaaacttcttaaaaatttgattaaatttatagaatagcaacatttatagcattattttagtcttattaaatctaatattaaatatattttaatagtttctttgtttatgttgaaaatattgttatatttttctataaacttaactaaagttaaagttgtttgacttttaaaaaatcaaagcgacctataaatctttgattttatatgtactagaaaaatgaccgtgccctgtaacaggcgaatgctattttaatcttattattgtcatatggtttagctagaatgaaatttactgtgttaaattcgcttagatgtatatctgttagaaaatcgtaagctgcaattaggaattcgatcgtcccaagttagaatgcgagtttttttaatgagatttcttatacgattctcctt

SEQ ID NO: 42024 - DNA, 1501 bp, Oryza sativa
agctttattatactctgtatttctttagaaggactatataacagggtcaaaaccaaaaaaaaaaaatttacagaggcagtctagtacaaatgagggtcttgaattttacctgtcatgcaattcacccagtaattcagcacactgcaacaaaaatatcccgtgccatataccgtgcaaattaaatagcaagcaatagttgtgcgatatttatgttcctagatagactgcaatacgtattaattgtaccatacactagcagtctagcacgtgtattttcatttgagtttccagtgtgtctgatgatgacataatttgatccacaatcctagccgggaataaaatttgatggatctaaatgcatgctctggtagaaacaagttgtacactcgtcaagctttaatttgtagcagctaaccttgttacaattaatttgcttacaagatgtcttgaaattgaaggacatattaccttgtccggcacttcatttttcctataggcctctcattttcaactattacctccgtcccaaaataattgcatttctaggatttaaaattcgtcccaaaataattataattctagagtactaattgccccatcaatcatatctcattcaaatttctccctattttaccctcaaccgtcttctcactctcacataaacaccatttaatgagtggcaccatagtctttcttctcaaaccttaatatatgctaaacaacatagaattgcaattattttgggacggaggtagtactagcttgttaactagtaaatccaacttaaacctggatgctcatagtcatctaagcactattacttcaggatatagcaaatttttagcaagtcacttgcaaaattcgctaccctattctcagttcctcccctgtttctctcttgcatccatatgaatgcatgcatgggctaattatcaacaattagtatacacagttatgcataccaatcatcctctcttgtgtaattgtgcagcttaattagtgctcaacaacaacaatatgttgtggctgatcatgatccagatcgctagctgacacctcctatccgggcattgagatttcatgactcaactcggctgtgtgtccatggagacgctgctggcagctgttacaccatatgatgtgtagagctcacgatcaatggaagtcatgggtgccacactgcccatcactgcaaactgatctgctctcaacggctgtgatcgactcacctcatgtactaggtaagacatgctgctgctatgatctccagggcaacaacctatagttttccagatgcctctcattctcagtgtcattccctttctgaacaaaattgatatacaaagggctggacatgtaagacctaatttgctccaatagagaacctgtagaacttaaaaggtctgtgtcaagcaacaagcatctactatatatgtagtacccagggcagtacaaatatgagcttttttttttctttgagatggtgagccattgtcctgag

SEQ ID NO: 42025 - DNA, 1501 bp, Oryza sativa
acaaaagaatatgtatggtttttacacactaaaataaatccatcaacaaatgtgatgaatggatagagaggccgcatacgaatgttaagttgaattagatcatatacaaggaattgaggttaagggattgatgcatggtgaatgcatgtactcacactctttgtcgaggtcgaagaaggcggtgttgaagaggcaaaggcgggtaggctcaaaccactccatcttggggtcgaattcagtcacctcccatatacgaaccatgtgaagaaccttcaacaccttctcctcccatgtgagctcctcctcctcccaattcttcctcctcggtttaggcttcagctccgacttagtctccaccaccttctccttctccttctccttctcctcaccatatgtgtgcttctcattacaattcaccttgcccatctcttcattgccaccaccaccaccgctagctgcaaccactagggaattttgaaaaaaaaaaatcatgtatccggcaaaacaatgaacaaacggagagggatatttcctgaggtaaatacttactagaaggaatgtcggagcagggactagggcaaagatgaccctcttcgtgatcgcattcgataggggtttcggagtcgactagatcaacgaccgtgcgagccttctccttgtccttgtcctcccatgcgagctcccgcagacgccgcgttatcgcggcgggcagactaggctccgtcgcagtagcagcatctccaccaccgccaatcaccgcagcgcgccaccgctcatccgtgtccaccatcgatctttgccgccgctgccagatgagatgatataagactgagggtaatctaaaaattctgaacgttcacaattgcattgggaattgcatccgaatatagaggattgattggcgtgagagagcgtacataccgtagcgggaacaccgatcctctccaactccggctgctcttcggggacgagccgccgccgccgccgccgagccagaggcggttagggtttggcaaagatgtcagatgggctattccgtctctctcggacaggccagattctctaaaggcataccctccttcctttcctgggcccgtttggcacgttacggctttctagttttggaggccgaataagttcacaataggtccctccatttatcgcattttcgtcctcaatccggaaaaccggatacaacacaattacaaaatcatgcaaacaatccagaaaaccagatacaacacatccttaacttacaaagccatgcaaatgagatccctcagtagtattgacccgggcttggctaatatggaacctacatagatcttttaacaaggttttcatcctatatagcattgacgtgacacttacgtgacaatttgatccagaaaaataaaaaaatcatgggcccacatattagttacacacacaaaacaataaaaacaatggtgaggcccatgtggcctcacatgtcatcctcgctactctctgcttctctcta

SEQ ID NO: 42026 - DNA, 1501 bp, Oryza sativa
ttgactgcgttagtttaataaaagcctgccgcttgtccttaagaaaacaatgtgccatgaatccaaacctgtggcctgcactgatatgtacgtagtatatcaagaatatagcactttttccttaattaacctgaagcaatgagattcatcataaataatacaagtctatgctggtggaagctgtaaatgtcaaatttgttctctccaatgttggaagggcagttacatatatagcagaatgtgacaacaaattaagagctggctctctctgtcctgtcgttctcttcacctatactggtgttgctatatagcttcctgatgttgcttgcatttgacatgagaggcagcaggaactttggcctgtccatactagctgttgttgcattctttggccttgcgactagtaggttgacatgttgggaaatttggccatcaaagggaaggatcatgcaagaagattttaaaaggaagaaatgcagctagacatgttaggatgatgtgcattgcagcattttctaagtcaaatcaatactttgttagcactaattcttgttgcatatcattcttttatggttaattagttttgtttactgtgatcacatcatgtgttagacgtgtttgcatatggctggaaacttgatgtgttcagtttgaggccggccaattcataaatgggtcaagttgctagctagttacaacgtgcatatgttgcatgccttaattagtgggctagttagttacttagtggataagtacgtacatgcatgtgttgcagggattagtggagaagtgcatgtagtagagtccgggtcaagtaatcatgcgtgctggcgtgagacttataaagccaaattagttgctctgcagtatgtgcgcttgtgataattagctgattcagtgcgaataacggagaaaaaaaagaaggcatttgttgctgaaaggcttctgttcttgtgtgtccattccaaatacgtgtgcgtgtgccgcaatactgaaagaaaaaagatatgcgtcgtcgccggcgttcgtcgccaagaaatataatgaattcagcatatacttgtctatgaattcagcgaaggtactgcaaaagtatttgaagtgccaaaattactgcacaaaaaatttatttagtttgcaaactaggaacaaaaaattgattcaagaggccaccaaattaaatcctctagcctcactatgataacaattaagcatcttaatgttaactctgaatagctgagcatgtatactttgatgtaatagaacgtcatactagcatgcacacattattacttctctcttttctggctttaccactgtttattaagtccatatatctgtcgatgcagcactgattcgtttagacttttcactaccattatcttacttcttcgcaagttcaacctcagagattcaaatggaatctactgtgacccatggcgatgacactggcatgacactaaagcattaacagaagcagaatactgagcatatagatgag

SEQ ID NO: 42027 - DNA, 1501 bp, Oryza sativa
tctctcttccaccgccgccgcgcctttgttgccaccttgcagctgtcgacctcgcctcccttcgccgtcgcgcgtgctggtgaagccggcgtgtgcgcgaggagccgaagaggactccggccacccttcttcttccccttccccagcccaaggccggagaactcgccccgcgccttcgaccgcccatcactgcccgcccggctctatagtgcctcctcccgttccccttcctcgctctccgtcgccccctctagtctgcgtgatagctcagtggcactcccgaacacgcgtagacgccgcccctagacccgccgccgcccagcatggcctcgccgccgttgccgcccgctcccggaggccgccgctcgtcgccagccctccttggtgctcttctgccccatcggacgccggaaacggactccttgaaccccggagatgcttccaccgcctctaattgaatcctcgtcgcccctccgccgtttgccccttttctcaccgccggcgagcgccgccgcgattcgtcgtcgccggtctcccttcggtgaatccgagccggtggcgcactttatctcctccgtctcattattccggtgtgctccctccctctcgaatcgtcgcgacaagctcgggtgaactcgaacgccgtccgccgtccattcgaccgcgccccctttcttcctcctctcgccggcccgcgtggccgctgcgtaggcgccacgtcggtgccaactcggctagaccgagtcaaaccggccagcctcgcttccccctacgtgcgtgcgcagaccacggtgagccatgcggctacacgtgggcccatcgcgcctcgctccacccggcgcacgcgcccaaaccgcgtccaccaaaccctatcgccgcccctcccgtgagcccttccctcagtgaacctagtcaccgacaagcgggccccacccgggaccccgcgaggtgcacccggtccaccggtcggcctccccctcccgcgcgcccctaatgggccgaccacccgcgcccgcgccggcccaatggcctgaccgcgctgcgcatgaccccttgggccgcgcctaagccgcccgagtaagtctaaatgacatccctccttccttttcttttccaaaggatttgataaatccttttcctttagacagaaaatccaaataatcttaggaaatccatatctcctcaaccgctcgtccgattgactccattcctcttccagtaattccgtaaattgagatctatttaatggcactattatttagtctaaatagggtctttttcttggtcttttgtctaggttttcgattgtttgcgtatagttgcggttaccggattttcgtcgatcgtggatttctcgaagattcgagaagctcagtgaagactttgagcaaggcaagtcaccctttgtccaattgctcctataattggaaaatcattattattttgtttgcaacttgcattattagaatcacacacttaatttgcttggcctcggtttgtg

SEQ ID NO: 42028 - DNA, 1501 bp, Oryza sativa
tcaagacaaatctattcatataatttttacattttcaaactcaataactcgagagttattcatgatttatattttcaaggtttgacttaaacattgtcataaacgattttctttacgagtacggagagaggacatgatttatgattaaagtctgttgaaatcaatcatttggaacatgctattatatgttttttttaacttactcagacttctctgtaatttttttctggttccatcactgacaatgatttatttgctagccagtagggtccggacacgtgtcatattaactggatatgcttatctcggagcatgttgagctgctgaccaggacaaattctttctagtaagctttgtcatcttctttttctcccatctgaatgaaagcgttgtcgcttttggggctttctgcatcatataatgttcacctgcaggtttgctgatctgtaggatttctcattttgtttgtgtctgcttgacaaatgacagccaaaatttattagtgattactccttttgcctcaaaagaaattagtgattgctcttttttttcctacaatgaagtacataatgtctaaaatttcagcatccatgttgtttttgataggtcagcattcatgtgttacctaacgtgaaaaggaaatcatggactgatagtccttgcatgaaagatggcagcattcgtctgtaaaacatattcggttcagaaattccatatgccatatgttagcttatgtccaattgtgaaattttatgcaatcattgggacaccattaaatttcattacgacaaaactttgaccaacaattattctattataacatattttttgtgaagcaaaattgatgtgattggattaattttcaaaagtacttttatatgattatacttttgtgtccataatatattagagaaatgtagggactaacatgggataaacaaaaatattcgaaggattttatacctctgaatgtatggacggagaaaaaaaaaactctgtttttagccccttctcgctgcttggagtctgtttttagccgccgtagtttctctatgcttaagtttttttttcttattttgctttttcttccttcccctagcataagccagtctggttgattgcgtggtgtaactaaaactctttttcttctaatatattaacgtgcaatttttttgcgcgttcgcgaaaaaaaaaccctactatctcagtagattcattactcgaaccagattgtaaactgtgaaattcggttcgatatgaatgaattctgcaaaattacatgaaaacccattcatctatgggccttctgttgctctcttcaacaactgtatgggcccaagcccaaaactgcccatgggctacaaacgaaggcccaatttggcctatacgatccacacctgaagcaacaagaaccagaggagacgacggtggcggcggctggggagagagaggagaggagaggagagagaggggaggagaggtagaggaggcgagagctcga

SEQ ID NO: 42029 - DNA, 184 bp, Oryza sativa
caaggtatataatttgcacagaattctccatctgcaatccacagtgtcgcgccgccaagcctaccttaacggcgcggttagtcgacgcgcttgacaccgacatcgtctatgctatccaccctaacgtcctatgtgccatctctatactaaccacctcgttgaaaacccgttgtggaccctcaga

SEQ ID NO: 42030 - DNA, 1501 bp, Oryza sativa
agcgcgtcgactaaccgcgccgttaagttaggctggcgggcgcgacactgtggaatgcagatggagaattatgtgcaaattaaaaccatgataactttgccttccggtcatggaatcgagctaggttttttttgatggcttcagaatcacgggcctcaccgaagagagaccggatttggagagttggacccccagagatttttctagaaattacttaccataggccacgaagcagcggttgtttcggcgaaacgtcgaatatctgagggtccacaactggttttcaacgaggtggttagtattgggatggcacataggacgttagggtggatagcttagatgatgtcggtgtcaagcgtgtcgactaaccgcgccgttaaggtaggctggcgggcgcgacactatggaatgcagatggagaattctgtgcaaattaaaaccttgataactttgccttccggtcatggaatcgagctaggttttttttgacggctgcagaatcacgggcctcaccctaaagagattggatttggagagttggtgtcgcgaccgagaaaaatacattttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcatacggctccatcttcacaggcgctcaactggggtataagccaggactccacctaagacttcttctccaaagcttctcttactgaaggggggggggaaagattgagcaagaatgagtacaaccacagtactcagcaagccacaccggtggatgcatgattaatgcaagggggtacaaggggtaataatataggggttaagttttgtagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaactaaaacactaacttgggtacattgctaggcttgcccataaccgagggcgcggctattcgaatagattatactctgatcagaggtgtacatctttacccaaaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagcccctagcagcaggacaccagccctgtgccatgacatctcgactaccgagccacagctcatgtagccttcatttgtcctaga

SEQ ID NO: 42031 - DNA, 1501 bp, Oryza sativa
cgacgtttcgccgaataaaccgctgcttcctggcctatggtaagtaatttctagaaaaatctctgggggtccaactctccaaatccagtctctctagggtgaggcccgtgggtctgaagccatcaaaaaaaacctagctcgattccatgaccggaaggcacagttatcaaggttttaatttgcacagaattctccatctgcattccacactgtcgcgcccgccagcctaccttaacggcgcggttagtcgacgcgcttgacactgacatcgtctaagctatacaccctaacgtcctatgtgccttccctatactaaccacctcgttgaaaaccagttgtcgaccctcagatattcgacgtttcgccgaaacaaccgctgctgcgtgtcctatggtaagtaatttctagaaaaatctctgggggtccaactctccaaatccagtctctcttctgtgaggcccgtgattctgcagccgtcaaaaaaaacctagcttgataccatgaccggaaggcaaagttatcaaggttttaattttcacagaattctccatctgcattccacagtgtcgcgcccgccagcctaccttaacggcgcggatagtcgacgcgcttgacaccgacatcttctaagctatccaccctaacgtcctatgtgccatccctatactaaccacctcgttgaaaaccggttgtggacccttagatattcgacgtttcgccgaaacaaccgctgcttcgtggcctatggtaagtaatttctagaaaaatctctgggggtccaattgtcacgccctgataaattcatcccgaaataaaaatcattttctaaaaggaataatagagttaattaaaattcgaaaagaaattggcaaacactaaaatacgtacaagaaaaattcaaatgtggcccggagaatttttgttaaattctccttgttctaaaaggagccctcaaaatttacttgaattttcagagcaccgaaaatatttattaaacaacaacaacaattaacaaagtttattaaaaagaaaaagctaaaaataaatcctccttcctcctttgggccaagcccagcaaaagtctccctctcctccctctctttccctcctctcccgggcctgtcctcctcctcccggcccactcttcccctccccctctcggcccactccctcctcctccctctccctcccgggctgcctctccctcctctcctcctgggccgcctcggcttcgcccggcccaagccgagccgcgcctcccacccatgccgcgcacgtgcgcgtgcgtgcgcgccgttgccgcgcgttgaccgcgcgcctgcgtggggcccacgcgccaggtcgtcgttctcctcccgcccggcctcctcctctctcctccgtgaaccctagccatttcctccctcaaatccgcttgattcatttggctaattccaaaattgattagggggttttaatccccattgattcctcttcaattccccccaatttcccccttgat

SEQ ID NO: 42032 - DNA, 517 bp, Oryza sativa
attcctgcacccccctctaacaaatcggccggagaaggaaaggaacggccggatttggaaagcggcggcgacggcagctcggcggcgcgaaactagggtttcggcccgaggaagacgacgactgacgggtgggccccacctgtcagcgacagcgcgctcgcgcgggcggctgcggactgggccggactgggctgaggagagagaagggattttgggccgactttcggcccaaagccaaaagagactttttaaaacctttttcaatttaaattatttcttaaatgcaattccatttattaaaaatactttcttagctcaaataaatcccagaaaaatctaggaattatagaattaagcaaagtatatatattttgaattttcagggtgtgacaaatggtttggttattgtggaattggcttcacaccgctccttctattcaaaatccccaaaatggttttaggctgggctcggggtgcatggttttgatagtagcacctcggccatataaggaccggt

SEQ ID NO: 42033 - DNA, 1501 bp, Oryza sativa
tcgtaggccttgggttaaggcaggttcgtgagggttcacggccttgattaataacactgtgtaactctaggatcgtctttataaaatggctttgggcaactaagtgacttttaaatgctgttttctacaaaacttaacccctatattattaccccttgtacccccttgcattaatcatgcatccaccggtgtggcttgctgagtactgtggttgtactcattcttgctcaatctttccccccccccttcagtaagagaagctttggagaagaagtcttaggtggagtcctggcttataccccagttgagcgcctgtgaagatggagccgtatgcccgctagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaatgtatttttctcggtcgcgacaccaactctccaaatccaatctctttagggtgaggcccgtgattctgcagccgtcaaaaaaaacctagctcgattccatgaccggaaggcaaagttatcaaggttttaatttgcacagaattctccatctgcattccatagtgtcgcgcccgccagcctaccttaacggcgcggttagtcgacacgcttgacaccgacatcatctaagctatccaccctaacgtcctatgtgccatcccaatactaaccacctcgttgaaaaccagttgtggaccctcagatattcgacgtttcgccgaaacaaccgctgcttcgtggcctatggtaagtaatttctagaaaaatctctgggggtccaactctccaaatccggtctctcttcggtgaggcccgtgattctgaagccatcaaaaaaaacctagctcgattccatgaccggaaggcaaagttatcatggttttaatttgcacataattctccatctgcattccacagtgtcgcgcccgccagcctaacttaacggcgcggttagtcgacgcgcttgacaccgacattgtctaagctatccaccctaacgtcctatgtgccatccctatactaaccacctcgttgaaaaccagttgtggaccctcagatattcgacgtttcgccgaaacaaccgctgcttcgtggcctatggtatgtaatttctagaaaaatctctgggggtccaactctccaaatccagtgtctctagggtgaggcccgtgattatgcagccgtcaaaagaaacctagctcgattccatgaccggaaggcaaagttatcaaggttttaatttgcacagaattctccatctgcattccagtgtcgcgcccgccagcctaccttaacggcacggttagtcgacgcgtttgacaccgacatcgtctaagctatccaccctaacgtcctatgttccatccctgtactaaccacctcgttgaaaaccagttgtggaccctc

SEQ ID NO: 42034 - DNA, 1501 bp, Oryza sativa
ctagcggggcttcagctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagatgtgcaaggggatacaaggatggtttgtggctatttgcataaaggaggttgtaaaacattttattgagcaaaacagtaaaactgttgagtaattaaagtaatattgaatctccattgatcaacgctacaccacattgaacaggcccaaccaacccacctgaactacagtgtattgagtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataatcccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgcagctcattctgatattaaaaggtctaatactgtaattatcccatcaactgagctagtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttaccttgcttcttcactttgatcttccgaactcttatccttgcgaccgcgatcttccgaaacgacggattctacacgctggcacgcaaaacgaggaaaaactctaataaaaaccaaggaaacagtacataaaaactaaacaaacatgtagagctcaattttagatgaatttacaagttgaatggctcaattcggagttcgaatgaattagatatgaattttagaagttttgagccatttaaatgaatttctagaattattaacgaattatgacgcaattattatttatttttccaaagaaaaagatggttgct

SEQ ID NO: 42035 - DNA, 1501 bp, Oryza sativa
ctgagttgatccatgaaactgatgggatcctgatccgttgaaattgtccctcatgctgaccaattgctgcgggcacaagagagggagggggagatgagaggggttactaaagatgaggtactaaaccacttgcctattgatctgtggtgaatggattttatgattcaagttgtttaagcaaacaacctagtatggtcgcatccccaccaatgatgcaaaccatacccctacacacaagcaaacaacacacgatctagaaagctaacggaactactcttctgggaaggattgggtttgggtcagctccggggaaacttcacttgatcttcgcgggacgacgactctgggctgatcttcttgctccttctgcgcgaagcttgagatttgacttgacttgacttctgaacagacatgaagctgacggctggtcctctaggtgtgacaactaaaagaattggagagattgggaggagaattttgaaaaccgtttgacaaagaaatgccgaagggcgagaggagacaatttgcaaatagggttttcagaaaacttgtccttagggtttgaccatttggctcaacctacagtcaagttggctctgataccactttgccacgcccagaaatttaacccaaatttccagactattttgcgtattaaatccctgtccaggaccagccagggtacacaaaacgacaagtaatatacagttccaaacataaataaagcgtaaaatacttacggaagaggcacttagtcctcacaccgaaacagaacgacagcagcggaaaaaggcgatcctagcggggcttcagctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagatgtgcaaggggatacaaggatggtttgtggctatttgcataaaggaggttgtaaaacattttattgagcaaaacagtaaaactgttgagtaattaaagtaatattgaatctccattgatcaacgctacaccacattgaacaggcccaaccaacccacctgaactacagtgtattgagtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataatcccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctaga

SEQ ID NO: 42036 - DNA, 683 bp, Oryza sativa
  unsure (1)..(683): unsure at all n locations
cgcgccccttgattgactggcgcnctctgcaagnagctcatcatattcacggcattcaagcttctttatagctgttttgctatgtgaattttcaataatgtagccaactttaggttacactcatcatattttacaaagcagtcggtatatcactcggatcatgtcgttcaaggattcacaccgcatatgctacatattaatatcaagtcgcttggttgactacaattatcaaaaccactcagttggtgcatctattaggtacatctattcgatgcacctgactttattttttagccctccacagtcttcatatttggtaaaagcactcgggagatcatggcggagatgattgaagcactcggctttgaagtaatctagttcaagaaaagattatctttacgactgtgaaggtctcaggggctactgtggagattatgggtaccccatacccacacggcatggttatccgattagtcataggggatagcttatatctatggaatatgtaactgatcatgacttgggtattacgtttccttttatattatggagcggcctaaagtcctgatttgataatattgtaaaatagatttaggaaaccgataccgtattggttaaggtttctatcttgtaatcttgccccccatcctatataaggtgggcaggaagccctctaggggaca

SEQ ID NO: 42037 - DNA, 227 bp, Oryza sativa
tcgatttccgacgcgggcaaggcatgtataaatatggtattttgatcttgaactgaggtcctccaaggaggtattgacggcggcggaaattgaatccatcgaacatgtcgaggcggaaattgaatccatcgaacatgtcgagactgatcttcccggctagattggatccgagtcgaagagcaagagcatgttgaagtggtcggcgaaaaaaactcccgaagcgaaga

SEQ ID NO: 42038 - DNA, 1501 bp, Oryza sativa
gcggcgggcaatgggtggcggtggtgcccgaggaggtaggcggcggcgcaagaggggaggcggcgggcgacgggaggcggcgacgccctcccctccgccggatccggcaggaggggaggcaggaggtggcgggcgacgggttgcggcagcgccctccgctccctcagatctggccagccgtcgtcgccacttgccgctgccgtccgccaccctccagcgctaccgtccgctgccaccgcccaccgcccaccgctaccgtctgcttggagcgccatcgcctggatctgcgtcgccgctccctccgtcctccttcaccgccgccgctccctccagcgcccgctcgcccgccagccaacgccgacgccgttgggcccgttgccaagaggttctcctctcctctcccctcccctacaagctttgagaaaatatttgattgccccaagattttgagcattgtaatgtctgtgttgtgaaatggtggattcttataaattagcatttggtcatttaggatgaaatgctgatgcaatttaagaataattttgcaaatctagctcacgaattgtaggtagcagctgttgtaggataattgacctctctttgcattttttttttgattggcctctcttctgcatcgacacagtcctccaccgccgttgccctccgacgccgtcctcctcccactgtccaccctccctcctggtcaccaacaccgtcgtgttcttctgcgtcgactccggtcaccaacacaaggtgatcgatcttgcctgatgctgtaattatgtattataacatatgcttgcctggctgatcgatctttgtggtccagattaattggggagccgctctttgatcatttgatatgtgtgtgttttgaaatggggaaattttggtaaattcttgttctgaaatgtatgctgaacttgatcttttcaggaaagattaattgtaaattatgagttgttgtgttgatggataggagtagcagaagatgagttgtgaatatcctattagtattaatagaaatgagtcactggagaggaggggttaaaatgcttttgtgtagctttgggaaagttaatatagaacttgatgcaatctgaaatctgaacttgatggtgcagttttgtatatgccatgaacctgtgtattccatgaatttgaaacaatatgaggatgctagaatgcagtaaacctggaaattttcttttcatgacgtagacctgttacaaatatcaatattacttgattgcaatttttagaatcatagaatagggtatgtttttgctgaatgacagttggacagctgccccatatttattttgtgatgtaatctgaaatctgaaaaatgtgaaggatgtggatgtgcaagatgtgaatgtaatattctgtgacttgtgtggaggatgtggatgtggaggatgcgaatataatattgtgtcatttttgtgtttcaggatatatttctgttgcgctatttattttttttggcttttattag

SEQ ID NO: 42039 - DNA, 263 bp, Oryza sativa
cgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggaatttattagagtaaaagccttttcttttccgttggtcgtgtagacgctgcagcttcggaagatccgctcttcgtgg

SEQ ID NO: 42040 - DNA, 1501 bp, Oryza sativa
gtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggcttggatacgtcgtgcgcgtcgatcagcttgggtcgcaatgcctcgatcagcagtagccggcggaagccatcaacggccctgcgacctcggagagtcggcagcatgtagatgaccgaccggggcagctgtaaagcctaatgataacagctcggaggcgaccgactacggagacggtggagccggtcggcgctgacggatatagccggcagtagatacggccggcggtgtacatgcaagacagatagcaacaaaataattgctggttagaatcaactagtaaacagattaactctgtagatgtaatgtgcatgttggttggatcgtgcatgtatgttgatcagttgaatcaactcatgcagtgttttctcctggtaaactgtgcccagcgatggccaccacatgtccgccggcaaagcacgaagaaagtctcgatgcgtgagggcgtcgtcgacagcttcggcttgatctccgccgaccgacacaagatcgacacaggaaaatataccagaagattgatctatgatagaaaaaaaattaatctaataaaaaatagattggaacgacaaacccggtccaaagttcgagccatcgaattcggtgagattgatctcgccgtttcttctgaagtggattccatctcacttttcgacgggtaattcgacgcatcccctacctggcgcgccaactgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccgggtgtattatagatctgacgatctagttgtctcatgtatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatacaagttatcccctataactagtcggataaccatgccgtgt

SEQ ID NO: 42041 - DNA, 837 bp, Oryza sativa
tttaacaataaaataagtcataaaaaaattagtgtactttttttaataagacaaattatcaaattttgttgtcaaagtcaactgcgttatgaccagaggaagtaccggaatttctcttaacatacagttggcattgtcttaattgtattggacttgtcgagcttggtgtttttttgtgggcatttctgacatgattttccctaatctatttacaggaggaaccattaactttgacaggacctaataatcgagtacttggtgcactagacagaatagagttacatttaaagattagagacgatggtggtgttgaccaagatttctgcgagaagccgagaacacaatgcatcagctataattttttaggttcataatataaatttagtgaaagtggcaacaaaatgtccggaccagtatgtgaacaagtagaatcgaatggcaaattaatcttctgtagctgccataaaattaggaacaaaattatgtagctctgtgatggaaagcttgaaggagctcagaattccagtcaatttctagtatacaaaagaaaaactaaaaaaaagtttaaactcaaagcccactagtaaatactactaatacaactaaggcccatattgggcccacacggcccacgaacagcaacctaatcctcgcgctggaagagacgagacagtacgccacgcgccgcctgagccctcgcgtcgcgacaccgctcgccgcggcggcgctgctcctctccagcgaccacgcgaggagggagaagaggaggaagaaggcgagaagggagcaagctagaagagtgggagagggggacatctaggtcgtcgacggcctcaa

SEQ ID NO: 42042 - DNA, 416 bp, Oryza sativa
cacctatcatacacactgcgtcttggagtccgtgctacagctggctacaaatctgtagcccgctacccttctctctcctcatttatcttcttaaaatatgtttgcagctggtttatagcctgctattgtacctgccctaagaaaaaacacagagatcaaaaacaactaaatcattatgtaattaattcacatcggttaagatactacactagtaatgtatcccatggattgcattaaatttttaatattgcatgtagttgtaccaccaatagtaattaatcttggttagttgtatgcagcgcattcaatgatgctaatttactctttatataaataaataaagatatatttgttaaatgatgatcattttggaaagatctcaaaaatcttagctgatgatcaaactggaataggag

SEQ ID NO: 42043 - DNA, 630 bp, Oryza sativa
tcaggaatatagtttatttttttctagggaatgggttggagctctgccatttcactgatagaagaaagcaggaatgtagtttatgcatttatatgtatatgttgaagacgtattattatatccttgctgacattgttggattttgtcaaaatagatacatgcatctcatgttagagaaggaaaaaaaaaaggacaacagttagacagctgtttcttgaaacctcctcttaggacaggaaaaaaaaatgttatgctgtttgttgttaatgaaaaaaaaaactttatgcttaagatttcaactaattgagcgggtttcacattttttttgtaaagattctgactgaggcagcaactgaatatgcatatggtaatgtcaagaggcatacgattatagaacataatagaagtaatttgaaatttggtagtccctggatctcgattgggtggatgtttcttaattctgaatagtgtaatgagtaggcttgcttgcactcttttttttttagctgggccagccaaagtaggctgactaattacattaggattgggagatagttttacatggtagataatgaaggttttacattgacagaagactgttgaacagttgagttaccacaactgcctgcc

SEQ ID NO: 42044 - DNA, 217 bp, Oryza sativa
aaacatatattattagtcacagtgctgttcagtccttttctgtcaggaacagcaatcaccttgtacattatgttcatttatatgagaagaaaatttaatttgttgatatgttgtcaaaactcaaaagtgttcatattcactattctatgtcatatctgattttctcacggatcactccaactgcagcagctggacaagcaaaagtagtccatgggcc

SEQ ID NO: 42045 - DNA, 1501 bp, Oryza sativa
taattatgcttggcttgaggccttaatcgtaccggtgaatattaatatgcgccctggcacgtacactggcccaactatacaggtatggcctaatttctacatattattgttgatgttgtcttctgtagcaaccaaaacgtgcttgggagttgagagttgagagttgagactgtttctgatggaagtaatatttgtctttttttctaggaacatctgccataatcaataaaaatggataggacaggagcatcaaactatgtccaagtgcaatctcacaaatacagttcttgtcatgtagtgatgtaaatgtaacatgttcatctttacattttgatttatgttggaacttccttcatagaaaaggtgtggctatagtggtgacatagtcaaaacagtttgtactagctactccgtatcatagttaccaacctgcattctaaattgcttctggagagattgtaaatgtatttatgttaatgtctacatttttctctgtttcgatgccttcagaattcagagaggctggttgccatggtgtcgatatggtctgatattcaaatattcaacaaaccttgttaagatggcagttgagcttcactcacaatctgtggattatggtgctccattttgtacatgttcttttcgtatttttattgggatcacaaagcgaactcaatgcaatttaagaacgagtgaaagtgcgaaactgacaagctgggagctcgaaagtccattctgggttctggcgatagtgttgggcttgggtaggaactcatcatgggccatctataactattcgggcccaatatgtatgggctggacatgaactataatactgttttggcccaatatatatgggccgtatgtgagccacattaccattccagacggcgcagccgcgttcaggcccatagatttgggctcagcacgcaggacctggccttcttgggcttcttgcgggaagttcaaatttttgcaccacattggcgcgggcacgtgaaagctacttgaattgggaccgtccacgcacgatctgacggccatcattgcatggcgtcttcagctgatggcaagacacgctcaggctggtctcagatatactagatactagtactagattagcagctactagtagctaatttttgttaaaagaaaaaaagggggaaaaaagaggcaaaacgtggtaacatggattgagcagtaaatttgcaagaccatgaagcacccatttccattaccagaaatgagaagttctacagttcttaaacctccaaaacaagagccaagaacatccacagttcacactgccagcacctgaagaccctacaaactaaaacgagctactaacctccactacatgtgtgaagcaaaccagggccaaataataggagctagcaactcaagccatcatcaacaaaacccaccacccaactgacaacagcaagcacgcagaaaaaacacactcagattctggagacgctgagccacgaaaatataaagc

SEQ ID NO: 42046 - DNA, 1501 bp, Oryza sativa
gaaatcaagcatcggcctttagtatataatttttcttcacataatagccagatgcttggtgtatcaaactattggaccaaattttcttctctatagacatatgaaaaactataacatccaactaacatgtctagatgaatactaattcaaatggcttttaaaacaataatcatcatggcatcaaaacacttagccaattgaagtataatcaataatgaatcaccaaagtcatatgtgtcacatgcatagattccaataaactacaaatgtaagtaattggcttgagcgtgtatgcaaaatattaacaatgccaatgttcctaaataaaataactctaaaacaaatcatcacattgaccattgatattagccgaattactaataagcaaaactttcatggtgcaataaatctatatcttatatggtgacccataaaaacacatacgatttggctttaaataaatattaaagactgatgagccaaatcatacttcaaacatattatatgccaacctaccaattccaccacttagaactggcatttgcaacatgtatgtataatatggatttgataagcaaaacacacatgtgctaaatatcaagctgtcgacgggtgatacccgtagaccggatatagagggtattggggtacgttggtacaaggatctacgtagtacgacatcaagcaataaaagacaaaaattatactggttcaggccccttgataggtaatagccctaatctagttgatatgggattatatgatggaaaaccacaggttacaaagggaacaatggaactcgatgaagccggcgagatcgtaatcaagttgattcgactagatccccggcgatttggctcctgcaggctccgacttcgtaggctgtgggggttgtgttggctatcagattccatcctttaggtcctcccagggggtcccttttatatcgcaaatcaggtggtctccaagtcgaactcggagacatcggaccctacacgatatattgacgaccctgtcttgtccgagtaggacttaaacactgtggaagatttccttagtatatgcagataatgtccatgtatgcgcgggtatgccatgtcgatatgtggcgcatatcaaaggctaaggggtacacctaacccgtaaccctgacagtagcccccaacttctgcttaaatgaacccgtgcgaccaataacgacttctgatgtcgaggctgatgtcgttctcggtgtgggaaccgtagagacaggacatgatcgagaacaccgtgtgaagcccaacggtcacgagtgagtttaaactaaagtctgaaaaaccgccgcgcgtaacggacccagaaatttccggcggccatctctcttctttccttggaattcgcaccgtcggaagtgcgtctatttaagggagttttggggattcatttgaagtccgcctgtagtggaaaaattctccagcccccaagcgcctctcgtcttctccactcccgcaaaaaccctagt

SEQ ID NO: 42047 - DNA, 1501 bp, Oryza sativa
accgaagatgcacaatatacacaagatgtatgattttatttactggtgcatatttccccatccgtttctgattaagatataaattcatatataaattatacctcggttccgttagcatattttttaattgctaaatggtgtatttcgtgcaaaatctttttatatagaagttaatttaaaatactccctccgttttaggttataagacattttgattttggttaaagtcaaactgttttaagtttgataagtttgtagaaaaaagtaataacattttcaacccaagacaaatttgttatgaaaatatattctattattaatttgatgaaactaatttagtagtataaatattaaagtgaatttcacaaaaccccaggttttgaggtgctcgtaacacaaaaccccaagttctactatttgtttcaagaaaccccatgttttggagcaaaatatttcaagagaccccatatttactcaaatactcataatttaaatattatatatgattatttagtatatgtttacattagtaggtttcaaaaacacatcccatcctatgtaatttatctttttctcactcttgagttgcacaaatgataaaaacgcaacataacctcattaataataacacattaacctattatttacaggtataaacaaacatactaccaatgacctatattcattaaaatgaggctaacatttatatatactcaaaaatatctcgtattattatttttgtaattattatgcataaatatattagccaaaaacgatgatataagcttaaacatgtggtttcttgaaacattttgacccaaaacttagggttctttaaaacaaatcgtaatacctgaggttttgtgttataggtgccccaaaacccggggtttctgaaattcactctaaatattactatatttatctataaacttagtcaaacttgaaataatttaattttgaccaaacttaaaatgtcttataacctgaaatggagggaataccgtataaatctaattttaattttttttaataacgaaaacataattaattatactaatagggtttctagtttttcatacctttatttcatcatcaatcatcatattaagttaaatctatctcaaacaccattgtaagagtagcttcgaaaaaattgggaagaaaaaaagcaatcattatccgaggtgtcacaccatccatcctcttcttctcctggtgagggggaaccatgggcgcacacgcttcactgcgtctttttccatccaaccccctataaaatctccaaatccaacaccccacctcacctcttcctcctcgtctcgtctcttctcgtcgccggtggattcgccgccgcctccgccgccgccgccggaggaggaggacgaggagagggcgctccctcgggggtgagcatccagccacctcggcccgttgcctcctcttcgcatctcggccccgcgagattggaagtgagggcagggcagggcggcaggggcca

SEQ ID NO: 42048 - DNA, 166 bp, Oryza sativa
ggtgtgcgttcctgcagtagttcatcacagaggaaagttgatgggtatatcaaggatcaaagaatctactgtaatcactgcaaccgagtggtgcgctcctttcttatttatgatatataatttacttctatcatactccatgaaataattaactttttgtatatga

SEQ ID NO: 42049 - DNA, 652 bp, Oryza sativa
atttattaaaaatacccacaagccaatttgacataaatcttggtgaattttagttgttggaggctcttttaggcttttaaaatttctagaaatgcattacagcacgatttaaatttagggcaatttttagggcgttacaatatccgtgtgcttgtagattttatctgtgatcgtaaaaaataccaacacccacctctcatccgccgcatataaccccaaataatgatatcccgtaatctagacaccacgcctaaactatcagatactactctaatatcatcgtcctgacatagagtaattgcatatgcaaacattatacccgcaccgaagcatctcccagataagctagcagtataatcagtataacatgaacataatgtaaagttggcattcatatactcggaaagtatttcaataccataaatgtataaagaagagtattctaaataaagtacatagcttacaaaagagaagagaagagttactatagccatacccgaactcttccgaaggcttccggactcctgatttctactctattcctattccactagcttaagaacattaaactaacttgagagaatataagagagctcttgcttgaggtgtgtgttgaagtgaagagagtgaagtccttatatagaggtagtta

SEQ ID NO: 42050 - DNA, 570 bp, Oryza sativa
  unsure (1)..(570): unsure at all n locations
tcgtctgtatgtagggagtattcagattattgggttgtttnctatcacctcctatcactccgacctttcttatattagtgagatttcgcggactcttatataaatccnntnttccnnnnnnnnnnaagagttagattttgcattgcagtaccacntctcactataccgcgaattcgagctcggtacccaaatagtacttgcggtaaataataccgcgctgcgtgcacataacacaaggttgttgttctgtctatattggctgattgcataaagaaacataaatctggctgaggtgaataattgatcattcggagccctctatatttattgatattgaagccacaaccatctaataactggctggtataggtgaagattatcgcctggaatgtatatttacatagggaatcacatatacccagataacaggttaggacctaatattggcataacatctaattgctttagtcttttatcctgaaaattgaacacttgttcttactgaaaacagaactttgatggatgtctttattgcagaacacttgctcgaccaagttcctccacgaagcc

SEQ ID NO: 42051 - DNA, 637 bp, Oryza sativa
ttatataagtttaggggtgcacatttcttgttttgtggttaagggatctcaaaaaatcttggtgttaaattgagggacctccggtgaacttattccataatatccccaatgttctcaccgccacccattggatccaggatgagaaaatggagacacagagttgcagatagagatcaggtgtcgtcacaatcatgcaagctccatagattggtgttccatgactgatgtgagatcggccacgtcaagtgcaagagcgtgtgcaggcgcaggcatcgtgagagcctgagaggagtggcccaacagactcttagattgatggactcaacacaatatcgattgatcacaacgccgagtacatataggcacataatcatccttatcctagtatcctactcaaccagtttatagaaacatgcctgggagggatattgggaggactggccaaaagaaagaaaacatgcgatatacatgagatatgctaacacccccggcaatcgcaacgtcaacaggctggacattgagactagaccgaaactcaaagaagacatcagtcggcaacccttttgtgaatatatcagcatactgggatgtagttcacacatgtagaacttgaatagtgcgagtagtcacacaacca

SEQ ID NO: 42052 - DNA, 701 bp, Oryza sativa
cctcatcttccagaagtggctcgggagattcgtgagggggaactgctgtaactgtaacacccaagaaaaccacataagcctgggatgccactaaacaaccacacataagtgccaaaacaagaaaattttggcaacaactaccttagacaagaaaacatcgcggaagcatcaacatatagattaaggttatgatacaacaatggactgacatgtagggataggcttgaaaaggtagctcattaatggtcaacacttctagtgtttaattaacccattatgtctaaacacaagtaatcctatcagcatattacaataatcatgactaagtgagatcatgtcgtgcaacagtgtagctaatcccatcccttcacgcaaacatatcaacagcaagtacctgaaaagactataaggggatgagaataaatctcagcaagcaaacggctttaacaagctacttaaaccacaggtggattatatagttaattaaatactaagttatgattcacataaagacaagttgaatatccatagactaaaaatatcatgacgtcaccaatcaaatccatatactcacaaatcccagagaagaaaacacttctcaaagatatcttcgatcgatatttcacgtaacatcctgcaatatgtacatatgcaatgcaatgatatgtactcctgctttcacacccaacagggtgaataaa

SEQ ID NO: 42053 - DNA, 255 bp, Oryza sativa
atccagaagtgaccgagttcaatgaggatgcggcatggcaaattatcatggcaaattatccctataagaactttatgttttccttttatctttaggaaagtttcttttttgtcctaaaagaactagtatctccccatgggtataaatatgtacacccggggtcattataatttagctctcgatcaataatactctcggcgcatcgccaccctcttttctgaggtttttacttatcaaccgacgaaatttggcacc

SEQ ID NO: 42054 - DNA, 1501 bp, Oryza sativa
tttaactcctggcacacacaattatgcatagctggaagtatatctgtttcaaattacttgtggttctagcaaatctcatacaaatcaaaaggatatcgaagattacatagttgccccattaaatacatctcaattttttttgttttcaaagcatataaaccaatgggagttattgggagtttatgactgtattaatgcatgactatattgatgaaaaggtggagataagatcacctctaaaaaggctttgaattgtgagaaccatataagtaatttgataaaaaaaatgaaatgctagaatggtaagtaatatatatgaaactgagggagtactgatttttttgaagaagttaggatttatacttagctaacgactattaagcgtgttcaaacacggtgtactagagagtttgtgattaaggtgatgtgtttgtcggtatatcttgctgtgaaaaaacaaggtatggttcatgttcgccaaacacaattttactataaaaattaatttctaattgtataaaggtaaagctccaagtaactccatttttcactcaaacaattaaacaacgcccgcacccaactaaaatcagcttttttaaaaaaaaaaaccatatccaacaagataacctatgtaaaagaaaatttattttttcatggtaatttgtatatgattttaaatattggtgttctaaaccaatcttacgtcctatgcaaataataattaaattaaacatcctgaaaaactcgaagtataatgttactatcattcactccacaaatttcaccttaaaaaaacgccttttcactaaaaaaaattcaccttaaaataagactcgtgtaatgcgaagcgagaaaattattgaaaaataatattatacagaaaagcgaacaatttcatgcatggtgttgatataataattagtactgtggcaaaatagtttaaactaggaaagtggtatttttccaataaatcctaccatttaacctacataaagttggattaattgacaggggttaagcatgctattataccgatcgacacatacacgctccaccattgacttttgaaagaaaaaaatggaaaaattaggccaagaccactaacattaattaggtgtaaagaagaggtatgaacacccgaagctcatgagtggaggatgctgtaaattatatatactcacagagttgtaaatttacaggtttgatcttttgattacgacatgaactgtagtttaattgcaattgatggcatcgtattaaagagacagcaaactcttctatttgtattgagtgttttagcaggagactaaatcgatctacttattatcagtccatttgtgaatagcaagtaagcacatgaacaagcactgcaatcaatgatcaatttaacatgtggcgtaagaaataaatgtgaaaataaatcgtgggtagatactagggatgaaaactgaacggatagttttcatctgctccagagaaattaaaacgaatatagatacct

SEQ ID NO: 42055 - DNA, 1501 bp, Oryza sativa
tcctcgtaaagatcggcaaagtaggattaagtatagttttgatgtggccaaatatgataagatctttgattatcttttgcaagaaaaacaaattagattacctaaaggtcatattatatcatcttaagaagaattgaaacgtcaagcttattgtaaatggcatgattctcactctcattctactattgattgcaatgtgtttcgacaacaggttcaatcggctataaatgaaggacgattgaagtttaccgatggttccaagatgaagcttgatcatgatccttttccggtgaacataattaattttgatgataagaaggtattgattcggccggagcaagccgaatctacaaaggggaaaggaatggtcattggagagcctaggccaaaaatgatggtgccaaagaatccggaggttggtgtttgcaaggaaaataggagtgaagcttcaacttctagagttcctaagaagactaaggtgaccttcaatatgcttttggagaagtatgagaagcaaggcggtgagagagatcgcaacaaaggaaaaagaccaagatcacctcctagggagcgatttggtcattgaccaagacggtcggaatcacctccatatcatcattctcaagacatgtcatgggggccttacccaatgccgccgccgggttatccttatccttactacatgccatggggggcaacaacgccaatgttcaatcatatgcctccaatgcaattcaaccaagggtagggaggaccaaggaggccaattcatgagcatttgtcttcatcaaacaatggttggttttatggtaagaaccgggccaatggagaaaagcgggaaggaaagcgcgtcaaggtgaagactaggacttcggaggtgattaccatcaaagtggggtctcatgatgtgccaataccttctggagatgaagttggggagtcctcaagcaacaaatctgaagccggtaccagctcatcgaagtcggccgatctgaccaggccctctggccggtctaaccgcagccatacgggcggtctgatcgccaatccaacaacggtctgtccgacgcctcaggccggtctgaccgctgacctaatgtcggtctgaccggcacctccggccggtctcaccggtggtctaagtccggtctgaccgggctccagcgccagtttgacaggaggtttgcaggaagcaatgtaggggcttcctcgtcttcaaatagacttaacagggggcactatttacctcctggaacaaagcagaaacctaggtggatgcctgaggatttgacggctactccaaggagaaggttgcaacgtcttcgggctcaagagataagagagaaaaaggccgaagaacaaagagataggaggttcaatgagttgtgaccaccaccggtatggaggagtaaattcgtagagaaggaagaaccagttgttttgcaagaggaaaaggaagaacaatcagttactaaagatgaagcatctccaaaggaagaca

SEQ ID NO: 42056 - DNA, 1213 bp, Oryza sativa
atccatttttatgtcattgttgttaaattaatttgattattgattgttgagagcctcaccaggtaaaaaggagccataaaaagatgcttgcttcacttaaatttatggatagaaataaatccaaggtcccatagacaatacaagattttatggaccaaaagcaacttttcttagcagtatgttccattaacaatggggcatgtagagtcagactcttcggggcttgatagcatcatattgaactatgacataatatctatgatataatatctgttatatgtaaacggattggatagcctactaaaattatatatttatttcttatgtttgatctatgaattgtgttcagtttcaggaagaattcaatgcaaagtttaaactgaaggccccaaattgtataataaatttaaggtggtcttgatgaaggatcaacttcattttcgagatatatggaatgcatgcagatttataatacattctcattagttcgaaactcagtactatcagattttgtatttcttcgatatttcaaaatcccctgtgctttggttgcactatgagaatttctaatttctttcattgtcatttgtatagatattcaaatgatgatagatttcttccatttttccaatgatttatttctttcttacatggatccttgtgcaatgtactctgttcgcatacagtatagttttgttttcccccttttcagcctgaatataattttcaggaagttttgattcttcattcttctatggatcgaaatgaatcggtttggctatatattgagtctgcaaaatattagattgatggaatatatattgtgaaaaacgtgcattgcacgtgcacgattactagtatatatatgtgtgtgtatgtatatatacatgtatatatgtatatgtgtgtatatatatacatgtatacatgtatatatatgtgtgtgtgtaaatttttagtgtaaatttcgatatctctcaaaaccattttacactttaaaaatatgttaattgggaagctactttaaaaaataaacatggaagcactagggatgcaagtgggtagttccgctatcttcataaaaatccgcttgctagtttattttctatatggtagtataaaatttagaagaaaaaataaatcagaagtgagataagcgggcaatcgttcttccgttttagcagataaattgcgccacgatgcattttggaca

SEQ ID NO: 42057 - DNA, 1501 bp, Oryza sativa
gctagcaatactttgaaggtttatttgtctctagcatagcttgtatgtgttctagtcttttcatgagatttagattttgtttttaagggagatgatgcatgacacttaaatttcacttgaattaagaaaatgtgcaatattgatgctagcatatggtttgatttataaatgctctatatatatgctttattgacttgttattcctcaaatagatttaattgctcattgtgaaaaagagaataaaaatatgaaaaaaatgaataccgaatcctcgaaaacagtcttgacgacaaggacgtattcgatgtgagcaaaataataggtgccgaatccctggaaacagtcttgacgacaggggcgtacccgaaataaaagagaaaaatatgagcaaacaggctcaggaaaagaaaaagttcaaaaaattctcttggttattttgtgctaaagtttatttgagaaagagtgataaatgcaataggtatatgtgtttagtgtttattctttaacctatgtgcttgttaagatgttccattataaattgtatgaaatcatgaatttcgattgttgattcaagcttaattgtaaaatctttgattcatggttatactttaatgcatgcttgttatattatagatgggtttatcttctttttgttgcaacacatgacatgatatgctatatgtatgctaagctcttatacattagtgaacataattcctatgcttgatgaaatcattgtcaaaagggggagaaggaatataaaaaaaattggacttttgggagctgagaagagtttttgagaagagcaatgtttttggttcaattgagaatttctttattttaaaaagggggagaagttttcttttggatttttgagaccaatgtgtacatttatacgaagtgtgctttttatcgcttttttttatttttccaaacaccaaaacatttttgatgggtttgccaatgtgttcatcaagggggagattgtaagatcaatgtgtgttttgattcttaatttgtgatgaacaattggcatatgtgattattggttttgatatttggagattatcgtcgaagtggttttgcagataatcaattttcaggtgatgatcggattcactgttattttatgtgtccggtccgaccgagcggatgttgccggtcagaccggtgctatgtgtgcggtcagaccggccggcccacggtctgaccggccgacgctgtgtcggtttcggttttgggttgtttctttggatatccgtgattgtttcatggttatggcttctagatggatactatacgtatgtaatactattgtttgctaacaatgagtcaagttggggatagcttggtctcggaatatggtttctttgtttgtttcatgtgtaggtgacttgatgccttgagacagtattttcggtgatggaccgggagtcggcttggaggtaagacgatgtccgtggtggtcagatattatgcgggatactaaggctagagttga

SEQ ID NO: 42058 - DNA, 1501 bp, Oryza sativa
cctgtttgacccgccaaaccactcttacgcatgcacacgttctgtttacggtccaatctattggttattggttattgatgattcacgttgtattccatccatactcataaaaaaagtcattaaagacaatgtgtaagttaaaccttatgaatataaattataaataattctcaagttgttgagtttgaaaatgtaaaaaatatatgtatagatttatcttgaaaaatacttttataaaagtatacatatatcacttttcaataaatatttttatagaaataagaaatcaaagttgtgttttagagaccgtgttgctattctaaacgattagtatgagtatggagggagtaattaagaaccgtttactgtatattgaactgctagtaatcaggctttgggtagcaatggactggtttcggacgtcccacggtgacattcttgatattgtgacacatgtcgcattggaggttttctgttggttgcagtgtccttgtaataatgtcttcgtcggatcggattctctgcagagtgatgacatgatatgaccaaatgacttattatatatcaattgctctccgacaatatctttcattttggttcgacgttagtcgccagatgtaataggagcgaaatttgatcgatacaggaatgagccgttgattttgaagatttttttttctggtttgagaaagattaggattgtaaaatcgtttgattcttattctgtgatgaataattggcatctgagtttattggttttaatatttggagattattagtgaagtggttttggagatgattggagttacaggtgttaaacaaggagtgctggagatttggtccagtcagaccgggcatgggttgctggtcagaccggtgtgtatctagtagccagaccgggcagcccgcggtctgaccggccgactctgtgtcggttgcggtttcgggttgtttcattggatatcattagataatttgtgtttatggcttctagatggatactatgaatatgtaatactgttgtttgctaataataagtcaagttggaaatagcttggtgtcggaatatggtttctttgtttgattcatgtgtaggtgtcttagtgcctcaggagagtattgtcgatgatggatcgggagtcaatttggagataaggtgatatccggacggtcagatatcatacgagatacttaggctaaagatcaatgcgcgtggttggtgaagattccatatggcatatgatggagatattgtgtgcgtatgggatacagagtcgaatttggtacaattggaatttgtaaagttggtttactgtataggaagatttcctaaagggattaggacttcttgtatgagtttggttcgctacctacctcatatataaatagtgagggagggtggcctcccggtatcgctttagatagcattgagttgacagaatagttagggtttcgagtttagtcgagatttttgtgaggagtgatgttgttgcactttcta

SEQ ID NO: 42059 - DNA, 1501 bp, Oryza sativa; identical to SEQ ID NO: 23054

SEQ ID NO: 42060 - DNA, 1371 bp, Oryza sativa
tctgtacatagctgtcacgtatagaggaactcaaaaagtttcaagtgtcatatgcccatgaagtaaatctaagcaatatgttccctacgagattcgcacataagaattatcaacacacattcgaaggtgagaatatttgaaaatagcaagtttgtctgttatactttcatataacttatgaatgcgtctagaaaagcaattagggtattcatactgtaagttgttttcctttcaaccttttgtgtttcccttaaaattgtctaagcacgcacattttgatagagcgatgctatcacatatctcggttaccaagagacactaaattttatgttaaaaatatatttgtcacctctctccatcatccaggagtgtaaaatttctcattttgatgactttcttaatcttgtatagcctatcgatatatgatatatatatatatatatatatatatatatatatatatatatatatatatatatatatagttcactatgcttgtaactcaaagatacaaagtggataattgtaataataataaaataaacatggttcaccaatctagaaatttcaaccattggcggatcttaatatatactctttccttgtcaaaatatatatctatctttgtatttcaaatttttacctcttaaccacttaagaaatgcatttccttaagatcttattcggtttagaggggattaaagaggattggaggggattgaggaggaataattccacaccacaatatgtgtggaataaatctcccccaatccgtccctcacagggattaaccaatcaaggcctaagggagctaccaaaatttatctcacaagttatactttcaattctttttcaaactctctgagacatatacatacatgtgtgaaacattaattttctttttttttctttcttttctatatggtatataaggatagaatgattattttattcataccgctgttcgctgcatgcgaggatgacttggcatgctcacgtagcaccttttgtgggtccaaggactatattaacccaaatgattaatttgaaagacttatttgaacgatttgaaacctcaaggactaaactgagctcgaagcgaaactatagggatcatattcaccctaaaataaacatggttcaccggtctagaaatttcaagcattggcagatcttaatacatactctttccatgttaaaatgtagctatctttgaatttcaaatttttacctcttaaccacttaagaaatgcatttccttaacggaactaccaaaatttatctcacaagttgtactgccagttctttctcaaactctttgaggcgatatacatacctctagctattctacgttgttggttcattcgcagg

SEQ ID NO: 42061 - DNA, 643 bp, Oryza sativa
cttagatctcatagttattgctgacgttgcatataataaataattctgaatttctaatgtcaatggttgataatcgtaatatggatgacatcgtgaatgagaaaaatcttgtcagtctgatatttcgcatgctccagaagatgctaaataatccaacttttcatgaaaacgccacgagttgaaaattattttaggcgtgcacgccttccttttgttcactgtcagaagcaacaagtgacaaataagttcatacaagatctgtccatttttcttgttgaaaataggagaaaggacgtaccatgtctcgttcattgctgcggaatttggcgtgttcgttttccaatagtttttcagtcaaagtatgtcccatggaggcattatttatctttgacaaaattcaagttcatttctctatcaaccgaaaggacagaaaaaaagttgctccagctgggagttctctgtttacaaggtcttcacaaatcttcaacaaaattctctgcttaaatttatcaacaaaatagcaatctctgttttgaaaaagttgcactagatgcaatagtaggagttagaagtcccattttgcagtaaaaaaaatcatgaatttcttaggttgcatctaagcatgggcggcctgaaatgtttg

SEQ ID NO: 42062 - DNA, 1501 bp, Oryza sativa
ccttgtaccaacgtaccccaataccctctatatccggtctacgggtatcacccgtcgacagtggcgcgccaggtaggggggcttggtgctcaaggttttactactatgtcatccagcttcgtcgacaacagcgtcaacaccaacctcaaccacgggtttcctgcttcaacaacgttggtgtggactcaagtcggcgaaatcgtcttcccggtgtacaccacgatgccgatctcagccggtccatcaatgaccggaaacgagaacgcagtggctgcaacccaaggcgactccatgtcgaaggaccctcccgccgaagcagggaatggaacatcgacaacacccgagcttgagaaggattctaatgcggccgaaccttgtctttccgacaagaaccacgagccgacgagaacagcttccgaagcgacaaggtcctggtgtcctatccacaaaaccaggaaacatactttgcaagcctgctgggtcttcctcaatgcccacgccgaaattcgcgcctgtagagagcgtggaattcagcgcgtttctccaactcgtgatgtctattgtcctattcacaagacaaagaatcacgacctctcaagctgcaaggtttttctcagcgccataaagatgtcatctcctaaggtccagccatcaagcgtatcccttagagaggaagacaagagacagggaacgacgctgacctcagatcgattcgttggtgcgattgacatcgactcccacgaaccatcagttctacatctactcaaggactatggctcgtcatcaacgagtacaccatgcgaggtattggctatcgatgggaccagcacgtcagcacgcgctaatgccgaggcggagaatcaagtagttacaccggctcagcgcatcagtacccttaacacaatactgagggaggcaccttacgatcccgttctgaacgacgatcttgcgtggtggcaggaacggctacgagaatcagtaaccaacctcagccacacgttcgaaggggctgctgctgatgcacacccggaacagccaccaactggcggcgtcgatggcgaaaaccccgaacagcgggagtcaccctaccgagcaaccccttcaccccgcggcactggcgacctccgcgatcacctgaacggccgacgagaagcacgtcgcacacagggcaacgggagccgctctcgacatcacatcccttcacggcatcacgataatgaagaacgaggaggccgctcgaacgaagaccgagaccgtgatgatcgcgacaatcgtgagcggcgggcgccgggcaataccagtcgaggacgccgccataatggcgaagacgacagagatcggccccgggacaacgacggagggcgacgatgggattctcgagaacccggccgatgtcctcgtaatcctacaccagaaccaagcgattcttcgtcatcgtcatcctcttcttcatcctcatcgtcagatagacatccacgaaggacacacgatcgccgacaac

SEQ ID NO: 42063 - DNA, 1501 bp, Oryza sativa
tcttttagagacgccgccacctgatggtccgcgagcggcccgatgatgtcagtcagaggaagagcctacgcttaatcaagtcataagatgatctcaagaggaaaggcgggatgtccatcgagtatacttacgttaatagcggcatcacgctccgtcgcccccttttcacaaaggggcacggggacgtcactcgccgttgtcggtccactgatcattaactgcccgacttggcgctccacggccctactgctcaaacctgtgaatcgaggaccaagtttcgataaatcaagaggaatgcgaacgtgagtatgtcaagataaatacgagaaagataccccgaggagaaacctgggtcgcgtcctcaggcctggaatagttaaaggctagatgggcccgagcctggagcagctggatccgcctaccaacgaagtccgcaacgacttcataccccgacaagccccgcactcggagatcgttgatgaagtcgataaacgactgaagaaaggggtcaaaggaggcttggcggtccaagacgaaatcttgcccggttgttctgtgggaacgatgaagacagggttcgaatctttgacctcaagataaaaccatctattccgccatttgttgcgagaagaagggcactagaacgggatataacgcgacttcaggccatctcgaagtcggaacccaacggagccagataccctgttggactccatccaacgcagttcgtagtagaagcgaaaaagatcaagaaaagactctaccccaatgtaagcctcgcaaagatgagcaaagatgctaagaaaggcaatagaattggggttcaaatgaagaagagaaagaccatagaagttcaaaatcaggaggagaaattcggaaggcggagggagaaaaccgcagagaacatagtcttcgatcgcaaccatgcgacctaagacgggctggggattagtacctcctgcttccctctccatggctccacgaccaggaagggcgccgtcttcctgaagctccttcagcgatgcgctggtggaagatgacttgccgaggtccatcgctgatcgaagatcgccggtgaaaggacctaagttgctgaactagggtttttgcgggagtggagaagacgagaggcgcttgggggctggagaatttttccactacaggcggacttcaaatgaatccccaaaactcccttaaatagacgcacttccgacggtgcgaattccaaggaaagaagagagatggccgccggaaatttctgggtccgttacgcgcggcggtttttcagactttagtttaaactcactcgtgaccgttgggcttcacacggtgttctcgatcatgtcctgtctctacggttcccacaccgagaacgacatcagcctcgacatcagaagtcgttattggtcgcacgggttcatttaagcagaagttgggggctactgtcagggttacgggttaggtgtaccccttagcctttgatatgcgccacatatcgaca

SEQ ID NO: 42064 - DNA, 1501 bp, Oryza sativa
aagctcctagtctgtgtgtggaaggttcgcgagaatggaaaaagcacaagacacgggcgatgtatacaggttcgggccgctgaaaagcgtaataccctgctcctgtgttttggtggatctatgtatgaagaagctacaaaagagctggagaaccagaaagctcttactctctccctctctgatcgttctgtatccgaaaaaatcaatcccccttctaagtgggcaaggtcctccttttatacctcaaggggataccacatgcaccatctctctcttttttttttgtggggacttatcctctcttttcataaacagacggagacttgtatggttgtcgtccgagtgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctctggctagggacgagtgcttggaggctctcatcctgatgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccctgctatgctcacctaccccgtatacgcggcgcaaaacccacaaggggtcggggcgcctcggccctcgaggccgagacgggagcggtccgacccctcggggagacaaagagaagggcggccgtatcaccctcgggcccgacccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggtaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccagcgtca

SEQ ID NO: 42065 - DNA, 274 bp, Oryza sativa
cacccgctgatgtacaccgagtcgtattcttggaatcggttgtatcggctagccctgtctgactcgaactctgccgatcctgaccgtagccgatccagactctacccgattcttactctgttttcgcgacagcccttatcttcgattccgcttctgtcgaggagtgatcctctctagcgggagatcgtgggatccccctttcgtgagttcgaccgggggaaaaggcccgcctctgaaaatcacgtatccgcccactagactaccaggtagtgtg

SEQ ID NO: 42066 - DNA, 1501 bp, Oryza sativa
gccggcgtgggggaggacgagctcgccggcggccagattcgtgcgggcaaacggcgagagatggatgaactgacgacgggcgtctttggatggacggagtgttacggaacgaagaaaattcgtactctagtggtgtattctgaaagtagtatgaattaggtgacaaatcctataagcagtgcgtattgggtgttatattctgaaaattctccccacgaccgcccaaggtaatcgattatccctttgcggccctgacttggttcgtggatggatggtataatggatagatgggagaaggattggttgcatttgttgctgtagtcttgtagacgaatcgatggttggtaaaaaaaaaaaaagggtgtctgtgactgtgaaccttgtgttaaatggatgatttcttatttaacatgtttctaatatgttcattgactggaatgtgaagcttgtgtcactgtcaaatggatggataataagtcataagatcaccaacctcggtgcataatttcgtttctgatatgaccgcaatttgcttgtgtcactgtcaaatggatggataattaatcataagctcaacaactgtgggaaggggtggtacaatccgatattcatactaccaaccaaacaaaaaagactagatcatcccatcggtattcattctaccaacgaaacaaagctcgatagcccgattcatctgaccaaagaagtaagttgatggcctctcttatatgattcttgtgtttttcatgtgctctattcaaacagctatttgttgtgcagttcttctatgttttcaacgctccgtaggagttggagcactctaatccttttctattcatatgccttgagaatcatgggttccagcgaggtcttaaatatctgtagattgatgattcaattaacatcacagtctatgggatcttaatgcttatggctacccatggcaacttcaaaacatgtactggaggtctgttttttttttcctggagttttgaacctagcatatgccgcaggaccgcgggagatgtcaggaccaagtttcctggaatctatgcaactattttctttgttgtttggtgagaaaaaaacttgtgggcccatgtgtaagtggagcaatggaggttagggagaattagatgggaaaataatgagattatacgagttcagttctaggtcctcttttagaggggttgtgatgtgatgttaaccatatattattgtagatgaaaaggaaaatgaggcatcgttataaagtgatacagcgttagtgatttgactcttatactccactttctttttggggaaaaaaaggagaatagtttacttttatcctttacttgctgctgggcaggtatcagatgaatgacatcttttcttgattccttaaccctctgggaggcattgcatcagattttgcatgcatgttgatatatttgtgtgtggcacttaactatgcatgaattgcattcatcccctcaaacatatcaaactggctaatccc

SEQ ID NO: 42067 - DNA, 1501 bp, Oryza sativa
acacacagtgtgtcttggagtctgtgctgcagctggctatagatctgtagcccgctactcttctctctcatcgtttatctcattaaaacatatttacagctggctaagagcctgctattgtacctactcttgggatcggtttgaagcccttagagttataaaatagcaccataaaagggctcatggctcattcgtctttacgttgcttcacgttctctctgcggacagccacggcgggttaatattgctatgatgcttttgttcctttggtggcatccaccttccttgtgacgactcgtctctgattgccattgcaggttgcacataatatgctcatagtgtggcgacgtacgtgatgattaacatcaacagtagagagggtattaattaatttggacgtaataccgttatggtgttaatatgtatacctataataaaaccatatttaatattggagcgctagtagataagaattaaactatttgaaagttagctatagcaagtctgcgtgaagaacgtgcatgttttcttattagagagctcaagcataaaccaatatataacgaatgatgtttattccttgcaggcacggtcactctcctagcccatactaccaattaatatttgatgggacagtctctagtcatgcattatttgattactaaagaaactttgtagagaggaagttataagaaacttggtgcttctacttaaatgtaaaattgaatctatagtaaggaaagttctcgattttagttttattgcatcaaaagtttacaattcaccatataatagcatctaacgtactttccctcagctatacttccaagtcacttccgtctcttccaacctgatttgctatctgttgggaatcacttcctagctagatagactcgcacacactcctgataaacacacacacatttagaggcaaagaacagtggagtttggtgctgcacaaacgcagcgtttttctcttttttactcaattaacaaagatgctaagtacatgcttaaatagacaaagttagaggccaaaacgtgcgccactagcagccgcatgctactcttagccacacgactagatcatccatatgcacacctagtaattaactaagatcctaatggcccggctattatgctaatgactctactaaccagccactatttgtgtgctcctgcagcatctcacatacccggccgtctcgcacggctcttgggcctactcgtatacggatctcgcgtactactactatagcttcttcgggtaccttatcctatcctgctacctatacatttatttgctacatgcgaccaaattaagcaaacatgattatgcactaataacaagattatttctaacactatcttatttgacctatgttaactcagctacccacttagaatgacattctaaatttgtcatccattatcttctaacaaaatcgatatgccccctaccctatgtgtatatcgtcaaactcattctgtgtcacatgta

SEQ ID NO: 42068 - DNA, 1501 bp, Oryza sativa
tcacattgtttcaatttcaacccaactttcaattttgatgtgaactaaacacacctccaatctcctaacttcaagcacatcaatcttgaaatgctgcatacttgcattgacaaatttgtttatctttaaacatgtgcgaaataatcaaacacaacggacctcatcttttcgcatatacttgtgtttatcaaccaaaatttaaatttttaaccttaaatttgaagctgattttatctttttatcaaggcttattttttagcttttatttttatatcgctaaggacgcgtaaataaaaattttattctctcacctgaccggtggggtcccacctgtcagcctcacatccctccaggccgttactacccccatcatcaccaccaccaccactccactcctctcccctccttatccccttcgtctcccgcctccgctcccccgcgcggccacggcggccatggccaccacctccacctcgtcgctgctgcctctcctcccctccaggaccccgaccccgacccctcgccgccgcctcccgttcgccgccgccgccgccgccgcagcggcgccacctcgccccttcctcgtctcctcccctccgcctccgcccgcgccccgcgcccgcctcgcccgccgcgccgcagcggggggcctgtacggtggtggtggtggggaggaagagggagacggggaggatggggagatggaggaggagtattatgatgatggggacgaggagggggattgggaggatgatgatgcggaggagggggaggagatggacgtcgaggcgatggaggaggaggccctcggcgccgtcgccgacctctccgagcggctcagccgcgagctccgcatcggtgagtggggggtttcagcttcgattcgctacctccgacatggccaggaaagtaggaaactagttagtgcttgtgaagagatagtagcatttagcctaaagtgcataatctagtgtagtagaacaatcctgtgtggaattttgagtcaatccgtagttccgtactctggtcgtggcggggatgttcgtataagatcagatggatatgctgcttgttgatgatgaactgattgttgtgccgagaatcatgatgatgcagatcaattgatactttgccttggagcatgatgtatgagtttgggaattgcagttccctgtatttctatatttgaaagtttagttgttagtgcctagcgtcgcaaagtttttcaagtacagtatttcttcggttttctcctttagaagcctgttacatacttacattgactttgtttagttcatgggctaaatgcgttgtgtcttcagatgacgatgttcgggataaaagaagaatcatcagggataagacatcagcatctaaacatgtaattatatcttcgtattcttgtaaattgtaaccctagttgacaggctggttaagaaagtgcaaatgtaaacaacttctattttctttactattgggtccgtgattcagataccggata

SEQ ID NO: 42069 - DNA, 1501 bp, Oryza sativa
  unsure (1)..(1501): unsure at all n locations
tcggggtcaaggagaagggattgtccctcctcgtcttcttcggcgatgacactattcctttgttcacctgcgtcatcatgtcactggaatcctgtactctgacaggtggccacatgtatagctttgtcgggagttttacttttacctgttggactcaataatagtaggtacaatagtaggctataagccagctataaacacatttcgaggagataaaagaggagggagaaagccagcaggctacagatttatagtcttatagctagctgcagcacggactccaaggtgcatgtgtgtatgacaggtgagaccagatattaattatgaagtactgcctccgtttcaggttataagactttctagcattgcccacattcatatatatgttaatgaatctagacacacattcatatatatgtctagattcattaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatacgcatacatacatacatacatacatatatatatatatatatacatacatatatatatatatatatatatatatatatatatatatatatacatatatatatacatacatatatatatacatacatatatatatacatacatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacanaatcaagaagtaaataaaagcatgcaaccaatgagtatttagatgacttcttgagttctaataaaacatttaatttatctcttcatttaagtcttaaatgcat

SEQ ID NO: 42070 - DNA, 1501 bp, Oryza sativa; identical to SEQ ID NO: 41781

SEQ ID NO: 42071 - DNA, 1501 bp, Oryza sativa
ccacagcggcggaggcggcgcggcggaagcggcgcggcgaggcgagaaacggtagctacggcacggcgaggcgagaaacggcagcgacggcgtggctgaggtgaggaacggcggcacaacgaaaagaggagacggggagtggacagaagggaagaacggcggcgtcacgggttgtttctctcacgcgtgcaaagaaccacgtagcaatggtcaaacattggtacggaaagatagggtttgtcttttttttgggacggaggggagggagtatgtagtctgtaaataaccagtactctctgagtgcaaagcatcatataagcaatcgaagagcacaatatcaagcatgcatggcgacgggagggaggagaggccgcgctgtgccgctgtccaagagcttctcgaggaggctaaggcacggccgcacgggttttggaggaagcggacacgcgagggggatgatgcagctccatgtggcgtccgcgccatccagatgtatggcgacggcggcggcagttctcgcctctcaactctcgaacaacaggacaaggcggcgcactggggctcaatgaatggcgacggcggcggcagatagatgcatggcgacggcgccggccggcggcatatcgatgtatggccacgtcggcggcagctctcgtctcgcctctttctcgactctcgaacaggaggaggcggcgcacggggttgggagtggatggggtcacgggattggaacttggaagtgggctctaggactttgactgggctagggcgcgtccgcgcgtgggccaaaattttgggaggctgtggaccgggaaaagaaaaagtacaccaaaggtccctcaacttgccatcgggatacaaaagcgtcctcgaatcgcaaaaccagatatatggggtcccttaattatacaaaactggtcaaaatagatccctcggcggccctcggcggttttgatgcaggttttgccctacgtgtctgcttagacccacgtgggccccacatgtcagcctatccagtcagcctctctttctttcccctcttctctcccttccccttctctctctcactcttctctctgggggctctgggcaggccggcgctgctggccgacaggtggggaagagaccgatggtgcgaggtgggagaggaggtccggcggccggcgatatggcggcagtgatgacggagacgacgcgggagcaggggagcaaggcggcggcggcggcggcgagatgtccatggtgaggtactggaggcggagctccgtcggggcggggagcgggtcgacggcggtggatggcgggcacgggatagcgtcgcggcccaacgccggcgccagcgccggcatcgcccgcccgcgcgcgatctcccccaccgccgtcatgaactgcaacgcgccgagggccgagggccaatgcggcggcgacggcgtcaccgatggctgccatcgaggcggttcgggagaggcagcagaggaaggggagatcgaggatgacggcg

SEQ ID NO: 42072 - DNA, 223 bp, Oryza sativa
  unsure (1)..(223): unsure at all n locations
tagaggacctcagagaagtctcagtgtcatatgactcaaacgtgaaactagcatnnttgttcccaacaggtatgcacatcagaaatatatactaacaagcggaggttacattagaacttgtggatgttcatgttacatgtagtgtatatatgttgcatacatgtatatttggaattataaaatgggggcatatgagttgcagcgggactaaaggaagtctcca

SEQ ID NO: 42073 - DNA, 264 bp, Oryza sativa
  unsure (1)..(264): unsure at all n locations
tgaacgcacaccagggagtagatttgttaacatgacagaaatagaagtgggggtgccccccgccaggaagattatcntcccgacggcggggaaaataacggcaggcggggacagancattatttgccaagaaaaaggagagtacgccccacacgcaccggataggaccacgcggaattccagccagagcgagtagatatcaggacgccgagaaaggacgaggacagacatttcatataagcaccgcaagagacaacagaagcga

SEQ ID NO: 42074 - DNA, 1501 bp, Oryza sativa; identical to SEQ ID NO: 23068

SEQ ID NO: 42075 - DNA, 1501 bp, Oryza sativa
ttatcgtctgctagatactctgtggctcacctgttttccctcaagatctttcctactaattcaactcagaaggttgggttcacagataattcaacaatgcactttgtacttatcaggaattcactgatctatcttttgttttatttgagcatcctgaatgatgtattgatctaatatattgacgtgcaattcttttgcgatttcgcaaaagattgatgtattgatatatcttgctctgtgctgatcaggtagagattattgaagatagaagaggtggttgtttctgctgtggttcatgagacagaggatcatctgggttgattgacagctgtgagtgaaaatcaagtacagcggatcatctggagaggttggagatggcacaaatcaagttggaggttacacttgagacatcaaataagtggcggattactggtgacccgatattacgttggcaaaagaagctgtggaagagtgtgataacaaaatatgcaggtgtaggcagcacgtcgaggaagaagaggctgaacaactagtaaggaattcatcctttcctatgcaaattgtgcatgccaccaagtctctagtattatccatctataacggcaatatccatgagccaaatagatctgttgttcgaagatttgagtggtatgcagatggagctaatgattttctgagatctgtggagtttggagggacgccatgctattatctgttcttcgaccctcttgtggggcacgttcttgctggtgaaacgctggattacaaattagtgcagggaaacaggtaccacttgtttttgatacaggcaaataacattgtagaacgaggagcatgagctaagttgatctttgtttacaatgatagagacacacctgaggataactttttctttggtttgatgctacaactttcagcaagtacatacatagttggcactataattaagtatgtgcagctgaaactgttaggagtttatgcaagtgaaacacagttttttaagatcatgattaacatgacattgaagcattaccacgaattttcaaggaaaaggattgcggtgacgaggataatttgtcttcaatagctagactttttacaagattgggacagtcaacgaggcagctttttaagttttgtgtgattgtgacaaatcaactgtacattcaaatcatcagacttgtggtgttgtgaagggaagactagtcatcttgctatcacggtcacattaattacctaatgtctgtcaacttcatgacatcactcattgtacagatgctccttcatgactttcactgtctaattggtatcgtgaagactctgaaccatttccatctggattcaggtttatgctgttcacaatctgcaaagctatcagtttaaagcactagtttcagtttcaaccagtttggtgtggtaagtatattttgtgctgaagtccagtatctctagttctgtgatgaataattgtcacctgacctttaattccctttttaataga

SEQ ID NO: 42076 - DNA, 1501 bp, Oryza sativa
  unsure (1)..(1501): unsure at all n locations
agaagagatctagagggagataaactgagagatgggtgagaatcaaaaacagtctggaaagtctgaacttacaggatgactctgaagataaaatctattggaatttgacaaaggatggaatttnttctgtgaaatcgttttacaaagcccttaaaatgcatcaggtgtctttccctcaaaagaaaatatggaaatntaagattcctctgaaaattagagtctttatttggctgtttgttaaaaacaaaattctcactaaggaaaacttgtataaaaaaggttggagaaaggggaatgaaaagtgtcaattttgtgataaaaaagaggatatacagcacttgttttttgaatgccctttggccaaacttctctggaatatcatgtgttgtgctttggatatactgcctactttgaatcatcaggatatttttggacattggctggatagacatgataaaaacatgaaacacttgattgtgattggtttagctgcaatcatttggacaatttggaagtccaagaataaagcttgttttgaaaataaatttccaagagatcctactgatttggtctttatggcttgttcctgggtggattcctgggcatctttgcaaagttggaagcaaatcgaagaagactgcagttgggagccagacttataagacaggtggcaagtgacatcttctgctcaagacatggatggagacctggaatctggaggatagaaggatgaagatgttattagttttttgtgatctgttttatccttttgatgaccgaatgatgttattcgtgttcagccatcgagccctgtgaggcatctggataagctctttagctttctttcctcgtatttgtttttgtttccctgactttgtaaggatatgctcatttctagtaagagaaatgggggctctctggccctagttctaaaaaaaaaacaaaaactgataggtattgatttgcaaaaaaagaaatgccaaaattagggatttcgattgtaaattttgtaatctctatgagtgacctgattgtggtagtgatccaatgacagacctgattgtaaatttgtgggttgctgacatccgttgcaagtagccgggtagggtcatgaatgtaaagagtaaattgcatcgccggtacacgaatttgtaaaatgcttattttggtgcatgaacttgtctggtacgtgcggagaaagatgaaaatgacactacatggctaatcttattgatttaggggctgattatgatactatgtaaacatatactccctccatattttaatgtatgacgctgttgactttttgacaaacgtttgacctttcgtcttattcaaaaaatttatgtaattatcatttattttattgtgacttgatttatcatcaaatgtttttaagcatgatataagtatttttatattcgcataaaaagtttgaataagacgaatagtcaaacgttggttaaaaagtcaacggcgtcatacattaaaatacagaggg

SEQ ID NO: 42077 - DNA, 1501 bp, Oryza sativa
gcatatcttgaggttgtgaaggcaaccatgaacatgacgagcacacggagaaccattcgaggagccaagaaagcaaagctgctgcgtggaatggatcagagaacgcagaggcgcacagttgtgacctgtgacttcatctgtgacttccttaacctctgggctgctcatgcgcctgtccagctgcagggctctatccttgattggattcagaaagaaaaggaaacagagttagcatctccactattgcgtctgaaattttagatcatttacagagactggttaaggagacagggagaattaagaagaatggaaatgtaatattatagggtgaaaagtgaattgtaggtagttaaatttagaagtccttaggagtgtgttgatctgtaatgtgtgctccatgtctccatatgctattgtttgtccagctgatcacttatgttggtgaatggtgataatatgatgttcatactctatcaatctaatgtacatcctcactcattgggcgtgacatattttatttgaattcgcatgcgtttaccatgattgaaggtgatgacaaaattttgtacttaccctatttcctgctatttcatattcccattcactttattttttgtaaaaaaattgtaatttgcatatcagtaattttcatacagtggtatcctcggggcggtttacatttcagattatatgtatttaggatgattccgaaatgaaacattaaaacacatgcatatttattctgacttcatcgtctactgaaacacagaaacaaagggaaacacaaaaaagttgcaagaaggagaacaagttgattgctgggtctgtgaatgggtgagtgaggaaggtggacatgtcaagccaaacaattttaatcatcaagcagacaagcagacaggtattcccttattgtttaaaataatttcagtatttttacttagcccagttgcaaagcttgaggttggttaagccctgtgttccttatttcttctgactgattagtctgtgattgagagtaatcagtttgtcaccagaatggcagaatatatcgttcaatcttaaacttttggttaaggcacaattacagtatattctaagcactagtttcaaccagcttgatgaggttggtacattttgtacggtagattattgcatcgcattcgccgggtcggcacgccgaccgtagtatattgagaatttgaagaatgcacagagatggcgaggcttcgcagccaccacctatttacaagacgccacaccactattgcatcgcattcctatgttacttagttgtacggacaaaagacagttcctagtaaatgccatctgccattttatgtaatatggtgttcgcgttaattcgctccatcccagatacgctccatcccagatatgtacgacattttgctcgcattcaatttcactgctgcttgtcgcgacctgttctgtgcagtttggttactgttcttttttaaaaaaaaactgcaggtaatttcattac

SEQ ID NO: 42078 - DNA, 1501 bp, Oryza sativa
gagctcacttatagatcaaatatgtgataatccgtaggtttttatatcgtggtcccgcttgccacatctagatatgtaaatagatcaacccatatatccatttatagtttaaattaatagataacccgcgagttacccactaaattttgcctataaattaaacgagctcgtgggttggcccgcttgtatctcaaatcggcctgcattttgccatctcggtacccatcttttccacgcagaagttggtaggcgatgccatagtgggacttccagaatacctcgtgcgtcgacgatccatccacagcatcgtggttgtggctttggcgatcgacaacgagtcaatgactggtagaaagaactcctccacctcaaacagcacagcccaatgttcgttcatggcttgctcctcccttccatctatcgccacagccgcgacggccgacggtcatgtttcgggatagcaactcctccggcgacgcatgtgtcacttagaccgccttcatcagcagcatagatgccaaggaattttcagaaaatcaactactctcgtcgttgccgaccagataattgtcgcaccgagatatgtcgttgcacggacaatttaatcaccggccggctttaggaatgcacctgatggctctgaccatggtgctcttgtccttcgcggcatgccggttttgggcgatgtgctagcggctggtgggccttcttgaaaacgaaagggtagatgactattttttaatataaaatcctctaatttttttggagtagaacagagtctcttggagcaaaaagttgttattgttatagttcctttctttatttattattttcctcaataataacgtgtcactgatttataagttctttttatctttaaaaaaaagatatgcctacatatatctaatacgatatgaccgatgacaggtatagccggtgagctggctattctatttgtcaaaaataagtaaatattgtagataattttgaactataatataattttattttgatgatagccacgtaatagcagggccaaccttgctattttttttttacattgagtaatttgtattggtggtacacaaaacttattaggtgggtgcaattaagtatataaatttataaaatgctcgttttaatacacgaacttgtctaattcttgcgaatgaggatcaaaataacttggcaatgctaattatacgaaaccgatgttgattaggatgtgatgtgaatacgtgtagtgagtatgcataagatatgcaatatttataatttgatccttactttatccatgatgaatttcatatatttttaacccttatatcattgcttggtatttttaaaaatctttttctacaatcactatatcctattctatttttttattgaagaggtgtatatctaattacaaccttcttatatactccctctgtattttaatgtatgacgccgttgactttttaaccaacgtttgactattcgtcttattcaaactttt

SEQ ID NO: 42079 - DNA, 1500 bp, Oryza sativa
  unsure (1)..(1500): unsure at all n locations
cgccgaagactttccgtccgatttgtgtacggaccccccccccttttttgaattttctgtttattggaaagagtacagggggtatgaataaacgncagtagcagggaagaacaggggagagcagtagcaagggaattggttctaagaaaaggaagagaggggatgatccaatcttatctaaatatctgtctgggacttaaccgatgtgggagagaaatatttactcccggttgataactccacccgagactaaagatagatttttagtcctggttggtagtaccaaccgggactaaagatctaaatgatctttagtcccggttggtagccccctgacatacctctgacagggatgaaccaggactaaaatcatctttagtcctggttggagatcaaaatttttttaaccggaactaaaaatcgtttttagtcccggtttttaatgaaaccgggactattgtggaatttggtcgaccgaccaaagatggtttctccaccagtgttcttatacattttcttaacattgatttttattttaactgcattttaagttgatcttaaaatcggaccatatgatttacttactctgaatagcttattttctggatgttcttcaggaatttggatgcaactgcactaggaattcatctggatttttttggttggttgtgataactgcagcaaaacatctcaagaggataaaccttcactgtcattgaaataaaaaatacacttattaattgaataacgtatttttaatccattctgaacagtgcagaactttctgaattatctatcggtgtttagcggttgattgttgttttattgaggggtattattaaatatcaaagtagatagatgcagataaagaatcaagttttatgacttggttttagttatacatatttttcttcaaagtgcaaaaataaaaattgtactccctccgtcccatgatataagggattttgagtttttgcttgcactgtttgaccactcgtcttatttaaaaaaattgtgatggtgactcatacatatattgtcattactaaatatcaccatagcattagcacgggcacaataatgttttatagtcaattaatgacttgtttctttttagtatcgctaagcagctcacctaaaaaagttagaacaaaaccatacacaggggccaaaaaaagcagggtgagtggcggccaaggatcaaagtgtcaagggggcatttgcccccgctcactgcaaaattgagtggtgttgatgaaaaacacgaggcctgggagatctgcttaactccagtgcaggtccaaaactcgccttcgggtatgctagcgtaccataccaaatttggtcgttaacaggtgggggcaaaggtccccacttgtaatactctagatctgcacatgaccatacatccctagctccctgccaaatctatgctccctgtagttggtcggcttgtagtagacttgtgacgtacaagtgtaaagaaaaatctatgcactc

SEQ ID NO: 42080 - DNA, 171 bp, Oryza sativa
ccgtccaaaacgaatccaatggagatggcgcttggtcccgcacgcaggcaaaaaaaatctccgtttcggcctaacaggaagcccgcacgcgcacaggacgcgcttaacctcgccctcgtccgcgtacaccggcgcagcctgagacggactcaacttcgcctcgccctcagg

SEQ ID NO: 42081 - DNA, 1501 bp, Oryza sativa
gaggaggcgacggtggccgaccgccggcaactcttcgccgccctcgtcgactcccgccggccgccaactcctgaaccagacggtctatgttctggggaaacagacagggatactttgcgttggcaacagtggttgctcacttgcttgtgcagtggaaaacttgccacacaggacagaacactgctggactttttttttttttttttttttttgcggggagaacactgctggacttgatgctagagaatgccctgcaaatgtctttgaactggagtggaattgcatggcggctactacataaattctgtctagatgatgtgcagtactctattatgttgatgtttagagcttagaattgtgagttaggatggtttatctttactgtatgaaccttgattgtaatatggcaaatcccagggaggcagggatcatattttccatcagctttttttttaatttttttcaatatattagaagaaagcaaagttttcgttacacaacgcaatcggctggatgtccattgccagaggacaaggaaaaaagagaaaatacaaaaggattgctaaagacaggaaactactactagagaaacgttgctcctatagagagggagggtggtggcagagccccactacgctcccaacaagtccccaaaggccgcggtgctagcagaagaccacagacggtcttcctggaggatggactcgagaaccacagagactgagaaaggagttgaaaaccctagaattccactcttttcacaactgccaagagaccagaagaactacggagtcgaagctcacttgaagatactcaggcagacaggccctagaggtcggctaccaagcttggagcgagtcaccacgggacgaagtggggtagcctaaccaggaatagacaacacaagatgctagacctactgagcgaacacacaatcaaggataatgtggttcgctgtctcaggatcttgagcgtagacggggcagaccaaatgactatcgatacctagcttttgcagaaggtcagccatccagcaacgctactgaaacgccaaccagaggaagagcttgcatttagcagggccttttgcatgccagagcacatcgacgcaagctaaggagtgttgcccaaggaagaaaacctggtaggctgagcgggccgaataacgctggtcactgatccaacgccaaacaagacgatccgtcatgcctggcgagagctggatagggagcactgcatcctagagcatcaggaattgggagatgactggtacggtgagagcgtcacggatgtcccctacctaggagttgcccacgaggatagaggcgaccgtacccaaagcccgaagataaggaagcactgcaagaggaggagcccaccgagcgaccctcaatccacctgtccgtcaaaaattagttggttgtatgcaaagttgcaaactgagaaaatgtatttgcccggttttgcatttaatttgttgttttcgatacctcctgtccta

SEQ ID NO: 42082 - DNA, 1040 bp, Oryza sativa
gaacgcgaatgaaacatgaacgaacgtgaacgaacgcgaacgaacgtgactgaaacgtgaacgaacgtgagtgttagtgaacgaacgtgaacgaacgtaaacgaacgtgaatgaaacgcgaacaaacgtgattgaaacgttaacgaacgtgaatgcacttgaactaaaagtgttagaacgaatgcgagcgaaacatgtacgaacgagataattaaactattgttgaacttagcatatatatatgattatatatacttgaaaacgtgaaatacattatatgttcctttgcgtttagactaatacattttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattattagagttagcatatgtgagtgttagatattattagattattagactagcatatttgagtgttagagatagttagagatttaatacaagattattagaggtttaatatacaaaacttaattagacttagcatatgtgagtgttagagatttaatataagattattagagatgtaatattcgaaacttagttagacttagcatatatgattatctatcgtacaaatacacgacacttagacttagcatatttgagtgttagagatagttagagatttaatataagattattagaggtttaatatacgaaacttaattagacttagcatatgtgagtgttagagatttaatataagattattagagatgtaatattcaaaacatatttgattgttagagatttaatataagattattagagatgtaatattcgaaacttaattagacttagcatataagattatctaccatacaaatacatgacacttagacttagcatatatgattatttgagttttaatacaagattagtagagtgttaatattatgcttagcaaatatttcttctatgaacaga

SEQ ID NO: 42083 - DNA, 253 bp, Oryza sativa
cataccactacttcgccttctcgctaccgcatcgttgcgccaacgcttggtctccgcgaggaccgcgactccgcacgccgtcttgcactctcgctcgttaccgccgtcccgcactgccacaccggccaccggtgcacgcgacggtgacgcctagccaccgcccggcgcctagcgacgaccaacgactggcccgatgccgcttgcagccggcgcccagcaactcgcttctcctcgtctcctcctcgcctccagc

SEQ ID NO: 42084 - DNA, 1501 bp, Oryza sativa
actagcgtggaggtgggccaccggatctacccacttctgcgatgttgtcctgctgcttctacctccggtgagtacatgtgccgacgcacatcctctttctctttccatccatctctttctacccgcaccatttctttcccttaacattatcttgatttctagatttggaagaagcttttctctagtagatccaaccgacgacgcgcacggagggatggaggcggagcaatttttgaattttttttaacactaattttggatttattttttatggctgtgaagcatctgctcggcccaaattgagttgagctagttttttttttcaaatcatatacatcaaaggtgccggttcttaaactgacacctttgagtcattctcatcagtgtcgtctccatggtgccagttgggaaatccggcaccgatgggggttacccaaccagcaccaatagcccattctttagtagtgcgaatatcaccatcaatactggttttatctgttagagaagtcactatgcccggttttacggataaggaatataaataggattaaacttatatctgagagagttatattggcctttttccttagtaaaatgcccaaaacagaaaaccctggtcttaacctctcatccgttacgctagcattgctcctattccataaaaagataaaaatgaagaaaaaagtttaatcacttctaaataacgattatacccgttcaaacttttttttataataatacaccttcaagtttatactgccactaactagagtggtaatataaatagatctaaatccttctatcaaatgagatcgacggtttagattgcttcttactaccagtacagagcatgagcatcctagtgggactataattaagtgagggtgtgagatggagtccaggcgttgatcccaacgaggaggttgcacgtatgcgcggatatgcctggctcatgagcgaagctcgatttaaacattcctggcgtcctagctcgggagatacgggcctgcctcgcacgtgcatgcatgtgagctacatgcaaataccccctccgtactataaaaaattcaatcctaactacttcaatcctaactacaaacctgacttgttatttttggacagaatagtaacaatactctctctattcaaaagtctaacacctatttattttattaccaagattaggaagtaattaactcatccaccatatgaaaaaacttatgagcgtgcaatccataagtactaaaatgacttcttttttccgatcaataatttaatttagcacatagtgattaccaataagatttagagtttgaaacatatcaaacaattttagatttctggatggaggaaatatataatatacctgcacgcgggatgcgagacagcgacgaaataccaaagcttgccctaattaaataaataattaattcgacgaagactaggaacgaccaatgatatctattggccaaccatataacactgtggaactgcatatcga

SEQ ID NO: 42085 - DNA, 1501 bp, Oryza sativa
ttataggtaactattgtatgaattggctattaagttgactatagatgatttagagccggtggttggctacactattaaacttcactggtggagaaatgatctttgctgggtcgacccaaaaccacaataatcccagttccaaaaagaaccgggactaaaaatgatctttagtcccggttgaaaaccccagaggcattgtatgatctttagtcccggttagtaacaccaaccgggactaaaaattatctttagtcccggttcatcccctgtcagattgatgtcagggggccgagcatctttagttccggttggtaacaccaaccggaactaaagatcaccactttagttccggttgggaacaccaaccggacaaaagatcaaaccgatctttactcccggttgaaaacaccaaccggaactaaaattcgaagcgtggtatataatccatatcccttatcctctcctcaacagatcgaatctctcccttctttccctccctcctccgcttcctccatcctcatcccgatccatcccctccacctcctccccttcctcatccgaccccctcccctctcctccacctcctcctctccccttcctgcccatcctccccttcccctccacctcatcccctcccctctcctctacctcctcatctcccctttcctgcccatccacctccccttcccatccggcagccggcggggccgtggccggcggcgggtcggggcagcggggccgcgccgggcggcggcaacggctttattttctcttttttttaatttgtgattcacatgtataattttatgatttattggatgaatctgagatgacctgtgatgtatttgatttgtgtgtaattttttaggatttgtgatgtatttgacctatgatgtatttgatttgtgtataattttttaggatttgtgatatatttgatttgtgtgtatatgtaaatttaagatttgtgatgttactttatttttgatgtggatttgggatgttactttcatttggggatatgcttctcacttgatttgggagaaaatagatatgcttcctacttgatttgggagaaaattaaaaaaaaaaagaaaaaggaccgtctggaattgccgctattctctctttactcccggttggtgttaccaaccgggactaaaaagagggatctttagtcccggttggtaaagatccatctttagtcccggtaaaaatagcgatctttagtcccggattcgtagtcccggttgaaaaaccgggactatagggggttatgattcgggagtaaaaagtacttctctaccagtgcttgctctaacggggaagtaccctcagatgagccatactcaatccaaaacttgcactcccgaacaagttgaaggaaccacagccatcaagtcgaaggcccgatctctccaatgcatgccttgacttaggctatgtgtagttccccaaaaaaaatttacaccatatcacagaatatttgaacatctacatg

SEQ ID NO: 42086 - DNA, 1501 bp, Oryza sativa
tgaaaaataaaataatatccaaaattagaaaaactaaaagagagttcaagtaggaatacaatttttaaacaacttaaattcaaaaataaaaaaaataaattatgaaattagaaaaataaaaaagatttcaattaggaatacaataaataactaaaaattggtgataaaaaataaagactattgaaaaaaaaagatcatctaaaacacatgacgagataaattaagtaacaggtctataaagaagtagagtggtggcggttgatacgacatacaaaaactattaataaaacacaaaatagaatcctaatgacgattaaaaggaggaacgacaggcagaccgtgaagctaacgggcaaggcggttgctgggacttctagaaattaaaaataaataaatcccattgataataatattcgatatttaaaatctcaatggcaatcaaaaggagaagcagcagacggggtgtataggagtgtagttgcagagccgctgacggttggcgagacttctagaaaataaaaaataaaaaatgaattctaatgataattatgttcgacttttagaatcccaatgacaataaagagtaggcggcggatgggtcgtggaggagtatagtggcatcgtttgacgggacttataaaaattataaaaaataaaacccaacaagacaataaactctaaaaactataaggaccaatttttaaaggttcggaactttcaaaaaataaaaaaacccaatgataatcatgttcgattttaaaatcttggtgacaataaagaaggaaggcagcaggtgagccacaaaggagtacaatggcaaagccgctgacggtttggcgggacttctataaagtaaaaaatgaacccgaacgataattatgttttatttttaaaatcccaatgacaataaagagaaaagacagtggacgggccatagaggagtataatggcagcgtttgacgggacttctagaaattataaaaatgaaacccaacaaaacattaaactctaaaaactacaaaattcaatttttaaaggtttcagggagaataaatagaaatagtggtagattgagcaagcaaataaagaagcatatgacagaagtaaagggtagcaactggtgtgacttttaaaaactatataattagaaatatagggatgataagatttggattttcaaaatcttaagacaacgacatagatatttaataaattttaagtaaaatcatactaaaaaaatatatgattttgtttgggtgctagccgcagaattgcgcggaccacccagctagttttttaaaagtcaccttgcatggcttaacttacacaccggcagttctctctaaaaaaacacaccggcttaactatgtttttgcttttatccctcttccacaatttcaggacaaacatcaggcgcagttggttcttcagactgtgcagaagcagcattactggtttcagcatccttcgtccatactttattgttgtctagcggccaatt

SEQ ID NO: 42087 - DNA, 269 bp, Oryza sativa
tcatcaaagattgggcccggtaaatcaggatcatgacccggaggatgatgaaaacaggaagactcaatggtgtcctcctggcatatttacaaagaatcagaagagaagggttcaaagattgagaaactgagaacgcttgcaggaggtcgagcaagagatcaatcaccggctaaagaaaacaaagccgaagcaggaatggcgcgttaagaaacaagctcctgtagccgatgaagcaaagagattggccaaagggaaaggcattgtgattg

SEQ ID NO: 42088 - DNA, 1501 bp, Oryza sativa
acaactagagaaagaaaaataataaaatcagaaagtgaatagtacacgtatattgtagataaaatttgttattttttcttcatatatcgatcgaatttatacttgcatgtttgtatgatgtctcatattatcatggtttatcttatcaaattttatgatatttttatataactgtttaaattacatgtatacatatagatgtggcacctagatatagaaaatactttctgggccatccagttgaactattaaagtcaactaatcattacggacacagtatttgctctatcgtgagagcaacaaggaggtgtgatctcttgcaaactaaagcgcacatgccagatgccattgcccattgacccaaatatttaacgcaaagttgccacctattaattccaagctagttttctctctagactccgctggctctagacttcgctggtcaacttgcattatcagccaacggttggctcgttagtcgttatctggcttaggggtgtgttcatctacacatcgacccagtctaaaacggaaattagctgtttttacggtttgagttatgcgggtttgacggaagcaacttcgagtcggacacccaattggagagataaatatcgggcgtcattacggggtgtgtttagattaggggatatcacatgtataacttaattttaattttagagtgtcacatcggatatgatattatatagggtgtcggatatgatatagggtgccgcatgggttttttttgacactaataaaaaactaattacataatccgtcagtaaaccgcgagacgaatttattaagactaattaatccatcattagcaaatgtttacagcttactgtagcaccatattatcaaatcatggagcaattaggcttaaaagattcgtctcgcaaattagtcgcaatgtgttgaattagttattttttagcctatatttaatatttcatgtaggtgttcaaacgttcgatgtgatgagatgtaaaattttagggtaggatcaaaacaggccctatgtcgtccgatcaattctgtatgcacgatcgaagggactctgcatgctcgaaatgactttgagggactctgcatgttgatttcagtgacttagagggtgtttagatcccacacaaaaaatttacatcccgtcactgttaacgaccaaatttggtaaatcatagatcggattcgaagttacaatcaaagcggatttggagagactttgtttctcagaaacagagtacgcatcggctattgactgcatcggctgacactgaatcagacaaggagaagcggatgtagccgatccccggaagatggttctagaatcattgttgggatcggttgaggcgccgcacaagcattgccacgagtggaaagagtccaaagaagacaattgtatctaattaatattttagtagttttcttagagatattttcggtaagagtcctcctaagaggcttattcgtatttttaagttataatagagataga

SEQ ID NO: 42089 - DNA, 1501 bp, Oryza sativa
agttagaatcgactctagaagaacggaattgcaaaatgatttaacagccgatgagtattacaaccttatggccgatgagagggaggatctggttcaatcacggttacgagcccttgcaaaggttaccaaggataaggagcgagttgcttggcattataacaagaaagtagtgcccaaagatttttcggaaggtgaacttgtatggaagttaattttgtcgattgggactcgggatagcaaattcagcaaatggtcgccaaattgggaaggaccgttccaaattcataaggtggtatctaagggggcttacatgttgcaaggactcgatggagaagtttatggcagagcactaaatggcaaatacttgaagaaatattacccaagtgtttgggttaacgcatgatcggctgatgttgccgatgcatgatagccgatgtgtttacattgccttgagatgaccgatatggttatatcgcacttagttcttttcatattgtaatcggttgtggtttgccgatgtgcaatggtcgatatggttatattgcccttagtcgtttttataattttatcaatgtttttgacattgtaaaattaggggggcacatacatggaaaattgcaaatttttgagcatatttggcagttatgttaatcggcacaaaggattatctagacaagttgaataatagcactagggtatcttagccgagtacaaaaaatttcttgaggtctattatacagaatatcactaagacaaatatcgttggatagccgatatagccctctgcctaatttgttctacttcttctatggcttgggcatcttgagcatcggttccagggatgactttcaaggacttggtcatatcagcgatattcttgatagccgatttcagcctcgccttctgttcttcgatagcttacgggagatcggctaacttcttgtgctccatatccagctcggcgttgcattcttgaagttgtgccatgagatcaatcttacgagcttcaagccgatcaatatttgacttgatcgggccctcagacggctgatcaagcttggacttctcttcgtgcataagctgccgattgtgctggattgtagcttcgatgtttttgcgttcccggcgatcggctaatctctacttggccttctccagcttgaattggtgttgctcaaggtaaacggctggagtaagggcatcggttagttcatccgggagtagagcttggatatctgtgaacctggcctggatcgagccacagttggtcactaagttgtctaatgatgcttctagccgatgagagatatcctcgagcattctcttcacatcatcagacagaggagctacagctttactggtggtgtcttcctctatttcatcgagataatccttgatgtcgaaagaaaacatatcggctaagacctgcaagagataatattatggatggttaaggatcaaaacatgattggctgatctcagatttgtatcaacaaaaact

SEQ ID NO: 42090 - DNA, 1501 bp, Oryza sativa
gaacagcaattggaaaatggctacgatcatgatccacaatgtttctttcaatgacatgcttcatgattttcattttgtctggatgcattatcagtgatgtcttgataatttgccaatcaattacaggaattaccttcttcggcacagtctggaagcatcagctaggtgctgacctaaaatagttatccatagatccataagtcaatgagcatgccacagctctgaagcataaaacatatagacctacacaaatacttgtcagaatttatgagttatgacaatatgctactatgaacatggaaacgactatgattctccatttcaccatttggttttgattccaggagttagcatgacgacattatatcgacttcttgttccctatcaatgcatcaaaaaaatggtttgcatttccatgtatgaactcgaaacacggagaaattaagaacctaataaaattgccattatcagaaaatctagtagctcgacgcctccacgctttcttagggatgaccaatgtggtgtggtcggatctctgaacctccccgcgagcctctgctggaagctgttcatgtcctccccttcgtatagatctctaacgagatgcacgccgggctacttgagcagcatctggtacggcggccctcgcggacacgacgccgtacggtttagaggattcccccgacccgagcacccgagcgagggcccgcgggccgcggcaggatgaactcggcgactccggcgtgcgaggacgaggccaatctccgccgctgctgccacaccataccactaccaacggcgatcggcggtgggcggcggcgccgtccggggcggccgaccccccgacggcccctgtggatgctggggatggtgagatgatgcgcgttagtggccgtcggatctgcggtgcctagttgggcttgggcaacggcccactgataaatcactatatgttgtacggcccattcaatgggctcctgcaatccggtccctgtttaggagtgctattttggttcgctattatggtacgggtatataacattttcgattttttttcatttttaaatttttattttttaaatatttacagaaatattgtaccggcgaaaatatttacagaagtaggcctgataaaaaaaattagaaaaatacatttttggcaaggcgaaatttgcatttgcccccttgcagcccttgcagagggtggcaagggaccttagtacaaaatgcgcacaccttgccgccctccacttggacggcagtggccattcctgtaaatattttggatgatataatatttctgtaaatattaaaaaataaaaattttaaaataaaaaaaattctaacatcttcattccggtccttttttcagggcctaatcttttcacttatgcttatgcttatcagtcaaaatttaaatttttaactttaaatttgaagttgattgtgaggttttttttatcgaatttatttttccgcacttatttgtagatcgctaagt

SEQ ID NO: 42091 - DNA, 1501 bp, Oryza sativa
aatatgtgcattgcacgtgcacgattactagtaatgtcttaaatccatagttttgtgatcgtttagtcaaagtatatttagttttgtgaaatttactctttttaattttgggttaattagcggtgcctgcaacgtaatatagtatctgagttagatggggaaattagccttattatcaattaatttagtaattgatccgctttgcatcaaattgattgtgaccaacctagtaacttcaatgtgaatttttgaaacgaagatttttttttaagaaccaccaccatgtgcctgccattagttgacagaggttcacacgccttaatttagggctgtcaacgagccgagctcaagcaagccagagcgtaaggctgccttatgctagaggttgagccaagcttattcccctttatgctttcaggcgggcttggcttaagtacgtgataacatatatttgatgataatttcgtagtaaaaaaacaatttagaatgtaccagcccatataaccagactcattagatgctttcagctcagctcaacaaattttgcgagcttggggttgggctcgagctcggttcgttaagagctcgagcaactcgcaagccttgagctttattattattgttgttattttacagccttaggccaatcctccgtatgcaccaaatgagcgtgcaaagatgcaaaagcatagcgagatttttctcatgaaatgtattgggcaatatctgtcccttgcaacttataagttataaccacaagtccacaactccgtaagtatacattggaacatgaacatcagtgtcctgttaaaggacttattttgggccctccctctgtttattggcatgaagaccaaagcaggcataaggcccacctggcctagtccagtctgataacatcatacacaaggctcaggccagatcatatgccagtgtctcgcaccaattacattgtcaaacagcagggcaccacaagcaataaagttctactaagatctcaccctctttagaaggaaaataatttgttctgcaatctacatatggttcttgtatttcatttggtttcatgtataaacgacaacaatgcatcaagtacagcactaatctgacaggcacaatgcaagaccagccaaactgcacctgctaagtaggtccatgacgcaagatctgctccgggtgatcaccaccaaaaccaactttccagcccatgcttcgtcaaggtactccaatacatctagagtgtattcatcatctaaattattgttcataaacctataggccccaaaaagcacacaaaagcatggaatatactttgaaaaactccaaagcaaatcaaaagcatagaacagaaaaagaagtttccacatgctaaggaatatgctaaggaagatacctcatttcggtctgcgaaaaggcactccaccacctaagcttccactttgtgaaagaaacctcgtgtactctctataaatgaaaccaagcacagcatcttccatggagg

SEQ ID NO: 42092 - DNA, 534 bp, Oryza sativa
  unsure (1)..(534): unsure at all n locations
ccgctctttganaatcgatattcgagctcggtacccatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatatatatatatatatatatatatatatatatatatatatatatata

SEQ ID NO: 42093 - DNA, 1501 bp, Oryza sativa
ttgtaaacacagagagaagtaataaagttgtcatctactttgagagatcttcgatttgtgtttgctcaggttcggcggtctaaccgacgaaacaccggtggtcagaccgacggcatcacggcggtcagaccggcgggtacacaccgatcagaccggcggcagcgtcaagaggcagaggcgatttcaggcggttggaccgggtgatccagatcggtcagaccggcagcacaggcgcggtcagaccgatctacatcgatttgagggtaacttttaattccgtaaaaagtttgattttttgggtacaccaaccattcactcctctctggttggcttagttctagtaattcgatcctacatatggaagaaaacattaattcaaatttagcatgtcatccgagaatagatctaatgagattaatgggcaccaaaaaagataagaattatctctaaaaacaacacataattttacatgcatacatagcacatggtaattcaaatcataaagtaagagaggaatggagtgagaaataatgaatatttaccttgcaggcttcaatctttaaaaaaaaaaggagcaaaaccacaccttctttagctgatcgggcaagaacaagaggcgcaagtctgttcttgcttgatcaactcggtggataggatgggactcatatatgtgggcggctcatagtgttagtgatatgccctagagacaatcatagagatgattgtatcacatactgtaacatactagatttttcagggtaaaatttttgcgaaaatatttaaagtcgatgttcttcgttctttcgaattggagtctcccaatccttatatttcttttgttcgctctaagtttcctactcccacataaccttgtttagtttccctctccaaacaaaatccgagatatcccaaagaaaattcccaaaatcatcagaagagctcgtgtttattttaagttatcccagagtcatcatgcaaatattctaagaccccaaatcccatcaattcctattaaaaaatatcctaccaaaattctatgcaaaaatctctccaaaaattcaaatagatcactgtgttttttctcgggccgagttccttgcattccagcccatatcccggatttctttttcccttgtcactctctgtgttgggctgttctagctcatgtcctggcccagccgaggcagccaccccagccaagccgctgctcgcttcgttcgctctagccgccgctcgtgccgccctgtgtcctgctcgtgtccgcacgcgctagctgcgtgccgccttgcacctgcctacgctgctccttgtgccaccctgagcccaactcatgaccgccttgtgcagcctcgtgccgcctcgcgccaaccacgcgccgatctccaatggccgtcgtgccgtgcggctccgaaacagccacgcagctgctcgtagccatccctcctttgttttccctcctcctccagtccttctctccttcaaagtgaacgagccgaagtct

SEQ ID NO: 42094 - DNA, 1501 bp, Oryza sativa
cgaaggtgtgggagagggtggatttcccgagccagcaatgacaacgtgttcgggcgccgtgaccccttttgggccgttgtcaagcagctacccttcctcctacttgcaaatctcatcggctggaaaaaccagtctagttggatggacaacggtggcacctaggatgtcatgacctccttgaagacgttgcttaggaggtcttgttccctgcctttgccgccttctctcggtttgattgttggcggttcttgattgtcatcatcatgttgtcaggagggatgagtatgtgtattttcttctctctcgccctctccctctcttcaacacctctacatgatgataaccataaacttcgactatcttctgtacagagtcggtatgtgggaaatatttgcaaccccccttaaagtttagcagtgatcgcacgcatatggcggtcggcttggtgctagcgccttcttttgggttgtgtgaggagctgccagcgtgcggtgctggtgtgtttgtttttgttttttttcccggttaacctccaaaggttataatgttgtatctttcatgctatatcaatataaaattttgcaccatcgggtgcgagtcgtttcttaaaaaaaaaagatttgcctttctttatccatgaacttattaaatgttgcataaaaaatatcaaatgtgatccaaaaagttctccattaataaaatttaatttagatcgagatagaattttgaatacctagaacaggaaaaatgttactgatatttatattttttatttagttttttattttctttcttgctcgtattatgatctttttttctaattgctatatattgtgttcaaaatccaaacttctcattttgggatattttgcttgctaacttaaatagctttactgattttttgggatgttaatatttctgtggttaaagaagtttataaaatgaacagagaatgctgtgacaggtgacagcaatgatttttctcatactaacggttgcgcgtcgccatttaatttgctatacatgcatgacgtacttgcgatgatcttgcctaggttgcatttctttgctatggctttcaacaaattaaatctagttttaaaatgcaagaactttgatttactgggtcaactatgagtctcggtcaaggggtctgtcttttttagagttaatggagatgcatatggataattcgtggggaaactctattcatttaagaatgtcccctgtttttacatgtagtctaaaaatcatcatttttttaaaaaaatagtaaaatagataaatatgtgatatatcgcttcatcacaaacatacatgtttagattcaacttatacaaattgaaaaaaaataaatttgactatggatagaacgcgtaatcacagtcaaatttgtataagttgaatttcaacttgtatgttttttattttaactttttttaacaaaaatttatgattttttaaataccatgcataaaacaagaaaacaagaggatgtccc

SEQ ID NO: 42095 - DNA, 1501 bp, Oryza sativa
cctctttgctctcatattcgtagtgtccatgaaagtgctcaactttcagaatagatgaacatcattgaccatctcccctctttcatgtacttcctgggcatgttagccctaaaatctaagctccaataaaaagaagaaacaatcttcttgtcttgaacgagagctagtctatcttttcaggccaacttgtgttgcaaagatacttgctttacttgcacaacatttcggattgattcagtgttccaggacgcatcagattatggaatacatcaacacttgcagcatccacgaaaacgtacacaaacagttggtgatacttaataaaaatgggagaaattaacatccaaggctccaagccattgaattcggaaatcctaattggcgatcgatcgtctgggacgggggtagcgatcaattcccctcccccctccctcactccactggtttccttttttggtaccgcattacttttctattttagtaaatttatgcacctcaagtttatacacctcaagtttacacatctaaagtttagagacccaaagtttacacatctaaagtttagagaccaaaagtttatatatccgattcaaatttgaatttgaattcaaaattttttatatatagtatttctatacatctaaagtttatagaccaaaattttatagacccaaagtttataagtcaaaagtttacatacccgattcaaatttgaatttgaattatatctgatttaaatttgaatttgaattcaaatattttctatatatagtatttttatgcatctaaagtttatagacctaaagtttataagtcaaaagtttacatacccgattcaaatttaaatttgaattatatccgattcaatttgaatttaaattcaaatattttctatatataatatttctatacatctaaagtttatacacctaaagtttatagacccaaagtttataagtgaaaagtttacatacccgattcaaatttaaatttgagttcaaatttgaatttgaattcaaattttttatatatagtatttctatacataaatttttctaactttttgtttttttaaaaaaaattatgtggtgtactgtagtaggaagagaagaaggggaggagaaaggggggagagaagggaggaatgtatcgagtatagggggaggggggcggatatgatcgctggatcgatcgcccgcccattagggcccccccactgaattagatcaagggaagggtttctttgcatcctgtttggcgatggcccaatgtgaagccaggaacaagcccaacatctggtgggcgttggccttcggagaatgattcggttttctgggctgcatctaaactttgaagagttttttttccccttcttttgttcaccttgagattcgttttgaaacatattacaatcgcagtcgcttacaatgcgcgcacactcaccactataaaggcacatatgcacaccctacgcctatgacgcagtcgctcataacgcgcg

SEQ ID NO: 42096 - DNA, 489 bp, Oryza sativa
gttagttatctgctctcgatcggatgaggatgagagagatcttcatctttgaagataacggggatacacctatgtaatgctgtgcggctttttttttttgtgacaagattgaataaatacatgatgttttggaggatgttgttggaatactcgtgtcatcggagcatatgagtaatgctataatggactgactattcgcttcccacccacattctttccttgtcctccctagcaccgattcggaccttccattaaccataaggcacaacagtacaacacatcagatatttaaaatgctcttgttagggatgtacgcttgtgatttcttagcaactagatgataccctgcgtgctgctgcaggatactaagtattgacataggtttaaagggtccgtgcacggattctatatggaaggatttaacataaaagctgcacagatgtacaccattttcaaagaaatgagttagggtcctcgtacaataggagc

SEQ ID NO: 42097 - DNA, 358 bp, Oryza sativa
acaaactccaattgtaccaaatttagactccttccaaatttgactccgcaacgcacacaatatctccatcgtatgtcatatggaatcttcaccaaccatgtgcattgatctttagcctaagtattccgcatgatatttgaccatccggacgtcaccttatctccaagttgactcccgatccatcaccggcaatactctcctgaggcatcaagtcacctacacatgaatcaaacaaagaaaccatattctgagaccaagctatctctaacttgactcattgttagcaaacaacagtattacatactcatagtatccatatagaagctataaacatgaactatccacggatatccaaaga

SEQ ID NO: 42098 - DNA, 851 bp, Oryza sativa
attcctgcagccccatgaagtgccagatcattcaatacatcatgcataatatagtaaatttggtctccacatcggaacacttggaaaaatgagcgctgtagcaaatcattgaaatagcctctgccaatatcctccagactagtattgatatttctgtctgaatgaacaaaaccctgagctgcccacatatggatcagcctgtttggatcaatgcggtaacctttagggaataactgcagtacgtaaaacactgctgaagataatttggtaagctttcataacttgagcgtaagattgtcataatgtcattagggttgagtacacttttctgaagaattttgttccattccagagcgttgtatttgccacttaaatggcctccagtcaccttaatggctagagctgagccttttaggttttcaacaatttggtcctcaattatcttcaactctgggtaatcttctggattcctgtttccaaatgcacatttccggaagagcattctgctgtcatcttttccaaggccctgcaagaaaaataagcttctcgaatctagcatttttgctaccaattctgcccgggttgtcactagtattttgcttcctgttctctttctctctaaagcctcagaacttatatatatatttcttatgggagctatcaactccttccacgtttctctgttcatgtgctctccaactctttcatcataccacacatcatccagcactagaagaaaccttttgcacatcagtctatctcgaagcttttcttggagcatactgaaattgaaactggccaattcaatatgttctgtgccagctgtgcatgctatgatctccttagttagt

SEQ ID NO: 42099 - DNA, 916 bp, Oryza sativa
tgctcaatcagagatagaggccaataataacacactgccatcttgacatttatactctttttcgtcatcattttctaaaattaaattgttgtcactcttttttgatctcttgccaacttactggggatgcaagaaaatgcagattttgtatggaaatctaggccaatggaggcactttaacctactacctccattccaaaataagttaagctagtacgggaagtgacatatcctagtagttatatcgcactactgtgaatctggataggatatatcatattccgtactagattaacttattctgagacgaaggtaatatatttcattttgcatttctgaaaagcaacacggccatattttaccaaaatttaatcacagatgggaaacggagatgactggaaacccaaaataatttcaactttctttgtgtgatgaacaattggcatatgagattattggttttcatatttagagattattggtgaagtggttttgaagatgattggattttcaggtgatgaataggtgctgctgattgtcaggtccggtcagactgggcaagtgctgccggtcagaccggaggtatgtgaatggtcggaccggcctgcccacggtttgtccggcggactctgtatcagtttcggttttggtttcgggctgtttctttggatatccgtggatagttcatgtttatagcttctatatggatactatgagtatgtaatactgttgtttgctaacaatgagtcaagttagagatagcttggtctcagaatatggtttctttgtttgattcatgtgtaggtgacttgatgcctcaggagagtattgccggtgatggatcgggagtcaacttggagataaggtgacgtccggatggtcaaatatcatgcggaatacttaggctaaagatcaa

SEQ ID NO: 42100 - DNA, 1501 bp, Oryza sativa
atgctgatagatggagagaattgtttgctcctctatgctatggagctaaaggaagcaaaattcttgttactgctcgaacaaatattgtttcaaggattttgggttgcccagcaccattccatttggagggtctgaagggtgaagatagttggaacctcttcaggatctgcgcatttggcgctgaagatccaggaaattatccagaactagagtctatcggtgaatgtattgtccaaaagttgaatggctcagcattagtcataaaggttgttggtgcacatttgaatgctaacctcaacgttgaagagtggacacgagttatgaaaagtagttcatcaaacaaggaagacattatgcaaattttgcgtctgagctatgaatgcttgccaggtcacctccagcaatgttttactttttgcagcctgttccccaaaggctattctcttgagcctgacttgttggtgaatatgtggatagcccataaatttgttcatggtcatataggcacatatgaaagtatgagagaaactggtagaagttatttcaatgaactattatctagatcattttttcaggaacttcagtatggccatacaatacgttatgttatgcatgacctcatgaatgaccttgcttctcacatttccagaggtgagtactccagaatagaaagagatggtaatcttgcagaaatttcaggaacaactcggcatctgtctatacctgtcgaaagagtaaatgaactccatggattccataacttgcaaaggctgcgcacgctaatagtttctgaacgaaggcaggtctctttgctcaaaactttgtctgcaggcggatgtttttaaggaattcaagtgcataagagtattggatttaagtggctgttgcttagaatttctgcctacatatattgatcatttgatacatctcagatttctttatctccaacatgttggataagtctttgtgatccttggttgtgattcttctttttgcttttggatagtttcacctttttcaggacagcatctaccctttagcatatttttcaggtgctaggacagctgcggttagtaggacagcaacagttagcatcttctttatgcctcctttatgctttattcagtttggatgccctctaggacagcatcccattcaaatttcgaattttagactaggagggtgtagcaataggctagcagccagctctggctatatatatgtatccaacctccctcgggtaggtatggcttttgtgtttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcactggttgctcctccttcccctttcccttccccctctccacgcagcagccccccggaggtgcgcca

SEQ ID NO: 42101 - DNA, 1501 bp, Oryza sativa
actatatgttgtgatttaaagctctgcttgtgtaaactaaagctgaattgttctttggtctcgaatacttcatatggtgcaggcaaatacttcatttcttcatattgttcaactgcaactgatttggaagtccacagataacgagatgtgacagatgggccattaagaactctctaagtccgttctatcaaatgtaaagtaagatgatatacccttcccagtattaccttattatatttacctgtcttcttttattgacaaaaaagtcatgtgaatcatggagtggaatattaaacagccactgcatatagcattgcattatctggatgagttatcatcaagcatcatcctgctatttctaatcagcgttgcacatgtatttcatcaagctcctctgttactttctggctacatgaagtggagttactaatatattgctatatgaagtgaaagtttcttcctgctcaaaaaactactactataataaaatggctaaatatgccaattttctaccactaccgaatctgaagttcaactgatgtgctttatttccatgttagccttgatatggtcagcccaccagtattaagattaacaaattgcatgtcatatttgtgagaactgaaaccgcttcttttgaaatgggctctaattgttgaaatatgttttttttcatgtctgtgcatgattggagtatctattttttttcggctgtactgaaatttggtttgcgatttaacctgtgaaaaatatttctttgcactgctctatatcttttattttgaaagcaacatcccgaggatgaaggctcttgtactaaagaaaatctttagttcctctccttgcaattttttcggttcttctttttgtttcgattaatgaaaccaaaaattcttgaattgaaggaaaacaggtagctctactatgtttatggtctttcctattgaagtaggaattcataggtgtgtagcagtgctcagcgattgcacgaggttggttctccacttctctgcatcagattggatatatttcaattgcttggattttgatctagctgacttccttttagctaaaactgattactgataacaagttctacacagtgaaggggatgcaaaagatggtgtctccacctctgactccattcatgtaatcatgttcatggtctgctccattgagtttatttttactggatgcccattcctccattggataggcctggcttaaaactgcaataagtaccattaatataccattctgtggccagtaatcttcagtaaagcatgtattgtcatttgctacctcttttgtgttttcttcttttgatgtgtaggagaccaaaaaacaagcgtgtacaaacgatggaaagagaataaactatgtcaaacgatcaagattgcatcgctcatcttttgccacaaacactgcaagagagattgatttacatatagtgaatgaatcaattctatagtctcaaagatttatctcttggttttcttta

SEQ ID NO: 42102 - DNA, 1501 bp, Oryza sativa
tctttaatttttaatttcgaatttcagttacttctaaattgtattcctatgttgactttaaactcttcttcccgtgtttttcttaatttcgaattttagttatttgtaaattatatttttatacagactcaaaactctacctttaattttattatgtttattccgaattttagttagttttaaattcctatatggactctatactctacttctaatattccttatttttttaattccgaatttctatttttttcttaattgtatttctatatggactctatactctacttctaatattccttatttttaattctgaatttctattattttctaattgtatttctatatggactctatactctacttctaatattccttatttttaattccgaatttcagttatttcctaattgtatttctatatggactctaatatcctcttctaatattccttattttttaattccgaattttaactatttctaaattgtatttctatatggactctagtctcctcttctaatatttcttattttttaattctgaattttaactatttctaaattgtatttctatatggactctagtcttctattctaatatttcttattttttaatttcgaatttcagctatatctaaattgtatttctatatagactctgcattttctttttcttcgattaatgtaagaatttctagaccatgagaacgaatgtgtagactccttttcctattcatttaataatataatagattctgccagccggtccaatgaatggaacggccgtagcatgtagtatatgcgtcgtcgtcagcagcttgaggtacgtgtgtgaaacccgtgctctgcagcttcagtgtgcaggcttgggattgaacgaccggccggcgagcaggccacgcccgcacgcgacgtcgcgcgctgaggcaagaaaacatggcgaattgcccgagccagaacgccaccccggccgcgcgccgcgcacgtcactcgcaaccgcctccggcgccgcgagctcgctctctcgctatccatccgagtggttggaggcaacttggcgctgctgctgcagccactctagaagacaacaagacatagcccgtcaccaccacagatatgcagtgcacacacatgttgactaaagctagctagctacttgtactaaaacaaggtgttcgtcccatgtactactactacgggaggaactaattaatctgatcatgctctctcgtggtcaaatggttagaaaagtacacacacatccacatctagaagcaagccgggccgttgttcgtcgtgctagctcgatccatttcctacgtgtgcaccaaaccacaagtttcagctttgctgccatttggtctttctaactctctctatatatatagtcatacgcgcagcatatgtgcaagtattgttgcacagtgcagcggatatacagatttcgatcggcgacgttagtgatcagctgggttaattaattacgtggctaattaagc

SEQ ID NO: 42103 - DNA, 1501 bp, Oryza sativa
gcggccgtgcgtccgtcgtcctgccgcgctttggccagccgtcggggggtgcacgtaagggagctgaggggggtgcacatgtggcaaaaacaggatatcaagcactgtacagccaatataacttcgcccctgcctagtacaacgaatttagacgtagagtatatctagatttattgtatgaggttggtttttttttttgggatagggagtatgcccccatctctgcactattcaattcgagtctattctcacttattaaattgttcacactccacactgcaaactaatcatgcgccattgtgaggattctccacctaacctcaacttggtctggttccgagttgcttagtgctattgctactagctagaaccagaacacgctctgcctttctcctgctggctgctgctctttggcctgcttcagccttcagcttctccatggttttctttttgtttgctccagcttctccatggttttttttgtttttgttctgagaggaaaaagggattttatatattgataaggtattattcttggtttctttcacttgatagcatgagttcagcatttgtaggctgtcaaatttttaaggatttctcaccatagtaaaacgattatattgaatttacttggtggatcttgatccgtatgtagctcctctttgcttcccaggcatatgagttatctatgtttcccttttgctgaaatacatatggagttaattttgcaaaaccatagatatttttgtcaaaactatagatttatgccgctgtattgcaaaaccacgtactccctccattctaaaatataatggatttttggagggatgtgacgcatcatagtattacaaatctagaacatagtattaccacgaatccggacagcctctctatccagattctagaactagaactaggatgtgtcacatccctccaaaatcgcttatatgggacatagggagtatttagcatatggagttccataattcttgacgtttggacaaaattgagggctatctataacttttaaaatatttagtttgaagaagctagaacatgatatagattattcttaaaagtattttaacaaaattaaatatttcataatttccctcctaggaaattttaggaactgaagtctacttaacaaaagacaactgcagctgagacacagagagtccgagatagctgcaacattagtactaatttttttggtgtctaggggtctactggtttaactaattaatggaatcaaggaataatgggaaattttatatagttccatctctgatagtaatcttacatgcatttgaataatgcggattttatttctgaattgttctattaaatgtactgactaatggacaccagtatgcctcacttcgacatgttttctttatgttcttatatttaattaattatcttatcaatgctaggtacatcagttgaaagctgtaaggagaaactgaagagccaagagacagtatattgagcaacatgg

SEQ ID NO: 42104 - DNA, 260 bp, Oryza sativa
tgaatgccgttgctctgatgggtatcgatcgagtagaccgtgtttgggagaagaattggttgtgccatctgtggttttgttgtttccttctccaatccagatctatgaagcctttggtgcaatggtattttggggctagaaatttacgggtgctgttggcttttgcccattgtgtcaatctaattcagaataggttggttgactgttcatgccttgacattgcaagaactaacttcttttctctttgcaacttatgaagt

SEQ ID NO: 42105 - DNA, 1501 bp, Oryza sativa
ctttggtttttctatacctcattcctacaaaccgaatggcacttgtagtagttaatcattaggaatctaaattctttgtttttcttcaaaccgaattggtttagatagatccttaatttgcagcccttagaggatgcaatttttctttttgctatattcaatgaatgaaatagcaccgtctttgtgtctattcatttaaaaaaaatgattacttttgactggatctctacacgatatgcattggtgcagtacaataatagagatcatcttgcttcttattatattcagcttgattgacacatttttaaatatacattgatacaaggcacatatgttaacgaaccaaatttggtaatatcagcatcggagaaggagattagatcgaagctatcggtgaagtgggcccgggggtatgtggaatgaggggaatttacctttcccatcctggcgcatgacctacagcatggccctacccccgtaccccgcggatcgcaggagcggccagggggcctcggggtgccacgtcgtgcccctcgggccctcgcccgttttgccccgaggcctcggggtgtcacgtcgtgcccctcgggccctcgcctatccgccatctggcggggggagcaagcggggagggggcccaagccgaacctcctttaatgaacgcagcgccccaactgccccctgccgcattcaatgcggtaggggcagacgtgcggcatgcccaactggcgcgcgatggtcaggaatgactagtctgtgaccggcctgtcaccggtcacatatgactggacggacagctgtgcccccacgtcacatctgcctccggcagagtggaggtaggtatgacccgtcccatcggaagggtcattcgaggtcctccccatgagaggatggccaccacaattcttcatccattaatgggggattgacaggggtgtcccccgtgtcaggcaagggacggcgctgaaccccactcaaggacaatccgtggcttagcttccaggcgaaggcacgggtcgagatccggtcaaggtagggtgggccccccccacccgagagaagagtagtagagtcggtgcatgtggtatcccttgaggtataaaaggaggaccttgcccaccgaaaagggggggaccaagagaaaaaacctgagctcaaggagaaaggaagtaagggcactctctggggcttagggacctttgtaacttgagcctaaatcccatacacagcagtagggtattacgctccttagcagcacgaacctgtataatcttgttgtgtgcacattagctggtagtctaggggacggatacgtgatttccagaggcgggccttttcccccggccgaactcacgaaagggggatcccacgatctcccgctagagaggatcattcctcgacagctggcgcgccaggtagggggatttcgcgcgcttcgaagagaagtcgtttccttccgctccaagccttcctccggccccaacgatcatggtggaggttt

SEQ ID NO: 42106 - DNA, 1501 bp, Oryza sativa
aaatatcatcattcagaaatcatcttgcttgtagtttgtgagctgttaatattttctcctgcaatagtagccacatgaagaacataaggttttgttatgtttccaacctccagatactagctaggcatgtttgctgaacagcgcaacaaattgtactctataatctgatctagcactgtggattccagaatggcagaatgatgtccatttccaggttatggagtttggatggtcattagaacttatattttgcaattttatccacaagtagaagattgccaggaagttaacatttttacttctatgcaatcctctcatccttttgttgcctgtaaaatttcgaaggatttctcagcataataaaactcacaaaatcgaaattttcgaaggatttttcaggacatatgaattatctatgagtgtgctggattgaagttggtatccccagcagttcatgttgtgcccatgcttttgttttgtttgggctgtataagactctctatttgttccttttggctttctccaaaaaaccgggtaattaaaattacctgttatctaaaataagtatgatttatctatgctttacttggtcgaagtatatatgttgaacctaattctgtcttttgattactcaaatagattttgtgaactataaggaacttgtgaacctgtgtggttttgcataatcaatatgattgcccttctgtctggactgtttcacggggagaggattatttatgtctcagtaacagttgctgacaattgaatttgttggtcccaatcatagtttagtatctttgttctgaaacacctaaatcaggcttacacaagcttttatattttacacattgggctcctaggttgtttcatcctctctagaaattaagcttctgaaaattctttgcatactgtgttttcggctattttggtccccatagttataacaattcattatttatgatatcatgcagggaatttctgattacatggctgagttttcagcaatgagttctgtaggatggattgtttcacctatcattcgtaaaatggtttctgtggtgcagtcctatatatcaagccagttcacctggaagtctgagatgatgtctgatctcaagaatttggagtccactttggtacagattttgttggtggttggcgcagcggaaagacgaagtagaaaagacagtagtcaagtgatgtcattgcaccaaatgaaagatgcagtctgtgaagctgatgatgtcttggatgagtttgactatctgatcaaagaaaagattgaagacctaggcatgttctcatctgttctctctattggcaagcgtttagttagcattgataagctcagatcaaaattacaagaagttataaaaacactgggcagagttagagcttccgcagagatgtttgctcaagttatggcaggggaggtctctagcttcagtcagtctcctgagtatgctccagcaagagccacaggatctcttttgcgtgaaga

SEQ ID NO: 42107 - DNA, 1501 bp, Oryza sativa
aaaatatcggattagtgtgttgaatttcaaaggagtgaaagggtttgatagctcgatattagcagtacgtagaaatatcaatgattaaaaaaataatttaggggtagatctttatatatgtagccaacgctgaaaaatatatgagtatgacaagaaccccaaaatcaacttctaaattaaattttaaaatttaaattttggttgtatagctaataagtcaagaaacaaatggtataaattgacagatactctctctacccctaaaaaatcaatagtaccatatgcgacacattgtcacaatatgtctagttaaacatgcatgttatgatctcacaaaggtaatcgcctctaaaagtaataaaacaatgttcgatctacaactcacgggcaactcaattacacattgtcagagttgaatcgaggttgtcgtgttacaactgacgtcagaaatatgcaacggaggaatgacaagaaaaaaccataccactaactttcatgaatttattgttatttacaacaaaaatacaagagttcatctctgagttcattctcaactaccctggcatattataaaaccccccaaaattacatcaattctacgaaatgttaaaaagtaaataaagaaaggtaaagatcaaaaggaaaaatcagcggtgtatattttatcaagaaacaaaggaataatcggcaacagctatcatgcaataatatgtgcagtttgaacggctcaaaggaaacaatccaacatggcgagcgccttgtgtacgccctgcccgccggcgccgagacccaccacgttccggcactttgcgcggttctccgacggcgtcaggttcaagtccaggcagacaccgccgccgtcgcaggccttcacggccgccgccttgcctacgtcgccgttcttcgtcgtcgtcgtcgtcgttgtcgccgccgcctcggcctccgcgcggtgccgacgcatgtgcccgccgagcgcctgcccgatggggaactcgagcccgcagacggggcactcgtgcaccctcggcttcgccggctgcggccgcggcggcgtcggctgcctcccgaggcatagccccgcgtcgtcggcgccggcgccgccgccgagcgcgtgctgctgctgctgcctcggccgcttgtggctggcgcggtggcccccgagcgcctggaacgtcgggaactgccggttgcacgtcttgcactcgaacacgcggtcgtgcgcgccgccgcgcaccaccaccggctgcgcgccggcggcgaagccgccgccgcccagcaggccgtgctggctctgctgcgcgaggagcatcagcacgcgggccgtgtccacgctgccgacgaactcctgcatgtcccacatgctcctgctcctcttgctcatggctatagctagcttaattagccacgtaattaattaacccagctgatcactaacgtcgccgatcgaaatctgtatatccgctgcactgtgcaacaatacttgcacatatgctgcgcgtat

SEQ ID NO: 42108 - DNA, 1337 bp, Oryza sativa
gcgccgccgcgaaatcgtgcttaggtactccagtggcgcaggattcagtccttataatatcctctatttttttttaaatttttcggaggaaatacagatacttcgggttttcgggatagtacttcatacatgaagcaacgaagtttttgagaacttagtttatctggggcagcatgggccatggagagatactccagttgatgcttatttggatttcggagagggatctgctctaattaggaatggaactcctaccagtttggaggcaaataattttggatgcgtgtatgacaaattatcaacccccccccaccccccccacccaaagaacttaagtttcttctctgtttggatatttgtcttttagcctctttaaccgggaaaaaaacgagatagttacatcatttgtactcctacccttattttgcctaggggcctaatgatctgataaaacaaagcagcagaatcagagcataatgggaaatttatgtacttatagttctagtatctctggcagtaatcttacatgcatttgagtaatgcgaaggttatttctgaattgtgctatcaactatatgaaccagcaccaatatgttccacttctacatgttcacgttatgtttttctctttggataattgatctgaccaatacatgataggtagatcagttgaaagctacacggagaaactgaagagccttaaacactatattgagcaacatggccactataccactagccactggagttggatgggtggtttctcctgtcatcaagcttatgtttgagaaggtccaatcatatatatcaacccagtacagatggcagtccaacttggatgatggccttaaaaagctcgagactattttaactgaaactttattggtggtgggcactgcagaaaggcggagaacacttgatttcaatcagcaagctttgctccaccagctgaaagatgctgtctatgatgctgaggacatcttggatgaatttgactacatgcttctgaaagaaaatgctgaaaagcgaaatcttagaagcttaggctccagttctatttccattgctaagcgtttggttggccatgataagtttagatccaagttaagaaagatgcttaaaagcttgagtagggtaaaagaatgtgctgacatgcttgtcagagtgattggaccagaaaactgtagttcacacatgttgcctgagccgctccaatggcgtattaccagctcattttcaattgatgagtttgtggtcggtcgtcagaaggagcgagatgaactagtgaaccaattgttagaacaggtaggcatacctaagtcaagaagcgaaggagc

SEQ ID NO: 42109 - DNA, 1501 bp, Oryza sativa
tgaattagattaagtgcagggatccgtttacaattgtagaaacacactgacatatgggcctaggactgcgggttgattcctagaaacctcaagggcctttgtgcatattggtccctcacagccatgtggaccccatcctttaaaatctgaagaataattaagaaaatgcccaaacaaatatatgtttagcagaaaaatgcacaaagttgtaaaatctatataaaatcaaatatagctcattttaaagtgattacagttgctgtagattcttgaagttatgaactttattccaggaatataaaacttgacactcactgtacaaataatgtctctaaaatttatctaagataggtcatacataaaacatgtacaaacttataaaatacatagaaaattcatctcaactcattttgaaacaaactcaaaaactgcagattcatcatcatgcatgcactctctgattaggtgaaataaaagtaattacttactttgcatcaaattcctctaaaactattatatctaaaatgattagttttagataagctaaactttagaaattcatgtagaacccaatttagcttcaatttgaataaacttaagttctgtaggatcaccaaaacatgtatttccatgttatgaaataagattatatacttactgtgtagtaaaagtctctaaatattcatataaggatttactaacatagagcagcctttaatttgtaaaacttgtagaaaattcatttttagtccaaatgaaatgaacaaagtttccatagaaccagcaaatagttatcttcaacatagtaaaataaaatttggcaccttttgtagagaacatagatcaaaaccttaacttagtgaaataagaatttaaacacatagtgttgtttaagtaatacataaacatgtataagtatatatacactttaggtctaattaaacctaaataaaaacttgattgaccagtgaagccatagttccatcctcatccactaaaacttagaagaacttagctcatatgacaatttctaggttaatataatatattgctagtttagattagagcatctctagtttataaaatatgaaccatagtagtaaagaccataaacatgtgaaataaaaatgttttagttaaccaaattattccttttattcaacttaaacaggaagtagcatgttctgaacctataactcaaaagtcatgaacatataaaacactatatgcctaaaacacgttgtaacttgtaaaatctataagaaaatcattataactccaaaaattgtgaaaccaaatgtgttagtcttagaaaacacatctccacacccctgtgaagtctaatataataaaaatcactttacaaaagtattttataacactacctaagactatactactataaaccgataaaacttctaaaattcataactcccaaatggaataaaataaaataggaattatttcacctaaagtcattttagatcagtaccaacccact

SEQ ID NO: 42110 - DNA, 1501 bp, Oryza sativa
acacacagtgtgtcttggagtctgtgctgcagctggctatagatctgtagcccgctactcttctctctcatcgtttatctcattaaaacatatttacagctggctaagagcctgctattgtacctactcttgggatcggtttgaagcccttagagttataaaatagcaccataaaagggctcatggctcattcgtctttacgttgcttcacgttctctctgcggacagccacggcgggttaatattgctatgatgcttttgttcctttggtggcatccaccttccttgtgacgactcgtctctgattgccattgcaggttgcacataatatgctcatagtgtggcgacgtacgtgatgattaacatcaacagtagagagggtattaattaatttggacgtaataccgttatggtgttaatatgtatacctataataaaaccatatttaatattggagcgctagtagataagaattaaactatttgaaagttagctatagcaagtctgcgtgaagaacgtgcatgttttcttattagagagctcaagcataaaccaatatataacgaatgatgtttattccttgcaggcacggccactctcctagcccatactaccaattaatatttgatgggacagtctctagtcatgcattatttgattactaaagaaactttgtagagaggaagttataagaaacttgttgcttctacttaaatgtaaaattgaatctatagtaaggaaagttctcgattttagttttattgcatcaaaagtttacaattcaccatataatagcatctaacgtactttccctcagctatacttccaagtcacttccgtctcttccaacctgatttgctatctgttgggaatcacttcctagctagatagactcgcacacactcctgataaacacacacacatttagaggcaaagaacagtggagtttggtgctgcacaaacgcagcgtttttctcttttttactcaattaacaaagatgctaagtacatgcttaaatagacaaagttagaggccaaaacgtgcgccactagcagccgcatgctactcttagccacacgactagatcatccatatgcacacctagtaattaactaagatcctaatggcccggctattatgctaatgactctactaaccagccactatttgtgtgctcctgcagcatctcacatacccggccgtctcgcacggctcttgggcctactcgtatacggatctcgcgtactactactatagcttcttcgggtaccttatcctatcctgctacctatacatttatttgctacatgcgaccaaattaagcaaacatgattatgcactaataacaagattatttctaacactatcttatttgacctatgttaactcagctacccacttagaatgacattctaaatttgtcatccattatcttctaacaaaatcgatatgccccctaccctatgtgtatatcgtcaaactcattctgtgtcacatgta

SEQ ID NO: 42111 - DNA, 687 bp, Oryza sativa
attcctgcagcccgtaacagtagtaagtgctggccattatattcctaggattaagactgagcatactcagtagcttttcaccttgcctggccaaattgatcgacctttttctatcaacttgtgccatgataagattgcttttactgccacttgctagagaaacggacgcagagtgaggagaatcgacggaagggggaaaagggaggggggagcgggacgacggcgcttggctcctgccctgctatgcgcgtcaaacgtggaaacgaccgggggagcaggaagtgatatgtatcgtttggaagttgggctcactttggcttggcccgttagacgaagacatcaggctttcaggtgttagctggacggaaaaagtacaccgaaggtccctcaacatcgagttacaaaatcatccttcaaccacaaaaccagatatatgacattcttcaacttacaaaaccgttcactttaggtcctccgacgtggcggctgagtcaatgtaggacccgcgtggaccccatatgtcagactgtccacgtcagccacttcttaccctcccccctcaactcacttcgtctctcctcccctctccacggacggtggccggtggagagcagccagggcacggcaggatggtgcggcaggcatggtcgccagtgcagaggagcacgttgcggtcgggcgccgcca

SEQ ID NO: 42112 - DNA, 1501 bp, Oryza sativa
aatatttttgtatctgatctatttattaattttagatagagaaaggaccaaggatatgctaagagaaaatgttggggctgtttggttatttgccaaattcaaccctaccaaaaaggttggctctgccagaacatttgccacttgtttggtttgctaccacaaatttggcgatacctttttttttccgttactagtctaactaatcttgccagcaatccaagcaatcatctttgccaaaaaaataatttgcaatagccaaatcttgccaatggttgccattgtaaaaatgttagcaatactaaaaatggaagagaatcaagtaggcccattaaggctgcgttcttttgtagggttccctactcccctctcgtttttcatgcacacgttttttaaactgcttaacggtatgtttttttaaaaaaaaattataggaaagttgctttaaaaaattatattaatctattttttaagttagttttagttaatacttaattaatcatgtgctattgtactccgttttccgtgctggaagagaatagaaggttttcaactagcacaacgaacacagcctaagccctgctacttcatcaaattattgctgtgaattatttgctctatgctacttctcaagaaaaaaaaccagcacttattctaagtcatttgttaagtttatcttaaaatattgtattattcctataatcaagtagataatcaagtaaaaatttaggtctcatcttttcgcttatacttatacttatacttatcggccaaaatttaaatttaagctgattttaaggtctttttaatcaaagtttattttttagcctaaaaacacgtatataaaaattttatttacaaattaatttacgtttacaaatatgccgtttcgcttattcaaaacaatgccttttttgaatgggctctaacgcccctggccgaaggatttatttattgatattcttatctttttcttaaccgtaagtctgtaaccagcccaataattatgggccgttgtttgggctttgggccggatcatgatattgcagttatcggatttgtacccgaaaaggaaaaatccgcttcactcgcctcctttctcctcctccgtcctcgtcctggtctcgcggactcgctccctcctcccctccgccatcgcctcgctcgcgcagcaatccgcgacaaatccaccagccaatcgcggcatcgcgcccatcccttcccctatactgcaaatccgcttccccgagatggtaatttccttccgccagtctctcctctcacgatgtttaattgcgcgcatctctgtttcttcggtctagttatgtcgtttagggtttatgaccaagagcagatggtgaaaaatccggagttcttggtcactcggcgtgccattccatatcttttatgcgtaataagaccttttttttatgtttttgtttcccaaattttgctgtctggaaataatttcttgaaagggttggctttgatcgtttgctcgtgc

SEQ ID NO: 42113 - DNA, 1501 bp, Oryza sativa
cccacccaccctcccacacacacaaaaaaaaaaaaaaaatccccaatcaggctatcagctcctacctccgcggttggagtcatccctcctcgggcgtgtagatgtagataacgaagaaggcaaggacacgatggagaggaggatgatagggatggaagttgtccggtggcgtggaggtgggcagcgggcgttcgactccggggcgtcgagggtgaagacaactaaacatggcgcacgacagggatgcgcacgatgaagacgggggatgagtgcggcggcgacggcggatggggaagatctcggctccgtggggggttggggaagacctcgcctccggttcagtgcgcggtggcggcggcagcagaaggggacgacctcgtgggcagcggtggactgcggcgacgacggcggatggggaagaccttgtctccggcggcggcggatggggacgacgtcggctccggccgcagcggatggggaagctccggcggtggctggggaagacctcgcctccggttcagtgcgcggaagcggcggcggtagagtgcgcagtggcggcggaaggggacgacgatgcgaggagcgagccgcgcattgagagggtgatgaggcgtaatcttcgcccggccttcgcgcctggagagtgggaatcgtgcggtggagaaggctggacggtacagattacatctgatttacgaatggacggtagggatgtaaacatttgatttggcatgtaggattagagggggcaactcatttttatattagtatagatatcacaaaattacatattaaggttaaggatcacaaaactacaaatttaatattgaagttatcgcaaaatacatattctaggatttaaatacctattactaacgttatattggatctataaatgttgtagatctgggatatgtactaaacctgtcatttttgtaatttttttcctaattaatttttatttttatgatacttcatcctaaatatgtagttttatgagaaattttgcgctaaatatataattttgtgatacaagaccttaatatatgtagtttttgtgatagtttggtaaaagtatgtgtagttttgtgaaatttacttaattaaaaatggcgactaagaacgaacaattcactcacactttaccattctaatttctaactataaaattaatttattttagtttacttggaattgagttattgtacaaattgattgctcatttctactttcagtttcgaatttcgttatttttttaaatagagatgagtttttatacaaatataatttttgatatgctttcaattttatttggaatatcagttatcacatattttaaacttacttggacaattctttttattgtggattaattaaccgtgaaagtttgatcccacaaaagttgatgaatgatgaatgagcatatataccctttttctgtctagaaaaatatcggattagtgtgttgaatttcaaaggagtgaaagggtttgatagctcg

SEQ ID NO: 42114 - DNA, 1501 bp, Oryza sativa; identical to SEQ ID NO: 39208

SEQ ID NO: 42115 - DNA, 1501 bp, Oryza sativa; identical to SEQ ID NO: 39200

SEQ ID NO: 42116 - DNA, 1501 bp, Oryza sativa
atagagactaaaattaagtccctagatccaaacaccacctaagcaaggtgcccaggtccttgaggttgccgccaatttgcattgcttcccgcagtaatccttctacgtacgcgaaatctatttcaagagcgctctcagtttaattctatagcgcgacgcatctcagagccgtctaattgtgcacgtcgtcatgatgtccacccacgttggtgtctttttcctttcaaataaagttcacgtgggtgtctttttcctattcaaataaagtttcctctcaaattacttatccgatctacaatccgattataccattgtgttcgttacaattaaatcttaacaacaagatcttacatgattatgttccggtgtaaaagtatttatatttgtaaattacttttattatatacataagttacttttatcatatatatatatatatatatatatatatatatatatatataaaagttacttttagatttgactaaattacttcttagacatataaaagtaaattcaataaaatctaaaagtaatttacatatattctaaaagtaacttaaaatacaacagaagtaactttgtcacgacattagaagtaaattcgttgtaggggataaaatatgactttttagttaattccataatttgtgctgattaatttaatttctagatagagtcatgtttttatctctacaacagatttacttcaaatgacatgtcaaagttaccttcgttttgttctaagttacttctataatatatataaattacttttatacttactgaatttacttttatagtttaagaagtaacttagtgaaatctaaaagtaatttagacatatcataaaagtaatttgtgatttttcatcaaaagataatcatgtgagatcttgttgtaaagatttaattacaacgaacacaacggtataatcggattataaatcggataagtaatttaagagaaatttctctaagaaggaaaaaaatacatagatattgagtgtactagtagctttttttttttaaagaagggtgtctctctctagcactatccagctagcactctcggtgtagttgtgtccttctacataacgctttagagactaatctttcatttgagaatgttgtggcttcaatgtgtaccttcacgacggagatggtaaccataagcccaataactgatatgtaggtcccatatgttgacttagtcgattggattaggtcaatgagcatgttatagaaaccatctaaaaagcagctgaggtagtcaaattacacgggttttaatagtttggggaataaaatacctggtattgtggttgagagatacttcctccgtttcacagtgtaagtcattctagcataaatatagaaaatgctagaatgacttatattgtgaaacggagtaagtaattagattgaacatatattgagggagtaaagtgaatttatttattcccttgaaaaatgtgcttggatgggctggtaacccacta

SEQ ID NO: 42117 - DNA, 512 bp, Oryza sativa
ctctagatactactgagagcaaatagattgaaccagataaatttattcgagaaatgaaatgaaatttatttgtgaacagataaaatttagtttggttagtagttactgggaattgtattactgtgtgaaactattgaattggaaaacagtgtttgcctatttttgtgtctatccataaacgtcaaccttacttcataaattctcgttttatccaaactactaaaaagttgcagagatacaaatgtaggacaaattgatactacggtcatcaaggaaatttgcaaattgcaatgcatgacacacattgaaagccttgtttggcatcaatttcaccaaatttcttgagctttacaatatttcattctcagataatacgtcattgcttttctcttagagagttcttaaaactattcactgaacttgatttgttaattgacatcatgagttcttgattctttatcatctttgtttgtttcacccctctaaagcagacctcaagtcactgccagaga

SEQ ID NO: 42118 - DNA, 1501 bp, Oryza sativa
cagagttactacgtagagagcattttgtaagaaaaaaattagtatgtattatatactgtactttccttttttttcttattatatcccttgattgggtttcgtgttaaaattgagacatctacagtctgtgtcgtatgattcgaattcccatggggttggggtggcccgtacactagacgcccgaatccaaagttgcaaacctttactttagtttagtaggaacactttactttatgaaactataaaaaagagattacgcgtgttcatgccatctacttaaaaaatatatatctagcacgaacaccaaatagtaggagtactaagagcaagtttaatgaggcacaatcagcagacgataagagtgccacatcatctaaattcattcgtggaggagagagaaagatagagggagagggcaacaggcgcttctgcaagcgccgagctacagcacaagaaactatgcatattataggaaccaatgcaaaatcaatattgtggttgtttttctccaatagcatagctatggccccattagcagaacacacgggataggatagagagtagcaagttagattaaaaaatagaaaaagttaactacctagagaagtgtgtaggtagattagcagcctgctattgtacgtatcatctttattttctacctccggatgacatgtacatttttatcaccagttgatggcggtactattaaacttgctctaacttatttctgttcgtggcggctatcaatagtttaaagagcagcaccatgctgacaggcaaaagaagatattagtttagggagattcgcactcaccaggaagctcaatcaaaatagcaaaatagcatgactaaaacgtagtattttagtttttctttttcgttgtttgttatttatctcaattatgagattagtattgtatgcactcgtgtacttttgattgtgtatatttactagtggatatgacaattttttatccaatatctaaaacatatgctgacagccaaaagaagaagataatagggagattcggattctcgtcaggaaagctctatcaaaaatagcaaaacggatctccacccctcgtgggcaaatggggtctcgtctcctctttttttaggcaggagggagcaaggctagattcctcaccccaacactgtcgcagatcccaccatcttacctggcagattcggtatcagcgcgtgccagtccgcccggcgcccggaggtaaagcaaccaaccaaacaaaccatcacaaaccccgcactttcgatcgtgtacgtttgaccccgcaccccctctcccccgcccgcctctcggcttcggccttcggcgcgcttcgcctacaagtagtagccgcgcgcgcagcacaccacaccaccacaccacacacggtcacacgtctcactcgccgcgacctcccctccaactccaacctcgcccttctcctctcccccgcgcgcgcgcaagcgagcgagcgaagcgccgcaatgacctggaaca

SEQ ID NO: 42119 - DNA, 1501 bp, Oryza sativa
cgacgttgccgtcggcctgcacgtacaggctgaagcggccagccgagaagtcggcatcggagcgcttggacacaagcgtagctccggctccggtggccatggactggccagggaggagcgtgtcggccgggtccctgaagctctcccacaccacggcgcggccaccggcggcgaggaactggaggttgccagagtcgagcagcacgagcacggagccgtactgctggcccgggttcgcgttcgtccagacgttgctgccggcggtgtcggcgagcgacagctggccggcgagggtgacgctgaacacagactgcgccgtggccgtcaccgccgacccggagcccgggtccctcgcgtaccataccaccgccttctcctgtacggcgtcgttgaaccaaacggcgaggagaaaccagccatccgggcggccggagccgagggcgcggaagccgaaggcgaagtcgccggacgggctggtgatgtagtgaggaggcctcagagtcgatcctgccgtcaggttttctgcttcaacttgaagcagacaggatgattgatgcagcagcagtgcgatcagaagcagcgggacgaacgagaatgacttcatttctgctcaataagctgctattgcagctggtcacaccaattttgtgattgtgattatagtggtgccagtgccagctttcttcatagtcatgtagtagtaacttgcattgattggccgaattttacatctccggacgtcctgtttcatcgtacttaaaaaaaatgtttctcccttcgtccacaaaagttacacgtattacttttgacaccaagaccagagagaaattaaatcaccttagatgttacaaaattaaagaatgaatgcaagcatgcaaccaatgagtatttagatgactccttcagttctaataaaatatttaatttatctcttcatttaagtcttgaatgtataaagactaaaaaaagaaacgacttatttagaaaaactttaatgtgaaataggtgtaactttgtggatggatagagtagtacgtactctctatcttaaaatataaagaattttaaatggaagtgacatattctaagattattaatctaaatagttttattataaaataatgttttcaataaaatcggatgcgcgtgatagttcatttgttcaatatacacgttagctgataaaaaaaatttgcatcggacggcggtttcgtcgtttgtatacgtggtctcatgtggttgtcaaggtcaagcatcacaattcacacccttggactccctctgtttcttttttaataattgctttttaatttgatcgcacgtttaactattcgtcatattcaaaaattttatacaaatacatcaaatataaatcatgcctaaattatatttagtacgaaaacaactcacaataaaataaaagataattacataatttttttataagataaatgatcaaatatgtgtccagaagttaacagtgtcacctattaaaaataga

SEQ ID NO: 42120 - DNA, 1501 bp, Oryza sativa
tgtctcatgtctctcaatattacactttgtggtgcttttgttccacaatgttcctctttaccttaggctatgcatattgtctatgtgaataaagtaaaatatcactacttcaaggcaagaagtaaaactttatcatatagcaaaatgcaacataatattggaaataaagtctagccatgcaaggcgaatcacgaaataaatgttgtgctctcatagagcttacaaaaccattattcaaaaatgttcataatgcaacttagctcaaaataaaataggagcatcaaatactcaaatggaatcaaccagagtattgagctctgcaaagatctgctcctgggtgacggcctcttcatttgcttcgcctgctgcagctgtaggggcgtcaagtggagggagtagccgcagtgacggcctcacccatgtgtgcttctgcggacgccttgggcttcctgctggcctggtatgcatcgatgacgtgctggggctcctcgcaaatatggctccagtgaccccaattgccacagttgtagcatgtctagtcctgctggccatatgccttgtcattgcgaggtggcttggcttccttcttgcccttgcctccctgtgctccctgggcagctggagcttttccctctgacttctcagctaccttcttcccaccacgcttgcccctcttcctctggacaggcttgcggaccttgtaactgctagcattgacttcaaggccaacactcttgccaggcggttgggagacaaagttcttgcggagaacctcgtcatgagattcagacacctgcatgatgtcgatcatctcgtcatactccttgtatgacgcttgcctgtagttacaagcgctctgcacagtgctagggtggaaggtggagagtgtcttctcgatcttctccgtatccgtgacaaccttgtcgcagagggagaggttagtacagatctggtgcagcgtggagttgtactcggagacgctcttgaagtcggcgaacctcaggcgagcccagtcctgctctgcttggggcaggatggtgtacttcaacttctcgaaccgcttcttgagtatggtccaaagagtgagtgggctccgcaatcccatgtactcattcttgagcgtggcgcaaaggtggtgccgtaggaagtgcagcacccgatcgttctcatcaggggtaggcgctcggtcctgcggggtgcccatcccgatcgtctggcggagcttcttggctccaaggacgatctagacatcggatccccaggtcaggtagttctggccatgctaagctagttcggcgaactccttattcgtgatccctgacattttattgcaaaagtactacaataagatagttgcaactatttcatgctttttccaatatttatattcatagggaatgcgaataaaaagtgcaaaatattaaataaataaatactagagttcatattaaaatgcatacaaatattcatacaaaaagaaaaggtgcaaaagttgcatata

SEQ ID NO: 42121 - DNA, 1501 bp, Oryza sativa
caggcagcggtttgaaccgttcgattgctgctttcaacagagagatgaccagacgtggtgctcgggttgatggcggcggaagcgattggcgattcaatcggtaggtcggacacttcaggcgggtgtcttgaactttccggtgagccactttcaacaaggagacatgaggcctcacgctcgggattgattgaagctggaggcgatcggtgttctcggtcgatggattcgaacactctaggcagggtggcctgggcctttcgatgagctgcgttcgatggggagatggctagacgtgacgctcgggtcgttcggtggctgggaagatggcatgcgacttgtcggcttcggctctcgactagattgatggcgttcaatcggaagtcggagcgggcggatccttggtactgatggagatgtgttgacgacaaggtggtgcacgatggatggctacaacaacggcgtacaatctacaagttctatattgttataggcacgagtcagatcgatgtcgttcgttgtcgatggaattgactggagctgctggacaatatattttaatttacaaacttctaatccctatatgttatttgggaaagatcaaattttttgaagtgatgttcaatttttgtccttaatgattacaacattataaataatgattactcttggaattgaatgaattttgtgtgtatatgtgatgtataggtgttattcttacataaatggtgtataagcgataattattcaatgtattaagtgaattttgtgttttaggagttgagtgcatattgttatgctcaaatatagtacttatgagtgatgtacatatgcataatgtgatgaatatatatctaattcctatatgttttcttgggaaagatcttttttttgaagtgatgttttgtgccgccgccgatatggttgcccatggccatgggctagggcaagcgtactgaaagccactgcggagcttcatcctcgccatcacacggaggagagcgagcgaaggatggaaagcagaggagacgcgagaggagggatggaggcgagacggcacgcgatggaggcgaggcagagcagatgagtcgtgggctcgcatccggtggtggtgggggggggggtaaaactgaaatttcacaccctcctggccatttgggcaacgtgggctgtgccatgcccactgttggccgagtagcctccatctgtgtcttcagactttgcaggtgcgaatttaagtcccatgtattgtggttcaagtgtcttttggtgttccttagtccagttggtagtccaggtgtagcaattttcaggacgcattgtgagtgccctaagaagcaggtacaataacttgactcggcgagctgcaaaactattccacatcatcatattgcagcctggcgatagcgatttttgtaagtcggtatcgctcgtttgcagctgctcccggtttactgctgaattaagttcgatttatattttggaataggttcagctctcctct

SEQ ID NO: 42122 - DNA, 1501 bp, Oryza sativa
tacctacggggagggcaaactaggtggacgaagagaagaaaccctcacctgcggcggcgcaccggcggcgtcgcggcgccgctgggattcgtcggcggcagcagtagagggaggcagcgcgtcgcagcgaagaggagcaaatcccacgtcgagtcgagcgaaccgacgaagacgacgctactcgggccggatggatatttctcgtgatgggcctaactataatgggcctgaaatgttagcggcccaaacattatgatgggtctaaaggatcgcaaccattgaatacgatccaaaattactgtgggcctttttggatctctttcttggatgagaactcgagcagttccaacgttgggctcagccctcgtcggcccgccgcgcccgcgccacggcccacgacgcgtgcgcgctctagcccatggtgttcgtcaggtgagagtgagcggcgacctactccatgatcctctcaggaggaggaagctgccgggcgcgcgagtccacgcgacttttatcccttgaccaacctcattttccaagaattttagtgagtagaaagtctcacctgcttggctgattcgcctccaggaatcatttctttttaccgcaaaaccgcgtgttaatccggcataaaaagctcgaaggcagagcacgccatggcgacgaccaccagcacagcagccaagaagaagaagagaactagagaagagaagcatctccggcgatgagcggcgggaggaagcgggagtggatacggaggaaggtggcggcggcggcggcggggagcgggtcgccgcggtggtcgcggcgtgtccgggcggtgtccacggcagtgctgcaccggaggcggcggcttgggctcgggctcgggcttgggcttgggcttgggcttggggtccgagtgtacgagaatgtggtgttctacgtgctgtgggtggtggagtcggtcgtcgtcctcgccaacctctgcttcttcttcctgcgcttcggttttcgcttgtgatcacaccaagggtccaagatgtgtagttggtgataccacagaggaacatctgctaaatcttctcaatttttttctctctcccccctttgaagaaatgtaaatcatatgtcctcagcttctaacagactgttatgcccagttgctgacttgtcagcaatggagattgacagacgcaaaagcttgaatctatcgtacaaaagcttttcaattaggatacaattttgacagaaaattatgatacaagaaaggcctgttcactttgataaaaaaaaaaccttttggcatagttaccaaaattttagtaggatttcttatatagctaccaaaatttggcagtaaactaaatatagccatttttttggtaattgtactaaaatttggtaaggttgaaaatgacatcaaagtgaacagtcccgaactcttaggctgggttcatctccacttctccacacataaaacggtgttgttcattaacatgtgattaattaagtattagctaaa

SEQ ID NO: 42123 - DNA, 1501 bp, Oryza sativa
tcatttgataaaccattttttagaactcgattccattcatcatagttgaagtttaaactaagatgcccagcaacggcctttattgctaatgctgagccattcaacttttgcacaatgcattcacctatagacttcatttcttgatgttcatttggatctctagtgctgaatgcacatcttctgaaaagttcccagctatcttcactctctagaccactcaaagagaacggagtggtacagcctaatgtatttgcaacaatatccattcgagttgtaactaaaatcttgactcctttcaccccatgccgtaaaggagcaaataattctctccatctatcagcatttataggccctccaaccttttcatcataccaaacgtcatccaacacaagtaaaaacttcttcatttttactttgttcttgagttcttcttggagcatgctaaaattgaaatttgttaggtcaatggtcttatcaatagatgttagaatttctttggtgattctgaccttatcaaagacatgtgagacacatatccatgccctcatatcataattattctctattcgtttatcattgtaaataagttgagttaaagtagtttttcaattccaccagtaccgactatggttattacctctggtgatactgatattgctccttcagttcttgacttacgtatgtctgcttgttccaacaatcggttcactagttcatctcgctccttctgacgaccgaccacaaactcatcaattgaaaatgagctggtaatacgccattggagtggttctggcaacatgtgtgaactacagttttctggtccaatcactctgacaagcatttcagcacattcctttaccctaatcaagcttttaagcatctttcttaacttggacctaaacttgtcatggccaaccaaacgcttagcaatggaaatagaactggagcctaagcttctaaggtttcgcttttcagcattttctttcagaagcatgtagtcaaattcatccaagatgtcctcagcatcatagacagcatctttcagttggtggagtaaagtttgctgattgcaatcaagtgttctccgcctttctgcagtgcccaccaccaataaaatttcagttaaaatagtctcgagctttttaaggtcatcctccaaattggactgccacttgtactgggttgatatatatgactggaccttctcaaccataagcttgatgacaggagaaactacccatccaactcctgtggctagtgataaagtggccatgctgctcaatatactgtcttggctcttcaatttctccttacagctttcaactgatgtacctaatatgcattggtaagataattatttaaaggtaacaacataaggagaacatgtagaagtgaggcatattggtgcccattagtataattaatactcgaaagcatgtaagatcattgtcatagacaactatagaaattccccattattccttgatttgttgaaccagta

SEQ ID NO: 42124 - DNA, 1501 bp, Oryza sativa
aaaggcacgcaagcacgaatctaacagtgcacctactgcccgggccgtccgtgggccagatctggatggggagagagattctgaacccttccaagtcaagcgtccaacgaatcctccatgttgcgcgggtctatttgcgtttggcaccctgtactgtattatctttcagagaggttatttcgaaagcagcgtgcacttttttaaaagaaaaagcaaaaacatgatcaacgcacgtaacactcgtcatcaatgttcatggaagcatggctatttgggtgagcacaataatatagcaacattagtgcacggatatggttattgccctctttgattataacatgacgataaaatagtacttagttatatggagaagagttcgttatatgtagtactactatatatatgatacaactatttatattgggtcaaacatggtttatatgaaaattcttgtctggaagcattagtgatgtggcgatccatccaacagggtttgagtcaaggtgaccataaaaaaaatattaatacacatggttaattgacaaaaaaaaacaagtttagatatttgcagccaatcacaatccctttttcgataataaacacgaagtatatcatcgcattaagcttttaagaggtagtttacatgtaacaaaaagaaaagacagttttaaacgggttatctcttgtaatatgtatacagcctatggagctacttctacgatccgaaatttaccaaagtacaacgccagcaagccactagggcgcatcctcttttgctatcatctttggtagctatatccagcttcaacggtattggttgaaagttcagatctttctctcatttacaaataacctaagctgctacaaccacaactctgttgaagctatatcgcttttgtcgttggatttttttgacacgatgcctcatcaccaatgtactaaggatatggttggttaagcagccaattgcatcgagaacaagcgacgagtttaaggagaaggggattgagaagatagggaagatacgtaaaacgagatgagctattagcgcatgattaattaagtattaacaattttaaatttcaaaaatggattaatatgattttttaaagcaactttcacataaaaaaattttaaaaaaaacataccatttaatagtttaggaaacgtgcgcgtggaaaacgatgcgttttctcactcaatctcaccctgacgaacatagtcaagagagtattatttgacaatataaccggtaaaagggggggggggatgaaaaccatcaaacaagagggtcttcttcctcacttcctgcatgaaatgcggtgcttttctaacaaagggcgaactgttggagggtcaattcgcaacaatcgcggagcaaaacgaaaaccccaaattaccctcgcacacctcggcttgtttcttctcctaccccccacccccctttcccccaacccacgccaccaccaccaacctcctccgccgcgccgctctcccgcca

SEQ ID NO: 42125 - DNA, 675 bp, Oryza sativa
cgtttgggctctatgttttacatctcaatcaaatctaacggtttagaatattggacccaccatattaactaaaaatcaagagatagatattaatgctatgtgatagtttgagagcgattttagattgctacgtggcggtttaggagcgtttatagcaagtttaatggacttttagtatataatagatagataaataaatagatatggataatgctaaaaagtcttataacagtagcagcagtagtctaggtgcacttcatttaggctctgttcgtttcctggagttcccaactcccccatctcattttttgcgcgcacgcttttcaaactgctaaatggtgtgttttttgcaaaaagtttatatacgaaagttgcttaaaaaaattatattgatccattttttaaaaaaaattagcaaataattaattaatcatgtgctaatggactgcttcgttttctgtaccggagggatgggttcccaactcaaccaaaagaagccttaggttggatgggaaccacccaggcgagccccatcatgcgacgtgtcattaccacaacaatgctgaggatgctggagttgagatagttcccagctgcaatgccgagctgcccaagcacaaagcttaggctcttcatggtgtctggggactggtcatatatagaacaattcaatca

SEQ ID NO: 42126 - DNA, 1501 bp, Oryza sativa
gcaaatctgcctaagtgttcatccttgttgaaaaatctggatgagagaaacccaacatctgaagttcttgatattgatatagatatagtatgtatgcatgtttcctgttcaataagccaatttatctatcaactagaaatttcaattattcagaacgttgttttcacccatggctccatcaccagtcttaaaaaaaaaactatggctccatcgtcttgccctggacgcgtagctgctgcctgctggtggccttggcttcataccatgatgcaggggcagcgtccacctcctcttccatgcacaactgcaacagttgctgcggcggcgaagctcagctcggtgcctcggtctgcatcggcctcttagcacaatgaggaacaacggccaccatccgagaggtctccgccaccgtcgtccactcccatggccgccgcctccgctgtactagcgctgaggacgagggaggagatagggtagtactctgcccgcatccccatataggaccacctcccccgtggtcaccgccgccgggaggccgactgccgcatcgggttgctcgatttgtggcgacgatagcaagcagtgcgatgttcccctccaattcatatgcgaaagtactactctgcccttccaccgttgaaaattactcggtacctgctttcctagagacgcggtaccgcgaggtaccaagcctttgcaaccgttggatggtgcgtaatggacgacttggatttggtacctcctttcttcaaggactgtaaaaactctcaaagtacgatggatattgcgaaatgggacttcagatgtctgaaactcttaattctgaagctaccgtatattatattcatcaaacttgtggatccgatgccactgtcctgcaatccagatggaatatactgtactagtagtataagatcaacatgaggaatcaactgataatgccacatgattctgacctgcgtccgcagacattcatctgcatgcgcgttgtttttatggtctctggagttccatttagacgagttgcatttttaatcttctgatgttaaggaatccactcttttacacacacatgtataaaactgttgcgtgtcattggctatgttaaggaaagaaaaatgcagagatttcccatggttgcttggttgtaacttcccaggtctcacgattttgcggtgctcgtttttttttttttttgggaagcagtatatatacatatgcatagtcgatgtaggcaccaatcgtgttaagtttgctagttccgaaagcatctgaagacatagacgcatatggccatggtacgttcagtaacaccctacaccagttcagatattcatttgcgtatcacggatcatgattcaggctgagttcctcaacctgttttttttttctcttggcaggatcagtacagtgagaatatcaagtatgacgaggttagttaatcctgataagcgatcccaccgtggtagccttcatagtttctgatcgccagccctttttc

SEQ ID NO: 42127 - DNA, 1501 bp, Oryza sativa
cgagcgagataagcgaatgcagtagccagtagtgggattatccctgggtcaaagccgcgcggtagggttcccgaggtagggtttcgggcggggagcggctttaagaggcgcacggccggcggcgaaagaggaaggcacgaggaaagagaggtgggggcggaggaggaggaggacaatggcgagacggtaacgactccctttggattgtagctttcgcggaggaggttttgttggggtttgggccatcagccgggcgggaggtggggggaagaaagcgaggcgtggggcccacttgtcagagacgcgagcgggagtgagaagttgcccggtggcttcgacgccgtccttttcctcgtggaacgtcgacgtcacggcgatgagtccaagcggaagaagagatcggaagtgggagagaattgcgctgtcgcgcgtcacgtaaatccacgcacggggggattatgggcacgttcggttttggctctatcgagcggaaattatacgtaatcgacgaccctttttttgcttaaactaacgctggttattgcgtacctgctgcgtggttagtgattgtacattcgtgtcctgtgtgtgtatccactgagccggcaatgacacttcgcagatagccaatacagcttcgatcggagaccattcaggatcttcctttgagagtttgagtggactttgttcggacgcaatccgatgctgacatgaaagggagcccatgaaacgggcgagaaaaagacgacccgcaaccggcggtaggaatatgaggaaacgagggaaggttacgtgacaacgacacaccaaacttcgcactgtcggatgtctcgcacgatgatattacttaaaactttcatcaaacagtacaaaaatgggaagggccatgaccgattttttgcctttttggcctagaagattagagagggttttcaggcaaagaggatattccgatgtgatgtttttagctaagattgatcaaagggggagagtttcccaactgatttttcattcaagattagtctcatgtgatgttatgaacattaaacgatctaacagcgaaaacttatgttagggacaagcttaaatgcactgacgtttccgggcaatgggaggtaaaaacatcacgatcgagattgaatgatagtttgaaatcgaatgctcgtaacgtcatgcagatagtaacgagctcgtgctggatgcaatgcaacgaccctgcaaactcctaaaacgctctgtttgacctgtgttaatcccttccggacttccggttggcggcttgtctgggccggcccgaaacgcgcgcgccgctgcaaaagcggaaacgggccaaacggcccggtcgcaacaaattccagcagtaaacagcactacagcaggcgtttccccgcgcgcgactcaacaaatagcgacgcgaaaacctcctcgtagtcggtagccatggagcctcctcaactcgacggccagtgcgggggcgagccaccggcatccgtggagggag

SEQ ID NO: 42128 - DNA, 1501 bp, Oryza sativa
ggttttgcgccgcgtatatggggtaggtgagcatagcggggctcacctaaccacatttattgcggtttggacgagcgcgtcacgccgcatgtaacgcagtgcagcgcgctcgtttattcggtctgtgaccagtcacagaccgatcagatcgtgggttaggtggcgacaggcggtctgacgcacgcctcgccccatcccgtcaggacgagagcctccaagcactcgtccctagccggagccggcgtgttagctcctggagatggcacattggttccggtcagatatatgccaggctttatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagaaagaaaaaaaagaaaaagaaagaagaacgatcccagaacgatcgggggctggctggcactttgtagcttcttcatacacagatccaccaaaacacaggagtagggtattacgtttctcagcggcccgaacctgtatacatcgcccgtgtcttgtgtgtttccactctcgcgaaccttccacacatagactaggagcttagaatctcacccagggcccccggccgaaccggcaaaggggggcctgcgcggtctcccggtgaggagccccaagctccgtcaaatatctacagccgatcgaatagatttagttctttattatctatttacaaccaccgatcgatttacatatgacatcggctcaaagataaatgagatgtcatcggcacctagccgatcggctatcgtttataggtttaaccgcggtttctttgtttttatttcttgtggattacaggatcaaatcaactggcacgctagcatacccgaaggcgagttttggacctgtactggagttaaccagatctcccaggcctcgtattttacgtcaacagcggggtgtataggagtatagttctagagccgccgacgtttgacgggacttctaggaaataaaaaaatgaattctaacaatagctatgtttgatttttagaatcacaatgaccataaagagtaggcggcggacgggctatagagaagcatagtggcatcgtttgatgagacttctaaaaattataaaaaataaaacctcacaagacaataaactctaaaaactacaaggtccaatttttaaaggttcggaatttctaaaaagtaaaaaaaaaatgataatcatgttcgattttaaaatctcaa

SEQ ID NO: 42129 - DNA, 1501 bp, Oryza sativa
aaaatcataactaaataaccgtagatccgttttaggtggttcaagttgctaaatttttctaaaataaagatctatatattaaaattgtccataaatttaattaaatttatttaattctttttaaatgggctttaattagatttaatcttgtaaaattcataataaattcatttgaagtcggaataaggccgttcaagtctcataattcatttaaaatcatgatctacatgtttgtttactttttatgtactgtttatttggtttttattagtctttttcttcgttttgcgtgttagcttgtcgtttccgtcgttgcgaaggttcgtgagtgcgtcgaaagtgatcaagaagattaattgaagatcgattattgcaaggcaagtcacacagatcctaagcacaatcctttgagcatgttgatcctatatttaaattctctatttatttcaactgtgcatttattttcgaatgtcaccgggtggtgtgaacctattcctttgttatggccaatttgcattgaatactctattccttgataccttgggtaataaattgattagcttgaaccttatgtattggtttggttcagctaaatgttagatataattgcttagcaaagcttagaaacattagctcattaatgggatgaatcatatatactacattattatttatggttatatttaatggtcgctcacgatggttaatcgtgtgatgttaattaattgataattaaaacctggttaaggtgggttgtgagcatatggttttgatggttgtgctcatgacaattaaggaccggttcgcgagctactgttgtgaaacatttaccgtgccaaccacaagccagcgtgggcaacgactttaccttttgtatagcatggttcattatagtgtgccagactgagaagcggcgagaagtccgtgggggtcgctggggagtccatgccttgttttataagggggtgattatgatccaggaacggtgcactgttttgagttgtgttgtgcaaagggtattgtcacgattttccccctttgcaatgccgtggtggtatttcggggcatggcaacatgtgcgaaatcgtgtcttgtgggtacagtggtacacctctggccagagtaaaactattcgaatagccgtgcccgcggttataggcgggttgagcaatgtttttcgtgattagtctcacacctttcacaataattatggatgttataattggtaataatttgtttagctcctggtttggagttagatctgtacagccgggtatggttgttcaggatggttgggcctgtacagcatgggtgtgctgttcagtgttgattaaaatttctaattaattactctactgttttacttatcttaaatctttgctaaatgctgcttttgcaaatgagcctatattatgccatcctttggtatccttgtgcacttgcatatttgctgtgtggcttgttgagtatgtcatatgctcattcttgcaataataatcaa

SEQ ID NO: 42130 - DNA, 1501 bp, Oryza sativa
atatatgtccaaagtgtatgacatgtgatcaaactcattcaacttatatacaaattagataaaaaccactatgcaaaactaacttagggggttatataaacggtatggtaaagtttagaggggttgaatgtccggtttcaaagtttagggtgctagatagacttccacccaaagtttagggggttatttggactttttcctatattataagtcactttgtacgtgtcctaagttaaacctcatttaagtttaatcaagtttatagaaaaatatagtaatgtttctaacacaataaaaatacaagcaaaatgtattcaatgaaactaattttattgtagatattaatattcttttatagatttagtcaaacttaaagatatctgacttagaataaatccaaagtgccttgtaatgccgggagtagctcttaaccatgcacaaaggactcgatgagagctaatgcacgcccagtgatcaataattacagcaaagagacaaagttgacattggatgccagcccaggaagggacagtggttgctagataagaagattagggagagaaaatgccaagaaacaacgtctagctgcgcacgcccagtttggacagggaacttaaacaaggggcctgagctcttccactgatgtcactctcacacttcctcaggttgacatgaagatgaaataaacaaatagcatgttgatccatgttttgagggcatgcgctcgtcctttaaaatttacaatgatagacttgaacaggaaaggtcaagcaagagctaataagatgtttaccttggaagcaagttcactccagaaaaaccttccaattgttcaaaggtcttcccaggtcaggtagtttttgccgggatgatttaaccatcctgcaccttccactcctccacaaacaaataattcagggctaccatcaagcgatccaaccatcacaaaacctctgtctacactatcttgcttgaaggaaaatgaggcttcccattgcaaccatacattatcagaaggtaccaagcagtttgtaaatctttggttaaagtgcgcacctcgttggcctagctcttaatggataccttgtaaacctacacgtttaaacaaacatatagcttaagtcatgagaagagaagcatgcgaaggacgaaacaactaaaatagcctaatcaccaaatgcactgcagccaaaaaatagggcaataatagagcacgacagtaaatatgcaccatactggtaccatagtagtactgcattgcatattgccgtgacagaaagaggattaggatgctaacaaaaggcagatcatagggtttaagggtaggtccctcataagtagtactagtataagccaattaataagactctttagctacaggcatcctgctttaaagcatgccgaaactccttccacttccttcctaaaacacaaccactatctctgccaaaaccaaaccagaaacacacaccaaacacacaagacaaggtagcaacaacaa

SEQ ID NO: 42131 - DNA, 1501 bp, Oryza sativa
ctgcgagctcatcagacgctaagaacaagaccatcattttcatggctggcgcaacatgagctgcatgcctgaaccgacaaagggggcgtggagaagctgcggcgtatgaatccattccattgccacccggagtcactctaagcaggctagtgcctcagccagcaccacagagctgcataattgcaagggctagttgccagcaacaccagacccctgctatctctcacgataattaattccaccacttgattcactagtttctttcttgaaagtgacatccatgttaaccttcgcatgtccttctggtggcattgccatttctcattctgcacaagctgattttggtcatgcctttgatatgaatctgatcatttcagagataccatgccctacattctcagtttgttcaacatacatctttcatttccctttgtcatcattagttgtcggatcggcaacaatgtgttttcataatcgacaagaaaggctacagacccaggttttttgccatgccttttgctatgaatctggtcatttcggacataccacgccctccataacatgtacaacaaaggtgctttcttagtaccatttagagctttgagaacgatgattataggagatgcttgacaagtacatcgggatgtgtgtaattccttcgtcacgagttacttagcattgttggtttacgtaccaaaatattaagattgtaggctttagcagtgaggccataatggatgcagcagatgatcagaggcctctgattcatcaccagcctctcgccaggtgctattatatcaccttgatgtgaattgtgatcctgcatctctaagtataacaaggattcacaatttcggaccaaaaattttgggtttatgatggttactggttggatggtctactggctgaaagttccaaatctattatctattatattattaaaacagccttgaaagaaggcaccacgttcgctgtgggggttagaaattcccacattaatcggataaaaggataaatatttacaccgttaaatcgtagttgtactagattttagtggtgtagattattcatgacaatattgagtctaaatagaaagcaactttgatctaataggaaatatgggagtcggacatgttgaatgaatagaagtcggacatgttgattgattaggagtcggacaggttgtctgagtatggatgctatggtcttatggacagtaatcagacaaattacattaatctatgtttagatggtaattagagtgcaaattgaactatagtgatccacgtttcatatgtggctggaaaatatacgtgccatatatatatggccattgatagtaaagagggagaacactgcatgcatgtcatgccgtatgcacatgccaagatagcagagacattgggcggagatagcccacaatcgatctagaagcaaagcaagtatgctacgaagaaatcaacatagatatacattattttataggatgagactaccgatc

SEQ ID NO: 42132 - DNA, 1501 bp, Oryza sativa
tttttcatacatatttttaaaatatgggacatacgggcgaatacatgtcttccctttcctaacccatattttctagggttaattagatccatgccactgcaactttgccaaattaaaaaaatgccactactattcatcatatcgactacatgccactgaaaaattttaaaattggagccatgccactgccgtccttttttccatctcctatctcacgccgtctcgtttccccgtcagatgtggcgtcatctcacgccatttccctctttcttcctgcgaactcggcggccacggcgagcgctcacgggctgaggaggtcggagaggaagacggcgacgcccgtgggggagtggaggagggagcggaggaggtcgcagaggtgcgggaccgcgaggcggcatcggcatccaccgggagcttcggcagcctctgcatccgccggccgaccattcgttcctcttcttcggcgaggaggccgacgccggcggccgctgtcacatcctgatttttgtttcaggatttataaattatttaataaattattattagaatttatattaaatgttcgttaatttacaagtgaagttaaatgtgggaaataaaattttctaaatataaagcatggatggatttaatttttattaaattctccatggttaattatactctctggaatattctcggatttttcggagctcaattattaattttaatcatacaaagagaagttcagcaattatttaaatattaaattaatcattaaatggtctaattataattttgttaagtactttgagtgtccaagtattttcaggatttttcttgaaattatttgagcattggaagtatttttaacaattcaaagatcatttaagtgattattttaattgaaaaagttcaaaaaccctttccctctaggcactgacatgtggggcccacatgtcaggcccttcttcttcctctagcagccggccggccgagtgaagccgtcgcccgagccgcctccttctcctctcaaatccgctccaatccgaccccgattcctccgggtttttgaggggttttgatcctctcgttctcctctatctttcccctcaagaaacggagcaatccgttgagtattctctccgaatcgagttcgtttcgagtttatccctaaaaaccgagtttggatttttcccgagtcgattcctctcgtttggagttcgatctcttcaatccaagcttatataaagcatcccctagtcgtcctcttccgtttgccccaagtcccgagctccctcgtcgcccgtagcgctgccgccacgttgccctagccgctagccgtcgccggcgatctccagtcgcgccgcgccatcgccctagccgtcgccgccgcttgccgccgccgtctttaggtgcgccaaggtgaagagaagcccggccgcacctcctccttcgtcgccggccgccgtagctcgccgtcaccgtgcaagccgagccgccgctgccgtcttcttcg

SEQ ID NO: 42133 - DNA, 1501 bp, Oryza sativa
tacatacaaactgtgcaattagtttttctttttatctatatttaatgctccatatatgtgtccgaaaatttgatgtgatgttttcacgaaaagtttttgggaactaaacaagccctaacagattagcataagggatggcaaattgtacgtaagcccagcagcaaaagctcgtcgagctatttgagctcggctcgagaagcttgcgagcttcgtgataggctcgagctcagtttaataataaaacgagccgagcttgaatcaagcctaaagcgagccgaactcgagtagcttgcgagtctcgagcttttttgacagctctacacacaatttttatctaccgctatctcaaacccagcttgccaattgttttgactggttacttcataaaatcatatattcatgaaaagcttaagccagcatggaacctccacatagaaagcatggtaaacagctaataggcatgatatatttagctttccttcaaaattaaataacctttacctaaaaagatgctagcatggaacaatcataaatatttttttctgagagggaacaatactatttctgaagtcaacaaaagcaacaataggagtatcagaatttcagcatcatgggttttatttagttaacaaaacaagagtttcttgtgaggacaaaatgggaaagataacaacactacatagcccaacagtgacaaaatgggatggacaacagtggcacagttggaagttcaaaccgtttcccaccaactgcggttaggaaaaagggtgtgtttagttgattggctaatttttttttaagtatatgaacacatattaaacgtagattaataataaaataaattatagattccgcctgtaaactgcgggacgaatttattaaatctaattaatttgtcattagcaaatgtttattgtagcatcacattgttaaatcatggtgtaattaggttcaaaaggttcgtctcgcaatttacatataaactgtgcaattaatttttcgttcacatttaatgttccatacatgtgtccaaatattcgatgtgatgtttttggaaaaaaaaaatctaaacacggcaagggtccgacggaaatttgcacgagtatttttcaaaacaacccaacacagccgaaatattcacacataattcgaagacgtgtttaactagcaaagggaactggactgtaaacaattactcattaattcgagggacttgtacgcaaaaaagctaaaaaattgaactaaccatagttagctaacctcgccttccacagaacaaaccagggttgcgcggacgcgaacaccaccagaccagaccacctcctcctcgagcttcccctcctccccctctttccaaatttccccaatctcgcgtcgcttcttccccgaattccccaacctcgcatcccgattcctcccgcggatcgtgcggcgacctcgcccaaaatcccccgccggattggcctcgccgatggcttaattggcgatttcgactctgcaa

SEQ ID NO: 42134 - DNA, 1501 bp, Oryza sativa
tattgaagtgcaaatagctttgccttcatccctttctctaacagactgtatacgttatcaattttgtcaatgtgatgcaatcatttgctctagcttgttactcctattagcgtctagaaggctgcacagaagaatacatatatgctacgggttcagcaattgtgttggctcagacgattcaaaaaaatattcaaatgatatcaccacatatcagaatacaataagttctgaccacataaaaaatgaagcgatatcctttcaatccaatcaaatgttacagcagtattttttagcagattgtgacaattaactagatagtggtatgaatggaattcactaatatttgaaagtagagcactgtaagtacagaccttgagcacacaaataattttacaaaataaatagcaatgtctagttttcggatagttttgatatattgaatgaccaaggcatccataacacatcattagcggccggtttttccaacctgcaaacaaatttatcaagatcgatcaccaatccaaacattgggcccgaggagagggaagccggtgatggcgtttcttcgcgtgccgtggcaaatggttgtggagagcaccgaagagcatccgaaccgagcaggatgaggtgcaccaggttggacgccgcccagaacagcgtccacctttggacgctcttcgaaagtgtgtccaagtctagacgctatagggaaccgcgtccatcctattttcacaaatttaatctgagatttatttatttaatttaaggatcattaattactatgaataaaaaattcggggttttatcactagtcgctgcacagtggggccagaataaaatttagtctgaattgtacgcaaaccatcactgaatgcgtattatttagtttacgtaaattgtctacagaagcggagattatgtgataaagaactaatgatcgacattgccccggacaggagagcaaacacccgcacgcttttgcacagcagatcatttcatgcttctactacgtgctactactacagactggtcgtgttattgtgttgactgttgagtgggagtcgttgagatccaaagtggagcagtttagcataagaccaactccatgtcgcctcttgattacctaaaccttaattttgacagcttaaacaagcacacctcacaaaaaaaccacacctccaaactcccaagcctcgtctacgagtcaaaactgcgcgccgagatgcaagcacaaactcgtcgtcgcatcctcgcccaatcctgcgttgcactcgcgctcctgctgaccacggtacacacggcagccggccgccggccggcgagcaacaaacccacgctcccctcccatggctccgaccagaccatgacgctctacaccaccgtagccacgccggcagaagctgccggcgttccttcgtcgcaacaccccgtcttcgccggccacggcccaatcggccaccactccggcggctggctgcgcgtcttgacgcggccgggagcg

SEQ ID NO: 42135 - DNA, 1501 bp, Oryza sativa
ctcagagatcgatcaatttccccacacccagtttccagccgcgccgccagttctctccaatatggccgtagcaccacccccgccatcacgccctcacgccctcatcacaaccagtcatcatcgaccatgcccatcgctaccagccctcttgccctccagtgggtagcgagctagtgatgtcgcgcgaagttgccacccccaaatcccaatccgaggcggaccatggctcctctacttcatcgtggaggaacgaacgagaagtaggaggaggcagttgtgctcggaccgtgctggcgtcaccacgtcaccaagatacaaatcgagaaggaaaagctcaagcctgccgtccttgtcaatgtcggtggttcggcaagtcaatctgccttgttggttttggttttttttttggggggggggggactcagtaggatgtttgttgccttttggttggttccgatgtaccaatacttccagatctgctaaggctcaggtgtgttgatggatgaaatattcccaattgatgggtacacaaattttatgccaagactttgtgattcgcaggttgcttgatttcttattcttcaattgcagaaattatagtttgcagctattgttatctttgatatatttgatatcgttctttgaagtgcattgcgttggtcataggtggcttgcaagctaaacgagctagctcgagctgctaaccgagtcgagccgagctgggattctaactcattaggataacgagccgagccgagctagctcgttatccaccctatgtggagtacaccactttaataccatcatcaaccgattacttgatcaccacgtacttaacgcaattgatttcttgcctagcaagggtattttgtcaattttgtagagttgtgttcctcagaatttgaagtatgggcgaatgtgtactgacattccaactgcattgtaaaatagatcaaatttctggtgaccgtctctaagcgtgtaaatctaattgtacatgtttggtatccctcttcatggcatacgctattttgattaggatgttagcaaattctaggtctttatatactcagatactcttttagcttgtaggtgcgcatttacaaggttgatgcacattttttagcttgtagagtaggtgcaggctttcaatatacctaatagtacttagtaaattgctaataactggatataagaataaagaaggatgtaaaatcaatagagaaggaaacgaaaatacccacctgaatagaatgatatatgaaaggaatggttgagtaatcatcaatgcatctgtaaggtagcatatagaaatgtcaacgagcaatgaaaggaactatatccctacccgtgcttttatatattttcttcaaatagaatggtgaaagggatgtgtgtactaaaaatgaagaaatggccatgtgattttgggggaaatgacaaatcaatcaaatccataacaatcacatagaaaatgtgcaatctagattatccctccact

SEQ ID NO: 42136 - DNA, 1501 bp, Oryza sativa
ggtagatctggccccatcgtgggcggatctgtgcccccctcccctgggccagatcgggatggagcggcgtcggtcgccgacgattgggggggcgccgacagaggaggtcgcgatggtggaggggcgaggggtggaaagggacaaacgaggggagagggcggtgtctacaggctcctcgcctagcgccgaccgacccagcgtggcttcttgctcgggcccccagccgaggagcttgtagagccgcgacccctgtagagtagatgcgtggctctgctggggacggctcgagcaaaaacgtgaatgggagtcggactccgtgagctgaagccacgagccaagctacccatcgtagatggccttatttatatctagactagatgcgagaattgttatggctgtgcaagaaagatttgtcaaaaaaaaaagggataaaaggttccttataggcttattcagttgtactacacaaccaatcgtccaacgttatctgattattattattatttgtcaaagcatgtttgatgtacatcggattgacgtgaagacaagaatgatgtggtctttgcttatttagtacccggtcaagtcactcgtcataatagcctcaaaagtactgtaacagctcataatttgcaagtagccataagaaaatatctcctccactttgtcctgaggtgaaagaggaagaggaaaaggccagtgaggaaatagaagaaaaaaggggagaaaattacataaaagccctccgcaacaggtcccgaatactttgattcggtaggggtactaaggccattttcaacgcgaggacagtggtcccgttcttttgtccaaccagagttggatgaagattaagattttttggcaagtttttcaaactgctaaatggtgtgtttcttgcgaaaacttttaatataaaagttgctctaaaatatcatatcaatctattttctaagtttataataattaaaacttaatcaatcgtacgttaatgtaatctcattttatgttaaaagcttaatcttcgtcatcattttcatatttagagaaaagaacgccaccagtgtccaccaccatcgtacgttgaacgggcctaccaaaatggaggcctaataaaggcccaagtaagtataggcccaaatacgcccatgggtcgttaaaaaacggaggcccaataaatggtcgagttagtataagcccagttaggcccacgagtaggtggaacgaccacctcacggcccttacccgccttatcttccacatccgaggatttctctctttctttttccaacgcggccatggcgccgctccctctccccctcccgcttcccgccactcgccaccctcccaaaccgcacgaggcctcggcctccgcctccgcctcgctccacgccgcgctcgcctcgctctcccagcagtgcggggcgggaggcggaggcgggggcgccctccgcgacgccttcgccctcgtcgcccgcgccgagcgcgacgcgtgccccgcagc

SEQ ID NO: 42137 - DNA, 1501 bp, Oryza sativa
attcggaattaaaaaataaggaatattagaagaggacactagagtccacatagaaatacaattaggaaataactgaaattcggaattaaaaataaggaatattagaaatagagtatagagtccatatagaaatacaattaagaaaataaatagaaattcagaattaaaaaaaaagaatattagaagtagattatagagtccatataggaatttaaaactaactaaaattcggaataaacataacaaaattaaaagtagagttttgagtccgtataaaaatacaatttacaaataactaaaattcgaaattaagaaaaacatgggaagagtttaaagtcaatataggaatacaatttagaagtaactaaaattcgaaattaaaaattaaagaatattgagagatgagtttagagtccacatagaaatacaattagaaataataaaaattcagaaataaaaataaataatattagaagaagagcctaaagtctatatagaaatacaatttacagaaaattcagaattaaaaaaatatgaaaagacgagtctagagtacatatagaaatatatataatttacaaataactaaaatttaatattaaaaataattaataactaacacatatataaaatacaatatgaatattacacatttgtagttttgtaaagttattgcaaaatttaaaattttgatgtcattctaaaaaatttgaataatataatgagaaaacatatatgctattatatgagagaaaatataatgattcttgccgcgcaatctgtgcgggccaccatgctagttaaaatttaattcataaatccaagcaccaccttaaacggaaaagctcaaaaaccgatctcgaattcttttttccccccgaaaattctcccagctggacacgcaccgacccgtccacaacgacacccccgtgctacgcatgcaaaccatgacgcggaaccggcacctgccgcaccacacccagccccctgcccgctcacgagtcacgaatgcaactatggcacaatgcgtgtgagccacccgcccatccacaaaaacccagaaaccaacaagggcgcaagcccagacacggcacagtgcagagcagagcagcgcttcgcttcgcgccactgcgacgcacagccacagcgtccacagatcacaaggcgcgcgcgcgccgcgcgccacacgcacacgcccgcgagacgcccagcgtcacgggctttaccaccacggcatcgtatgcgccactgcctgccgatccggccgcgctggctggctgctgtgtagtgtgtactcctactgctgctgctagtatagcacaccacgccactgcataaaacgctcccggacacgcacattctcccggattttcccaccacttctctcgctaacccacagtgtggtcgtatccgctgcagtttgctagcttcacactccgatgcctcctcgcccgtagccgtgtccagctgctgtgcgacgcgatggccggcgtcgtgacca

SEQ ID NO: 42138 - DNA, 1501 bp, Oryza sativa
tctaattcatcaccattcactcctcacgattgatatgattagtgattacagggtagtttatcactaatttttaatatacaatagtgaccagacctgaaattctcacaactgggtcatcactgtttacatcttttgtgataaaaacacattttctcactagtaataggtgaaattgtgatggcagaacagtttgtcactagatatccgtccaatggtgacagcaaaataatttgtcactatacaaccacttactagtgagagaagtgagggtttcatcactagagttcatcactgaaagcctaatcccttgtagtggacaaatatacagatatgcaagtacttaataggatgtaattttacgggtcacctagtattttatatgtacaagatacacacttaattatttcattggcagtacaattattaagagcataagtacgtacataagtaggctcaatatgttttttctgctcaggtacataagttatcttgaaatcgcgaagaccccatatctaacagcacacatatataccaaccccatatatatatctggcagtacatacatatactatgggcgctgttctgatctttttgaagatgcattgtgttacactggcatttacgcacagctcgaagaaatgtgagtaactggacacacatttaggtcagagcatttagcagcaacaagaccgggcgactcctgcatatcaagatctttgtgcaacattccatcgggcagattccaatcaaaatggtagagaagattagccaaggcaaattccatgttggcccacccaagatttatcccaggacatattctacgaccagagccaaatggaagaaacttaaaattactccctttaagttctatatcattatcttcaaatctctctggcttgaactcctcggcattcttccaatacatactatccctgcatattgcccacacattcacaaatacagatgtacctttgggtacatcatagcccatgatcttacatgtctcacggcacttgcgaggggacaatagcggcactgggcaatgtaatcgaaacgattcctttaataccatctttagatagcttagttgggcaagatcatcttcagttatggtgtttttcccttggaaggcttgccgcatctcagcctgcacctttgccattactcttggggagcgcatgagctctgccatggtccaaatcagtgttgtagacgacgtatccgtgccagccccaaacatgtcctggaatgatggtttttgtaattaataatttactaatcaccagaaatcttttttatccattaccacctaaacttgcacaatacgcgcctgaacatacagcctaaacctgctgtacaaagcatgatgccattttttcagtaaaacattactatctttttgtatacaatattgttatatgtatgctttcttatttaatctcataggaggtcttgacccttattcgaggctatttatgtaaataaaactttatggttgggt

SEQ ID NO: 42139 - DNA, 1501 bp, Oryza sativa
gatgccgtggcctggccggggaagaggatggcgctgctgtgccgggagaggcagcgacgatggaagacgacgctctggcaaagcgacacaggcggctggaggtggtacagtggcggcaacgccactgtacaccagcgaggaagcgtctccgttggtccccgtgcgaaacggagggcaggccggcgtagaggggacacctgcgaggccgaggaaggtggtggcgacgtcagccgccgcacgggagaggcggcacaggcggctggagggtagccggcgccgaggaaagagaaggaggaggcggggagaggtggtgcggccacgggggagctcgggaaggggctaaaacgagggaacggagcgagggggttccattttataggcaaagggaaggagccggccacgggaggagcggggaacggcggcggaaaactcggccggcggccatggaaggtggccggggttggcgcgtccgttcctggcgatttaaggcgctattcaaggggaaaattaggggcaattgaagaggaaggaatggggattaaaaccccctaatcaattttggaaacctcggtttgaatcgcgtggattttggggaggattggcactagggtttgcacgggagagagaaaggaaggaggccgggcgggaggacgacgacgacccggggatgggacccatgcgggcgcgccgtcagcgcaagcacatgcgcggcacgggcgggagggcgccgctcggcttgggcccggaggcggcccaggaggagaggagggagaggcaggcccgggagagagaggggaggggagggagctgggtcgggagggggagggaagaggtgggccgggaggaggaggagagggagactttggctgggcttggcccaaaggaggaaggaggattttagtttttctttttagtaaactttgttaattgttgttgttgtttaataaatattttcggtgctctgaaaattcaagtaaaatttgagggctccttttagaccaaggagaatttaacaaaaattcttcggaccacatttgaatttttctggcacgtattttagtgtttgacaatttcttttcgaattttaattaattctattattccttttagggaatgatttttatttcggaatgaatttatcaggacgtgacaacacgtcaccgagttccccaactatgtgaaaggggactgggagatcagtgcagaggacgtttcgctcgcgcttcgcgcgtggcggagatagttctggcagaaggacggccaatttgccgccaaggcgcaccttctggagaaactagcgaaggcggaggcggaggaccagggcgaaggggaggacgcggcggccggagtgggtcgaggcgatgcccaagatcacccagaggtgtgaggccctccgccctctccttagatttttgtagcttttcttgtgtttgccacggaaggcgaacaatgtacatttggccgatggcccttttccctccttactgtagccgaaaacggc

SEQ ID NO: 42140 - DNA, 1501 bp, Oryza sativa
acgtgttaggccgcaagggtttgcagatagaggccctcgctaacaccttcaaggaggcgaaagccgaaaacaagcgactccaggcagaactggagaagggaagagaggccagagctgaggttgatcgccttagggccgatgtggataaaggaagagagtctagaactgaggtcgaccgcctcagagtcgaacttgaaaaggaaagagcccattccgtggcgctgactgactattacaatctcaccgagctgaagatggaggctcttcgcctggaggtcagtaaagctgaggcgagagctgcggaggagtcgcagcggttttcgcgggagatggcgaaagccaccgcttctgcgaagacggcgcgccaaacacttcgccttgccctctccgacatgggggcgtgggttcgaggagttcctggcgaggacgcctccgtcttcgacttctcggagtggacccaacaagccggtggtgcgatctcggattgtgccaccgcgtacggcgattgctgtgcgcgagtgtcagtggccttcaccatgggccttctgcagtagtgcggctgcgagcacgtgtcgcgaccgagaaaaatacattttcccgaacgctagtgtattaatccccgtcccaggaaaagccggggtacaccacacaaacatgatataaaagacacatctttattatatcgataatatttacattattacaaaggcacttaaggcctgacaataaaaaataaacagcagcggactagcgggcctacggctccatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgagctggcaacccgaccctgggtcccagcttgtcccaagccaacccaggccacccattccacattttagttgttaagcaggttttaagaattaaaacactaacttgggtacattgctaggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaacccacctacggccggaacctccaggacaggcaggcaggattgagcccctagcagcaggacaccagccctgtgccatgacatctcgactaccgggccgcagc

SEQ ID NO: 42141 - DNA, 1501 bp, Oryza sativa
aggccttctttagatttcaacttttttcttcaaatttccaacttttccatcatattgttctaatttttttcaaactttcaattttgacatggtactaaacacagcctaaatgaagtttgagctgtcaattttgtcaattgtttcttagcatgtgttgcatgcattgtcatttttttttctaacacgagcagagaaaacagaggcccagctgtattgtctttttagtagaactaggcaagtagcccgcgcacatgcgcaggcactttgtctaaagtggtatttaaatatttaattttagtttactattaattaaaattaggaaggtagcccgcgcattcacacggatatgtatcgtacgctaagtatgagacatttataagagcgaaatattaaccggagatcaattgtcacgatttctccataaattgttttcgtcggtattaattgcttatataatttttaacctattacttttatgttatataatatttaagtaatatctataagcaattatttataatcttcttcattatttgaaaagaatagtcttattttctatagaaaacatgtcaacgaaagtaaaaataatgtgttttctttttttaattgcatatatattatcatggtttgttagaggataaattgggtgggacatgaggcttcactaaatgtatgggtttatatagcctaatatgattgatgtaatttgagaggtgatccatccatgaacattttcatttagagtgggtcagaggatcacacaacctaacatgaatacaataatgacaaaatataattgcgtagtaatattttttaaatgtgatgtcccatgaatacacgctgttttttctatataacatagatctaacggttagaaataataatggttccaccagtttaaaagacatagtagtattccaaaaatgtagcttgaaaattatggttgtttcaatgtctaatattattacgaagtgagtgtagctcaactggttatgttccttgtgatggaacatgcctgcccggatttaagtcctagatttgacatgggtgctcgcatttatggttaactattatttcagtgttgacatacccattggtagcgaggcgctcgtggtgatttcgtcaatctcaaaaatatatcggcccagtctttagaagatactcataggggtaggatgtgcgtgtgtgtgtttataagggtgagtatgcatgcgttgtgagcgcctgcgtttgtatggtgtatcttaaacaaatacgcaattttatagattgtttctctatgtgtgttcttataagggtgagtgtgcgcgtactcaaagtgcatgtgttgtacggtgtttctaaaaaaaattgaatattattgattgtttcccttttagtataatagctaaaaaaaatagggaggggatggacgatgttttgtgcatgtgagggtgaggaggaggtggaggagattttattcttctattttttctatattatttaagtgaaagccggtgat

SEQ ID NO: 42142 - DNA, 1501 bp, Oryza sativa
ctcgtcgacgactcctccggtcggtcgttcctcctcgccggctcgtcgtctcgctgcgccgcctccgtcgtcggattcgcagcggtgtgttccacgccgtcctagtctctgtgcagctgccgccggctgccctcgttgcctcctcgccggtcccggtcgtcgtcctcatcgtcgtggtgttcgtccctccgtcaagccgttctcgtccgtcgtccgcgtccatcaagcgagccgtggcagccccgttgtcgtcttcgtcctcggctccgcgtcatcaagccttgtgccggccgtgtctcgccttcgtccaaggatcgccgccgaagtcgttccctcgccgttcgtctacgccgcgcccgttcgtcgttgtcgttccctcgcctcgtcgcgtggtggtatggatctctcctctcgctgccccgtcctcatcctttcggtgtcgccccgtacccgttgtgcggttgtcgaccccagtacccgtgtaccggtgtcggtagtcgttcgcttgtacgtgtggtgaccctgttagtgtgcccgctcggtagccgcgtggtttcacgtgtgcagcccgcgtggtgtctagtggagtccgtttgttggccactcgcctcggttgacacacggggtccgcttccgtcgacccgtggaccgtctctgtgtactcggtctaccgcggtcctttaggttgacatgtggggtccgcatgtcaacggcgcagccttcctgtcttttccaggctagtgcttgcacatgttttatagttgcaaaacctaattataataatccgcaaatctccatataacagcattaaacttcggatgaccatgtcttggtcatacgagctccgaatcgatccgttcaagtctcctaatgtttgttataacctaaagaaccctgtgctttctttttatgtattgttattgcttctttataggcttgtagctttgcttgtgtgcttcgcgtagtcttcgtcgttccggaggttcccgaagcgtggtttacggtcgtcgccgaaggttcggaaggccgttatctctgagcaaggcaagtcacatcatccttgaacatattgaatcccaatttataaaattattttgatttaaattaatgcattatcgctttatttaaattcccgcgttatcattgttttatttagccatgcctatttatctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtattataaggattaa

SEQ ID NO: 42143 - DNA, 1501 bp, Oryza sativa
aaaagacaacaaattttatttgcaggaataatataggtttcggcaggagcatcggtcgaaagagggcgtcacataccataccacatggtttgcacggtctcggccgaagctcctatctcacccttgcccgtgaggggcttgttggcgatatggcatgaggcccttcgaccaagcctgccgaaactatgcgaccagcgaggattcaagcccaaggcatctagattagtcaaggcgaagccaacatggcgaagactatggaacaacgacggcgagggacagagaatcgcgcggatctcactaagccgaaggcctcttgggcgaatgatgtatggcgaagagtgtacgtcgaagggagacaacttcgccatagcaagttcggcctcacgggggccgatgaggccgaactatcatgccaagcctagtggccgttgggccaacgaccgcctgacggcccattaggagcccataaacttcaattacaatgtatacccatgtaaatgtccctttcataaggacaaccatgtaaaatcccctgtataacctaaaccctagtagtaagaacctgtaatggggctataaatagtcccatagtgtcatgtaatagggggatcagaaaaattctcaatttaatatacttcacttcttttcagccaccattgagtgaccacgtccttcaacgtgtgcggttgtcgtttcgactacaactgtggttcagagtctaacaagggtgggatctgatcacaacccaattctggtggagttggaaaatcaaataaccccttctggtcctaaatctttcaaatttgaaaaagggtggattcagcaagaaggttttaaggcttggataattgacatatggcctgagaggaggaaaaaacatatcctagatcactggaagtgccagagatatatcttgagaaggaaaatgagaggatgggctatgaataagaagaaggagataaacaaggaaaaagaggagctcatcagtcaaatacagaaaatagatgaagaagtggagaagaaagaactgacatgtgaagagtgggggcatagatatgagctggaaggtgctttgaaccagattttcatctctgaagagatttattggcaagggagaagtggggagaaatggatgttagagggagatgccaacgcagccttcttccatggagtagctaatggaaggaaaaggaaaactacaataaggagtttggaaggggaggagggacctattgagaatgctgatgagttgaaagagcacatttatggtttttataagaaactgtttggaatggaattacctcctaaattctgtcttagccataatatgtgggagggaagaggcagactttcttcagaagacaatatagaattaactaaaccattcagtatggaagagattgagggtgctttgagagaaatgaagactaatacggctcctgggccagatgggttctctgttagcttttacaaagaattttggcctcaagtgatgtgacca

SEQ ID NO: 42144 - DNA, 271 bp, Oryza sativa
gaccctccccccccccgagagggccaggccacgtgggtgactgcagctgccccaaacctctagtcaagatacccccggtcccatgtcaccgacagtagcccccggcgttacgctagggcgatcgcccccccccccccctctccgagggaagcgcttgggcatgacgccactccttagacctggtgacaggtggggccggtctccacaggcggcagaaacccagcggtcgcaaatcgcgcacatcgtcaaggaaaaaaccgaccaacaataa

SEQ ID NO: 42145 - DNA, 1501 bp, Oryza sativa
gacctagcggagtaaatagccgagcggaggcagtatccctgcatagtggttttcttgatgtgtgtgaggcagggcctacggtggggcagccattggtaggaccgcgagggacgggtgcctacagtggtgtcgccatcggtaggactgccatgtgtaaacctaaacttaactataacttaatgcatgtgtgagtctttccttcccgggagcgccagaactcctctcactgctagaaaccgtgtacgcctagagtgcatgaggactcaagttcatggagcgggtactgccaaagtgaggtggttgaaaggctttgccgtggcaattctcattcgttgggacgtagggtcatgtgttgggcaagtcacggagtacgggtaaagtgtacatccactgcagtgtgagtaaatcaatctattcgaatagccgtgctcgcggttattgagcaccgggacatgtattacacttggctagactcaaatttcctaaatatgaaagggatgggatctgcatgatgattttgagctggtggatcaacttctcgagaggcgagaaggggtaaaccccagaaaacaatgacgaccagtaacgggaagccatctttgggaagacaatggatggtgaacagaaccgttgctgtgtaataaccactggaattaaaacttgactagtttatgctaaatcttaggcttgtgaaaaaaattgtgaaactagctttacgcaaataaaccaaaggccacaccttgaatacctctatcatacgcattgttgttgtggtagcttgctgagtacggttggtactcactcttgctattacaaatttaatcagtggatggcaatgaagtcgaggaggatccctatgcttatcttcaggaggatgcggaggatgacggcgccccgtagatgttagttacggtcgttgcctgtggcaatggcaaggccgctgcttaaattccgctgccttatctatttctgcttttgcatgtattccagaccgttcgggcctatgttctggtctatgcatgcgggcctatgatgtaataattcgcgctagacaatctttgtatgtgcacttgatatttcagcaatgtaatcgtgagtaccagactatttgatccagggaaatggtactattaacacgagtgattcctgttataaaaacgggggtttacatataatcttcaccacgtaccagtccacctgattcaccgttgtggctatccaaaactcctaatcatccggctgcacctgcatgatctgtatacatatatgcatatctccaaaataggtaaaattctacagccacccaacaaactgcacacacatttgaccaactctcaagcaagccattcaatgaatcgtgaagctaaactaaacaatctggcatgcctaaatgaattaactactagccaaattatggcataaacacatgccccctgttttcggtataactaatgcgtataacttttattttaccgaaaacactataaaattaaccaaccca

SEQ ID NO: 42146 - DNA, 1501 bp, Oryza sativa
tatgcatctagaaaacacaaaaggtcgcaccccgtggtggaccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcacccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcacacgtgatcatccgctgcctcggggcagctgggacggaggtgctgagcctctcgtcgccacccgcgggcttggatgccgcggcgaggtggtccgcgcgctgctccatgcaagcaagcgcgactttgaggtcgccatggacggtgatagggccaccggggcccggcatcttcatctggagataggcgtagtggaccgccaccatgaacttcaccaacgcgggcctccccaggaccgcgttgtagggcagactgaggtccgccacatcgaagttcacccgctccgtgcggaagttggcggaaccatcgaaggtgaccgggaggtcgatatggcctagcggccaagtgtgccccggcgtcacaccgatgatcggctgggacggccggagcactatccacggggccttgatggcgtcaaaggcagcgggggaaaggacgttgagggctgcacccccgtcaacgaggacacgccccaacttcacattgcaaacggtgggggaaaccaccatcgcgatctgtcctccccgggcaacgcacggtgggtggtcggtgtcacgtcctgataaattcatcccgaaataaaaatcattctctaaaaggaataatagaattaattaaaattcgaaaagaaattggcaaacattaaaatacgtgcaagaaaaattcaaatgtggcccggagaatttttgttaaattctccttggtcaaaaaggagccctcaaattttagtggaattttcagagcacaaataataattattaagaaataaacaaagttaaaatggttttataaaaagaaaagccctaaaaagtccttttttccccttcccctcttgggccggctcggcccacctccctccctctctctcctctcccccgcggcccaatcggcctcctccccgcgcgcgtgccgctgacgagcgggcccgcccgccaccctcgctgacgggtggggcccacctgtcatccctatcctcccgccgctcccgccgcctcgcccgtgccctagcgccgccgccgccgcgaatcccgccgcctcccgccgtccccgcgc

SEQ ID NO: 42147 - DNA, 1501 bp, Oryza sativa
gatgatgatattagagtagtatctggtagtttaggcgtggtgtctagatttcgagatatcattatttggggttatatgctgcagatgagaggtgggccactgatggtgacagttcagtacgggttaatttcatggggagggtactcctccgtattttgccccggttgtatggtcatgacgggctatcataaggaactcggtagtcaggggtggcttctcgaagtaccaggagggcatcagatagagggtattagctagttaatcatataactagaatgtatgtataatatgtatactagaagtataggaatagattcttttctattttctttccatttagcttgtgtgtcatcctaccctttggattatgcttgtgtgtcatcctaccctttggattatactaacccctgcttagactatgattattacaagtaacatataaactattagtacggttctctctactataatctttccacgggattaaataaatacgattcccttggaatactctcgggtgaaatgctacaattgtatatctgtgcgcttgcggatgaactctgtaaccacaatatactaagagtatttcagcgccattgctgggaattaaatttctagtaatgtcgttaagaaataccaacggtagccttgttccaatcaggcacactagagtcgttccccttggccacctagagtgctttggctttaggcaatagctacctcgttgtcggcttgcttaatgccactctgctttgctgaacttcgccacggtttgcttcgcttcatgttgcttcgccagttttttatgctttggcaggttggtcaaaaggctcactagcctgtccccaccaaacttcacatttgagtatttatactagaaaaaagtgtcaagatgttgatgagctgcctcttacctcatggagctgtgcaataatagcagaaaatttagggaactaagagcagccatcatccagaagtacttcctccatttcatattataagactttctagcattacccatattcatatatatgttaatgaatctagacatatatatatgtgcctagattcattgacatctatatggactaggaaagtagcacgcgcattcgcgcgggcatgtatatattgtaggatgtgtttgagaaatttataagatgaaatatcaaccgaatgatctggcctctacgcttcaaatgtattatttctcttcaaattttcatcatcggcattatttgaaattttccaaactatttattagctttaaactatatatatttaatttattactataagatttatattttttttcattatcttgagaggagtttgacttagtttgtataaaagatgtcttataaattaagtataaattaaacatatggtgttttccagatttaattgaatgtttagagtccctattttttaataaattatgaaaactatgattgctaataaatgtatttgtcgacggtgggtacccgtagaccggatatagagg

SEQ ID NO: 42148 - DNA, 1501 bp, Oryza sativa
cggattcggttggaaaccgctcccctaatctcgccggcgccattgatggcggccgacctcctgcgccggtttcctcccttccccggccaccctctctcgccccggctctatttaaacgctccccgtgcctctctcctccgtttccgccgctcgccgctctctctccccgtcggaatcgagctcgcgccgtcgtcctctctctccgccgtcgccaccgagcttcggtccgccgtcatcgtcgccccggacctccgcccgcttcggcatcgcctccttcggcttcgccgcgtcctcgccgacctcgtccacccctccgtttcgcccgccgaccgccggaacgccgccgtccccgtcgacccgagccgcgccgccgccttcctccgctccggtagccgttcccgtcgtcgccgtcgacccggggtgagccgtggactgccgtttcgcttcccccttccctcccctctctcgggcgccgctccgccgcgccggtgatcaccggcggcgacgaccatcggggcgcgggcgcgccgcctcccgtcggctgtgccggcgaggccgccttcgggcgcgccccgcggctgccatgtggggcccggccgtcagccgcccgcgtcctcgggtgcggctgacgcgtgggacccacggcgccggccggcgtaagccgcgtgcacccggtccaccgtggaccgagaggctgccgcgtgggccccactcccatggacccggtccgcgcgcccctcccctcggttgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaatccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattaccgctttatctaaattcccgcgttatcactgttttatttagccatgcctatttatcattgttaagacattattattgctattgttattattaccttgttcaccccaggaaaataaaaccccaactagtgggtactctatttatggttccactagtatgaacttaggtagatgcttcgctggttaattaggcaacattaggtggttttataactttagactttgggaaatctcatatcatttggacagtagggaattgttggattattgtggaattggacacacacctccccctctattcaaaacccccaaaatggttttaggctgggctcgaggtgcgtggttgggttttgctagtcgtacctcgggtactataaggattaa

SEQ ID NO: 42149 - DNA, 1501 bp, Oryza sativa
tcgatctcttcatgggcagatttgtggcaacaattcgtcgctaacttctagggaacttacaagcgccacgcgatcgaagacgatttacacgcgttaacatagaatccgggtgaatctttgagggactatgttcggcgctttaatgactgcagaaatacgatccccgatatcaccgatgcctctatgatttgcgctttcaaaaccggtgtcagagatcgctatactacccaggagttggcaacaaggcgaatcacaactactcgaaggttgttcaaggttgtcgatcgatgcgcccatgcagacgacgcgctgagacgcaagaacgacaaaccaaaggcgggaggagagaagaagccagccaaggacgcacccgaatcaagaaagaagaaaagcggcaagagtgggaagaggaaagctcaagcagaagtcctcgcatctgaatacaagcgcccgcccaaacacccagacccacaaggtagtgatacgaagagaatatgttgccccatacacaagtcggacagacattctctagaggagtgcctcatcttcaacaagtcgttggaaaagtagctggctttggagaagggcaagcaagtacgtgtagtcgagaaggccactgaggcaaccactcaggattcggacttcacatacccagattccgatcttcatgtctcgcacatcttcagaggctccatagtgtactcttcaaagcgagaatacaaaaaagtggaacgtgaggtttgttcgacatggcagggggctgcacccaagatgaagtggtctgaacagaagatcgagttctcagatgaggaccaccgcaaggctgctattatatcaggacgatatccgatcgtggtcgaacccactattcggaatatcaaggtagcactagtcctcgtcgatggcggcagctccatcaatctcctcttcgccagcaccttggacgcaatgggaattccgcgaagcgagttgacacctaccgatcaacccttccacggaatcactcctcagtcctcgtccaagccattgggcaagatcacgcttcctgtgaccttcggccaagcaagcaacttccgaacaaagcagataacttttcatgttgctgagtttgacacagcatacaacgccatcatcggaagaactgcactcgtgaagttcatggccgcatctcactacgcgtatgaggtactcaagatgcccgggccaaagggaacaatcactattcaagggaacgcaaagctggcggtccaatgcgacaagcagagcctcgacatggtcgagcacatgcccagcccacccgccacaaccgagccacccaagaaagtgatcaaaacgactaagacgccgaaaccagacggcgcaatcaaaatcgttccactctccagtgccaaccccgacaagacagtcaagatcggggcatcactgaacgagaaataggaactcgcgctcatcaccttcctccgcgacaatgcggacgtattcgcttggcagccgtccgaca

SEQ ID NO: 42150 - DNA, 1501 bp, Oryza sativa
cttcaacgaggccgccgtctggtggtccacgagcggcccgatggcgtcagtcaggaggagagcctgcacaacatgaagtcatgatgcgatctaagaattgaaaggtaaaggaccatcgactacactcacgttgatcgcggcttcacgctcagccgcctccctctcacaaagaggggtggggacgttgctcgccgtcgtgggactgctaatcatcacctgggcaacacggtgctccacggttgtgctgctcagacctgcagatcgagaaccaagtttcgacaagtcaggaggaatgcgcataaaagcagagaaacccaaaatacaagaaaaataccccgaggagaaacccgggtcgtgtcctccagtccaaagtagtcaaaggctagatgggctcgagccttgagcggctggatccgtctaccaatgaagtcggctgcgacttcataccccgacagccctcgtattcagaggtcatcaatgatatcaatgaaagattggagggatggggtcaaggtgggtttggcggtccaagacggaatcttgtctggttgctcctcaggaacaatgaagactggatcctaatcttctatatgaagatagaaccacctcccccgccatttaatacgagatgaggggcactggagagggatgtatcacgacttcaggccatcccgaagtcggaaaccgacgcacccggatacctttttaggttccatccagcgcaactcgtagtaaaagcggaacaggtcaagaaacggctctaccccaatgtaggcctcacagagatgagaaaaaatgctaaggaaggctatggagttggggttcagatgaagcagagaaagaccgtagaagttcaagacaagaaggaaaaactcggaaggcggaggaagaaaaccacagagaatgtagtcctcaaccgcaaccatgcggcccaggatgggttcaggttcagtacctcccggttccctctccatggtcccgtgaccggggagagcgccctcctcctgcaatttctccaaggacgcattgctggaggtggacttgtcgaggtccattccctgagaagaagctgaggcgggcgaacatagggtttgtgtggaagcggagaaggcgaagagcgtttggaggcaagatagttctcacaacagccggacaccaaattggattcccaaaactcccataaataggcgtactaccgacggtgtgaattccaaggaaaggagagaaatggccgccggaaatttctaggtccgttgcacgacgcggtttcttggacttcaatttaaattcactcataaccgttcgacttcgcatggtgttgtcgatcactctttgtctctacggtcctcacaccgagatcgaccaatcgagaacgacaacaactccgacattagaagtcacgattggttacacgagttcatttaagttgatgtcgggggctcctgtcagggttatggataaggtataccctctacccttggatgtatgctatacggcaata

SEQ ID NO: 42151 - DNA, 912 bp, Oryza sativa
tcctcgcaggctgccgctacacaaagagaatatgggcgaccctagcggaatggacggggaccccaatatccaccccaaccattggtggcaggtttcgtcggtgttagaatgggggatcaaaccacaagtgtaaaagaggcacccaaaaaggctctacgctccctaacgttcctagtcgtctgggagatctggaatgaaagaaatcgcagaacattccagcataaggagctcccaccgagtggtcttctgacaaaaatcaaggacgaggccaagatataggccttagcaggcgcgcatcatctgagaaattggcttgttccttagttgactagggcgaaaggtcctgagtttttttctttccctttacactgtacagttttctccttctatattcaatgaaattggcggctcaccgattcgttcaaaaaaaatgcgctgaaaactatgggaggtctgggattttgaacattggtttttaagggtattagatttttttctattttcttttaattttttctaagttgttgtcggtgacatgggaccgggagtatcatgactagaggcttgaggcaaacacaatcgcccacgtagcctggcaccctcggggggcgtcgggcccaagggtgatgtgttcgccctcctctgtctccccgagggggttggaccgctcccgcctcggccccgagggccgaggcgccccgaccccttgtgggttttgcgccgcgcgtatgggttaggtgagcacagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatccgtca

SEQ ID NO: 42152 - DNA, 1501 bp, Oryza sativa
ggcaccattgtttatattgagtataaacccaattcagatgagcatgagtctttttcaattagttaggtataaatattagcaactttatacactagttaaaagcaagtttgaactgaatttgaacttgtttttgttagattttgattctaggtatatagcacccacacacaaaattagttgggtaggtaatcatggggtgtgaaataaagaaaaaacagagttgatttgtaaataggtataggcaatatctatatatatatatataggtatatactccacatatatatatatataaatatataagtatatatgtggatatatatatatatgagatatagacaccaatgtatacatatatagagatatatatatatatatatatatatatatatatatatatatatatatatatatatatatatatatatatatatatatatatatatacttcctctgtttcacaatataagtcattatagcattttccacattcatattgatgttaatagattcattaacatcaatatgaatgtgggaaatgctagaatgacttacattgtgaaacagagggagtaagtggctattactgtattagcgtgacggagcgtggggctcctcaccgggagaccgcgcaggcccccctttgccggttcggccgggggccctgggtgaggttctaagctcttggttttaggaaggttttcgagagtggaagaagcacacaagacacgggcgatgtatacaggttcgggccgctgagaagcgtaataccctactcctgtgtttttgtggatctgtgtatgaagaagctacaaagtgcgagccagcccccgatcgttctcagatcgttcggtcccctctttttctcctccccttctctaagtgggcaaggtcctccttttatatcttaaggggataccacatgcaccatctctctcttttgtgtggggacttatcctatcttttcataaatggacggagatttgtatggttgtcgtctgaatgaccttctgatgggacggcccatacctacctccacttccgccggaagcaggcgcgacgtgggaacatggctgtctgctgacgacatgaccagtgtcagacggtcacagacggtcacctttgtccacgcgtgtcagtttatcaatctgcatgttcgcccttcttcatacaatatcttgcctgtaatggttaggatgaagcctggaatatatctgaccggaaccaacgtgccatctccaggagctaacacgccggctccggctagggacgagtgcttggaggctctcgtcctgacggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccccgctgtgctcacctaacccatacgcgcggcgcaaaacccacaagg

SEQ ID NO: 42153 - DNA, 1501 bp, Oryza sativa
cgtgttgaaatcaagaaaggcattgtacaacatatttcgaaatatgttcgccatgtttgtataatgttctacgatgaagtattccccgagcagattttggagctggcaaacttgcgcacactaatcatgtgctattccataaaggagatgagtaaaaacgactttgagcgtgtgctgatgaggctaaggaaattgcgggtggtgtacttggacttgcaagatatgaggacggtcccagcatgtattggtgaactaaaacatcttcgttatcttggtatttcgccatcccttaattacaacgacatcactttgccagccgaatttgccaagctttaccatctccacgagttttcggtcacacctttcgttaatttgcagttttcctccccggcgaaaatggggaaccttgtcaatttgcggtatatgcacacgtggaaaggcttggacattcccaacatagggagactgaaatcgctccgaaatctgtttcgcttcactgtgaggaaagagaagggatatgagatacaccagctggaatacctgaacaaccttcgtggcaggatgttcattgactgtcttgataatataagaagcaaagaggaggctgttcgagccaggctagctgacaagaggcatataactgatctgacgctaagttggggtggtgacgaacgctccgcatcaagaactgcacctgtaacggagatgagcagcggtccagagcttcaaatgcaagctgaggtccttgaggagctccatccaccagcctggattacatccctttgcatcagggaatataatggtacgacatacccaagttggttgtcagtaaaaggggtcgtgcagcagggagaattcccggccgcattgcaaatccttatgttctggagttgtaaaggctcgaataacccacccatgattggtgagcgtttcggtcttctgcatcacctctcaatcacagattgtagctggaactctttgcctgccaacttggattgcctgacaaagcttgatatcctgaccatccaagagtgtccaaatatacagtcactgccgacgcttccccaatccctcgtgaacattgtagtttttcaatgtaaccgctttctcacagagagctgtcggatacgtgggcatccaaattggcaaaagatcaggcatataccgtaccaaagcatacattaattttgggctgtctttgagaatacaaatgttcacgcatgtgtaaggaatataggctgtgtttagttccacgctaaaattggaagtttgaagaaattggaacgatgtgacggaaaagtttaaagtttgaagaaaaaaattggaatctaaacagggccgtagagtcctttacattcgcttcggaagagccttcctttggaagggagatgacccctaaaagttcagtgttggaaccagcttggttaattggcaaggtgtttgcaagctgaaaactggttccgaaggtctaggaatcctaaaccttgagaagtttgcaaga

SEQ ID NO: 42154 - DNA, 1501 bp, Oryza sativa
tttctttctaatcaatctggatcgatcaaaggatggagagagcatgatgaaaaaaatgcgtacgtgcacgaccaaatcagattgcgatgacgacatcaactggctgcactacctccaggacgccgtcggcgcttgcatcaagctttgcaccagcaaatctgccgcgctgttcccaatttctcgcccaccaccggattctacggatcccaactgtagcagcaaatctgccgcgctgctaccaatttctcgctcaccactggatactccggctccggatcccaactgtagcagcagcaaatctgcatctgccgcgccgctaccaatttctcggcctccaccggatactacggatccgttccctctagaaggagtagacattgtaccctcgctgcaacgggtccgttccttctaccagcttgcatgtttttaccggaactggtcctacgaagtgatgggcatcacaaactacaaggtacgttctgtcagtctcccacaagccacatactctactacctcaattctaaaaagggtgtagttttggaacgcttatatccaacgttttatcgtcgtcttatttgataaatttttataattaatatttttattgttattagatgataaaacatgaatggtacttatgtatgactaactttttttaaaaaaaaattcataatttttttaaataaaatggacggtcaaacgttacacacagaaatctaaaactatacataaattgaggcaaaggtagtactatatggtgtcctcccgtttcttccatatcatgtcgtcaagaagaagaagaagaagaagaataataataataataataataataataataataataataataataataataataataataataataataaagaatttaacaagttaaatcaatatgtaatattgtatcacttcagaaatatatagattcaaatttattgtataattattaattatgaaaataataaatatgattgttaattgggcacatgttctactttaattttaatattttcagtgcttttcctgctgtacttccattgttttatgttcctataaaattgaaaagatatgccatgaacttcatgtgtttacgtttctttgtttttttttcttatctgcattctgctttctatcagcctcatcttttcgcttatacttatgcttatcagtcaaaatttaaattttcaaccttaaatttggagttgatttgggggtttttcatcgaagtttacttttcagcatttacttttaaatcgctaagaacacatatataaaagttttatctacaaattacttttcgtttacaaatatgacgtaccatgggacctatgtttcttcttatgttgcattgtaaaggagaactaagagtctttgaaggaaagtaaacccaaaatatcaagaaatgcggatcatatattttcaacaatcagcttgtgtaatcatttgaggctttgtttcttgcaggggagtgattctttcctgactattt

SEQ ID NO: 42155 - DNA, 371 bp, Oryza sativa
cgactgcatcagccccagggtgtagctcaccatggggatggaagcagcgtacgccacccagatgctcaccctgacggcattgcggctcgactgccgccggtaggagccgaggatgaggagcacaaacagcgctgcaacgcccagcagcaccaggacttcgatccggaccaatctcgccattgggctgttgagcccggaaaccatatcgaccacggcgacgaatcccatgattattttagctagctgttgatggtgtggttatcgcagtggcacgacaagtatcacggacctcatgtggatatatatatcattatcatctgctctagcttttgcatgaactgcatcgatcgatcacgtaccagtccttcagt

SEQ ID NO: 42156 - DNA, 1257 bp, Oryza sativa
tgcgatttctttcattccagatctcccagacgactaggaacgttagggagcgtagagcctttttgggtgcctcttttacacttgtggtttgatcccaccattctaacaccgacgaaacctgccaccaatggttggggtggatattgttgcacgccgtccattccgctagggtcgcccatattctctttgtgtagcggcagcctgcgaggaggtgtagagccgtctcctggacccgacgacataagggacatatggatccatttggccatccgcgggtagatagtctatcagaggtccagactctattctgaatgaccagccaggcgaaggttttgcatttgcgaagagcccagggcttccaaattaggttgttggccgttgttccaagtagttgtgcattataggccgatgttgccgtatattgaccgtggctagtgagcttccaagatatttggtcgtcctcatgttctgtcagctctattgtctggatggcggtccaaaccgtgacaagttggtcaatcagctctgttgtccagcccacgtccgctggaaatcccagatcgagcagccattgatctgattgcaaggcatgttggagggtactattctttttcttggagaccgcgtagactagcggtgccacatctttcatccttctctcctgccaccaggctgactcccaaaaactcacagtcgccccatttccgattgttatggatgtcgctgctgcgaaaaggagcttatcggtgtcatcgcacggcgtaccagaacccacccatgctttctccggtgacttccattcctgccaaagccatcggaggcgcaaagctcttgcaaacttctcaaggtttaggattcctagaccttcggaaccagttttcagcttgcaaacaccttgccaattaaccaagctggttccaacactgaacttttaggggtcatctcccttccaaaggaaggctcttccgaagcgaatgtaaaggactctacggccctgtttagattccaatttttttcttcaaactttaaacttttccgtcacatcgttccaatttcttcaaacttccaattttagcgtggaactaaacacagcctatattccttacacatgcgtgaacatttgtattctcaaagacagcccaaaattaatgtatgctttggtacggtatatgcctgatcttttgccaatttggatgcccacgtatccgacagctctctgtgagaaagcggttacattgaaaaactacaatgttcacg

SEQ ID NO: 42157 - DNA, 667 bp, Oryza sativa
attgcagcccttgccgcggtagccgtcgccgtcccagccttgccatattaaccgtcgtcgagccattcgctgccagatctagcgccggtcgccagccccctttgctgctatcgccgctggtggcctcatctccttcggacagatctaggagagggaggggagaggagtaggaaagccagcaccgttgctccctctgttgccgctgcggccatcgtccttgatccccgccagccaaatccgggagagagatgggaggcggcttcatcgctgtcgctccatccatcgatgctccccttcctccacctctccatccctcccctttgccgctgttggtatttcttaacgacattactagaaatataattcccagcaatggcacaaaaatattactggtatattacgattacagatatggtctgcaagcgcacggatatactattatagcatttcacccagaagactatactaataatttatatgttacttgtataaatcagagtgtaagcaggggttaattaattcaagggtagagtgacacgaagaagaagaactaagttactctcattaaataaatccttggctaagtggagaaagaataagaaaagaattcatcctaatacttctagtatacaagtatctttaatttaagctctatagtatacaatca

SEQ ID NO: 42158 - DNA, 958 bp, Oryza sativa
cataaatttaatcgaagttgactggcaggctaaaggcccagcaatgtctccaatattcttctctcgaggcgtcagatatttcattatgtttgtttgatgacttgaattattcacttcatctctcaaatataatggaaggtccggagaggctacggcatttaattgtaagaaatataacggtgtgagcgaataataattgtttgggtacctaaaagttgcttttttgagatttattatgataaattaaaaatattatctcaactacttaaaaataaggagtaaaggggagataagacgaggtgaggagaggggtggtgggacagttggcagaaaggcattgtgtatatttctaatgatagaaaggcattgcatatatttctaacggcatatcattgtcatttagatttagaaatagagactgcctatctaacatttgatagaaaatcagcctaaaattctggcaaatgtaattatcgtataatagcagtgtaattacattcgtaattcgtatgtaactccagtacaagaaagatgtaattattattgtaaaatagaaaaatttacaaagcttggtagtgaacacatgctctagcgttttgcacgtcgatcgccggttcgatccttggtatccatgcgccatttgattttttctctcttccacgcatgcatcttaaagcatatctaatggtggaaaatttgcatgtttttccccatgattttctttcaaaagataaatatcagttccataaaagtttgagaatttttaatgatcgtctttaatttagtggtcttggggccaacgtgtaatatttgtcttttactctgaaatatagttcaatgcgcctgaaatcgtttgagtaaagaaatacattagaatggttcaaatcgatcacaaattggttatatacaatttaaaagccataatcacttaaaatactgtttatttatttttaaaagg

SEQ ID NO: 42159 - DNA, 357 bp, Oryza sativa
catggatggtaatgcaggatataatcaaatttttatggctgaagaagacatccattagactgcttttcaggtgtcctggtgccatcggcctgtatgagtgggttgttgttgatggctattaaataccaaattcacacagtcaatacctgcataaatctgaaagtataaaacatccaacatagtggtagggtttatttctaacaataaattctcaaccatcaaagttgagaagaaatatacataaaggagaggaagaattacattcatatccaagcctatggagtcttgggcccataagtccaacgaaatacatgtgggcccaatcactatgccactagattaagggccttcctgcca

SEQ ID NO: 42160 - DNA, 1501 bp, Oryza sativa
tagtttgtgttgaaaatactagtatggccctgtttagttcccagaacaaaaattttcacgtggtcacactgaacgtttggacacatgcatagagtattaaatgtaggaaaaaaaaatccaattacacatattacgtgtaaattgtgagacgaatcttttaagccaaattgcttcatgatttgacaatgtggtgctatagtaaacatttgctaatgatggattaattaggattaataaatcgtctcgcagtttcctagtagaatctgtaatttgttttattattagactacgtttaatacttcaaatgggtgtccgtatatccaatgtgataaccaaacctaaaaatttccccaactaaacaaggcctatgtttttctacaaatttagtcgaacttaaaaaaaatttactagtacttgtaatatgaaacggatggagtatctatttttttagattggttggattttatctcttctttatatttatccttagtatttagaataaaaacccgtaataatggcgatgagtcttaaacgatcaaagttccaagaagatcatctgtactaaatcattagccacgagaaaatttgttttcctcagctaggaggtcataggttcaagtcctagttcttcatatattttttttcttttggaattactaaataatgaatttttcaggtttcattgtggtcatcgtcgtacttctcgctgcagttactcttgtttgctgcgctggctggaaggccgccgcccagtggtgggaggcagggaagagggctcgcacggtacaccccgtcgacgtcgccaccgccgctgccgccgtcgtgccgactgcctaaagaagtactacatgttactgcatgtacagtatatatagtgtgttgctgtcatagtgtgcctcatcctatgtgttaatagtgtggtattgcaataagaaaatgtactacatgttactgcagtgcgtatgattatgtatgcttttttcttgaacaaattatgtatgtgttggtgcccgtaaaactgcatgttactgcagaagtaaacggatgtctaggcagtcccacttgccgtgcctttcaatcaacttgctaagattctggtatgtctttttcgggtgtgtttagttcatgctaaaattggaaaagtgaaaaaccaacggtaatatttgcttaaatttatatagtgttatattttatatttaaataatagaaaattatatctaaagatcatcgtttttttaatggtattacgtatgtatatttttttttggctttgttgttttttatatttcttcaatggtactaagtacttgcgttgtttttggctctattttttttaagcaagtctgtgcgtaggtcttttttcttctatcaacattatgtaagcttgattgttttttagtcgtacgtacttatttacggagtacttatgttttccgttctttttccgcccaacagtatggtattcgtttcctttaaataaaatacatctaatctaatctaa

SEQ ID NO: 42161 - DNA, 471 bp, Oryza sativa
catccatatggatgtgggaaatgctagaatgacttacattatgaaacggagggagtaacataactccaccaaaagagagcggaagaggtaaacttattactaacagccttaatcatttgagcatcagaaaaatcatactcatcaaattcattatctactgctagctcccaatcaatatatgcaacagaatcatacttctcatcgtagaatggtaacttagattcaactcgtgcaaaattataggcaggtacctcatatgcattgcgtggagaagtcgtcatatctcatcgaaggtgaagaagtcaatgttctcgtattcccttgtgcgatcttgtcatggttagtagcaaacaagaaagacatacaagaatgtgcacgctcctatcaactactaggtagtggcagcccaaatatcacacacactcaagcttttcaccgagctctgacaagttcttaccaatgcaagaagaa

SEQ ID NO: 42162 - DNA, 1501 bp, Oryza sativa
agcctaagtatcccgcatgatctccgaccaccacggacgtcgccttatccccaagccgactcccggtccatctccgcaaatactctcccgagacatcgagtcacctacacatggaacaaacaaagaaaccatattccgagactaagctatctccaacttgactcattagtagcaaacaacaatattacatacgtatagtatccatctagaagtcataatcatgaaataatcacggatatgcaaacaaacaacccgaaaccgaaaccaacacagtatcggacggtcagaccgtgggctagccggtctgaccgcgcgcattccgctggtccgaccggctaccagatctcggtctgaccggtcacatgaaataacaaatcctgcgatcacctgtgaaatccaatcatctccaaaaccacttcgtgaataaattccaaataacaaaaccaataatctccgatgcccaattgttcatcacagaataatcatcaaaaacacatttgattttacaattaaggctagaaatctatctatctattactccctcaatctacatatagtttttttagattattcctaaatgatctacatatttgtgtttattcattaagtctattcgttatttgtgcattggagtaaatggacattaatgtatgcatccatgcacacaaatatttataacccacatgcgatatcttgatttgctattggctaggaaatagtgggtatggtgcatgcatcgactttgttgctagagtaaatatagtatgagagttattagtttttcttagtcttggtgtacctatgaaatatgtatatcaatttggaatggagggagtatatactaaaagtccattaaacttcctacaaacgctctcaagcctggcacttctacaaatgctcctagaccgccacataccaatgtctaatctcaccgtcgattttcacttaaatcggtggatccaaataatttagactattagattagattagatgtattttatttaaaggaaacgaataccatactgttgggcggaaaaagaacggaaaacataagtactccgtaaataagtacgtacgactaaaaaacaatcaagcttacataatgttgatagaagaaaaaagacctacgcacagacttgcttaaaaaaaatagagccaaaaacaacgcaagtacttagtaccattgaagaaatataaaaaacaacaaagccaaaaaaaaatatacatacgtaataccattaaaaaaacgatgatctttagatataattttctattatttaaatataaaatataacactatataaatttaagcaaatattaccgttggtttttcacttttccaattttagcatgaactaaacacacccgaaaaagacataccagaatcttagcaagttgattgaaaggcacggcaagtgggactgcctagacatccgtttacttctgcagtaacatgcagttttacgggcaccaacacatacataatttgttcaagaaaaaa

SEQ ID NO: 42163 - DNA, 1501 bp, Oryza sativa
agtaagtatcatcatttgggcatatatgctgcgggacagtagaggtgggccgctgatggtgacagctcagtacgggtattcctccatgttagtatatattcctaagacaaattcctggggagggtactcctccgtatttaaccccggttggacggccatgacaggttgtcgtcgtaagaaactcggtaactcggggtggtctctcaaagcaccaggatggcactgttaggtggtattggccacatgattgtatactagcaagtgtagagtaaagtttagtgtatattagaagtataggaaatgagttctctctatcttttcttccacttagttaggattatttatctgaggaaatctactaaatgctgagctttccaatgtggaaacaaaagatggttgtggcggcaacaatggcattgcataatttcattcatgaccatgacacgcctaataggcatttccataggtttgagaggaatccagattatgtgccaaccattccatctatattttggagatatgtgatttctcaagatgcatcgaatacatccactgaggggtcaaagtgataatccatggatgcatttcgagatgacctagccggtcgtattgtaggttgacggaaatatatcatattttgtgtagttttgtagtattttgctctatctttcgatgatactatttatttttactaaacatttatattgctaaatatatgtcatgcaacaacttgaacttatacttttttttagtaccaatttttgaattatgtttatcaccttatatacttaacatgttgaaattattaaggaaaaataataataatcacagtgctgaaattattaaggaaagtatctattattaatcctacataaagttaacagtgaaaaaaacagaagggtagtattgtctcttgcaggatttctagagctgagtaagttagccaaatactttcagagcacctacatcttttagaggagctggcttccattggagttagagtttggagttgagagatagaagctggagctataccaaacggtgccttactgcgacagtgttatagcccttgcccgaagcggtcgtgaccgaacaatactgtttggcccgattttggcccacctatgtaattgacgacgatcgaatggcaacaaccaatggcaggatatatgtgtctttgattggctagattggtgtaatcgatgacgatcgaacggcaacaactaaaggcaagatatatgcgtctttgattggctagattggaaagtaatgctcttattagtttccttaattgacgaaaattagacacggtgcaggtcagttttgccgcaaagaagcagcagcggcagcagatgccgaggttaatgtcggcctaattgcaaagccaaaatttatcgtccccagtggagtcgtcaattcatgttagtgtctttttaccctaacacgaggctcatctaaatatttgcggtgttaatggagtcaccaatcacctcgatctaga

SEQ ID NO: 42164 - DNA, 1501 bp, Oryza sativa
atgttagtttgagcaagtaactttactcgaatgctttttccttgggacagatcctttagggtgaatacatatatattcccatacctaaaactactttttgggtggaaacttcattcgagtcaataaataactcgaacacattttccttcttgacatatgttttcggccgggcatgggggatggtgtttaccacctgctacaacaagcccctcacgggtaagggcgaagtgttttcggccgaaaccgtgctagatcaaaaatgcaggggagtaaccgccgtccccctgttcggtcgaaaacatcattgagatagctgcggtggaactccgcatggcggggaatttgcatatttccatatcgctcggcactacacaaagcagaattctcagtttgaatgcatcaacttcatcgtcgcaattactttttagttttcgagctcgaatttgggtaaatgctttagagctttttttatgtcgtgttttcgagctaaggcaaaaattgctcgaaaaccgccgtccccctaacgtttcaaaggagtgacgaggtcgaacgtgtttccctcgtcgcaattactttttagttttctagctcgaatttgggtaaatactttcaagctttttttatgtcgtgttttcgagccaaggcaaacttgttcgaaaaacgccgtcccccttacgtttcaaaagaagtgacgaagtcaacgtgtttccctcgtcacaattactttttagttttcgagctcgaatttgggtaaatgctttcgagcttccttttatgtcgtgttttgtcacgcccggaaattcactaataatttccaaactaatttgtgcataaaatcctcgtccagaaatcagccgaggtacacaaactgacaatttaatatacaaatccatcataataataacgttacatacttacaaaagaaaagaaaaacagcagcggaattaacggtctagcgatggcttcagctccactcccacaggcaactcaactggggtataagccaaacgtcttctccttctggatcccttttcttcaactgaggttgattgattattgcaagaatgagcatatgatatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacaacacacccatgctgcacaggcccaaccatcctgaacaaccatacccggctgtacagatctaactccaaaccaggagctaaacaaattattaccagttatagcatcaataattattgtgagaggcgtgagactaatcacgaaaaacattgctcaactcgcccataaccgcgggcacgactattcgaatagttttactctagccagaggtgtaccactgtacctacaagacacagcctcaacatcatgtctaccatgcgtcgcgatactggaa

SEQ ID NO: 42165 - DNA, 1501 bp, Oryza sativa
actttaaaatttgtgatgtggacttgggatcttacttcgatttgggatatgcataccacgcatattcgggagaaaataaaaaaggatatacataccacctagatttgggagaaaataaaaaaggaaaaaaaacctggctatcctctttagttccggttggtaacaaccgggactaaagatactctatctttagtcgcggttggtattaccaaccgggactaaagattcatctttagtccccgttatttcaaccgggactaaagatgcacatctttagtcccggattgctactcccggttagaaacccgggactaaagggggttcccaactggaagtaaaaagggtttttattatgaaaccgatctcccgaaggagtcggatttgtagcgaccatgaggtagtcgccgtgatcgtgaggatcacggtaccgcctcctccttctattcttcagtttttttaaggatgaagtaaccttataccaaatatgcatgtatgtatccttatatgactatcttattatggatataaacacagtagaggggttgagagaaaaagaaagacttttaagagagagaaggcagcagtgtacggtttatagcccctccactttcacgttcccttgtgtaatgtgttcgtgcgtgtttatgttcgtttgttgacaacgtgaaatctaacacgcaggaggggctccgcgaccactttttcaatcgaacgctacacgtagtccattgatcaattgtcacatcacatcgaccggttggcgtaacagtttagatcttggaaatcagctggggaggtgtcggttgtgtccttgcaagatttaattatctctgttcagaaaagattgctatggtccaatctaaaaaaattccatatatattaactgccatctttaattggagtaatacttgataagattatttggatgcgctgccatatattattatattcgatattatttgctgatgacttgttcggtgtactaatgcttatgagtgcacacaactcttcctgtccttcatgcatgtgtgacaactagtaagctgattcgacggttacacaatgcttccttccttttcctaattggtttctatagtctccgtacgtgcttcattgcttttcctaattggtttattatacgcacattgtgaatttgcatggtgagaataatatagatctcttatccgtagacgttgtctagcagcctgcctaaggttttggcattaattaatagtacatggaagacggcatgttatactcgtaaagaaagttgtttaggacaatgtttaagttaaaccttggaaatataaatcatgaataactctcgagttgttgagtttgaaaatgtaaaagttatatgaatagatttgtcttgaaaaatattttcataaaagtatacatatatcacttttcaatgaatacttttatagaaatacgaagtcaagttgtgttttggagaccgtatcgatgtcctaaacaactttatttatgagtatggagg

SEQ ID NO: 42166 - DNA, 1501 bp, Oryza sativa
agaagagatagattataccctaaaccctagccctcctagttgtttatcgttctcttgttattttatggcttttattgaatttggttcttcctcttctttagtagaatctattatattttggatgacaacctgtgatatttcgaggatcggataatcaggttgcttatctcggatttatttgcgttggagcaaggcaagttattattccccccctttgagcataattgttgtcgtgacctaagggcatggacaaagttgggagatagaagggaaaatgtaatttcccgtctatcctaagagtgagctcaaaagacaaataccaaagtgaatgaatgtgctttttctatattcatctcctcccgtgcttacaggatcttggttggcttaaatagtgctcaaccgcatgtccaagatttacaagtttgtcattacaggcttacatgaagttaccattttacccctataaagtttatgacctataggggcattttggtacattctggtggtccctaaatgacatctggtgctagctggtgagagtggttgaggtggtccccatggtactttcccaaattagaccatttgctcaatggcacttttcctcaacttcatatgctcgagtgagatcacccgtgctaaggctcgaacacattctcccacctttcaggctccttgtcaccttaacctgcctgaaacacagcttcattaattagtgatgttagtttgagcaagtaactttactcgaatgctttttccttgggacagatcctttagggtgaatacatatatattcccatacctaaaactactttttgggtggaaacttcattcgagtcaataaataactcgaacacattttccttcttgacatatgttttcggccgggcatgggggatggtgtttaccacctgctacaacaagcccctcacgggtaagggcgaagtgttttcggccgaaaccgtgctagatcaaaaatgcaggggagtaaccgccgtccccctgttcggtcgaaaacatcattgagatagctgcggtggaactccgcatggcggggaatttgcatatttccatatcgctcggcactacacaaagcagaattctcagtttgaatgcatcaacttcatcgtcgcaattactttttagttttcgagctcgaatttgggtaaatgctttagagctttttttatgtcgtgttttcgagctaaggcaaaaattgctcgaaaaccgccgtccccctaacgtttcaaaggagtgacgaggtcgaacgtgtttccctcgtcgcaattactttttagttttctagctcgaatttgggtaaatactttcaagctttttttatgtcgtgttttcgagccaaggcaaacttgttcgaaaaacgccgtcccccttacgtttcaaaagaagtgacgaagtcaacgtgtttccctcgtcacaattactttttagttttcgagctcgaatttgggtaaatgctttcgagcttccttttatgtcgtgtttt

SEQ ID NO: 42167 - DNA, 1501 bp, Oryza sativa
gaagatcgtggattaattttttacatggctttggtagcaggcggggcggggtgcgcgctgacctgcaaaagaagtattttggccgttaggaaaaaacgtgtttcgtagtagtgatatgatcaattctactgattcagatagaaacttgttttgtacgtgattgtaatgatttactagtagcatttcttgataactttcccggaccaggggaaaaaatatagagatttttagcagacatttatttgtactagtatcatacggtacgagaaatatatgtacaaattaaaacacaacggtacgtacctataatatgaacaaacgatggccctttgattaattaactccattatttcacgtgtgatcgatcatagctagctaacatgtacgcatgcatgcaaagctataaattaatgtatagccgccgtggaatgattagaaaagaaacgaagctttacttggcctttgcaagacatgacagtgacgttttctgcctcttgcatattgtcctgtccaagcaaagctaaacctatagctgtgagattgggccaaaaggtattatccataaatactatgcatgatgtaataagttttatcttaaacatatatattatcatgttcactcccaaaaacatattagtaaatgcatgtggttgtgatatgttcgttgcaaagaattggactgctccttgtctagaggagataagataaacaacacgtaccactagctatagattaacatatatccatatattattagtttcttaaaattaaagaaaagcaaattaaggaaaaaaccagtaggtacactacccaacacacgaataatacatgtcgtattatttgcaagtatctgcacaagtagtcatctggtcatagtcaggtctcagtctagaggagaccaagtttgacaactctgtagactagcattattgccaagccatttggattacatatacttatccttcacatattctaccatgtcaaccgataacgatgcacaaaaatacgaacagcaacttgatgcgtaacaataaataagtaaaaacgatgagagtaaatgtaatactccctccgtttcgaaatgtttgacgccattaactttttagtacatgtttgaccgttcgtcttattcaaaaaatttaagtaattattaattctttttctatcatttgattcattgttaaatatatttttatgtaggcatataattttacatatttcacaaaagtttttgaataagacgaatggtcaaacatatgctaaaaagttaacggtgtcaaacatttcgaataggagggagtaattagtttggctagctagctgccccagctgcctagctaaatgatcaaataatggatcggcaacacacagtacacttgggcagctataaatcaggagaggcgctgtgtgttagctcgtggaacacacacgacacgaccgtataggagtagtcgtgtagcagctagctagctagcaatggcggcttcttcttcttcttctt

SEQ ID NO: 42168 - DNA, 1501 bp, Oryza sativa
ttttgccttagctcgaaaacacgacataaaaaaaagcttgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaagaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacactttcgacctcgtcactcctttgaaacgtaagggggacggcggttttcgaacaaggttttgccttagctcgaaaacatgtcacatcctgaatttcgttttaggatttttaaagtatttaataaattattattagaatttatattaaatgttcattaattttcaagtgaagttaaatgtgggaaataaaatttcctaaatataaaggatggatggatttaatttttattaaattcttcatggttaattatactctttggaattatctcggattttttcggagctcaattcctaattttaatcatacaaagaacatttcagtaattacccacatatttaattaataattaaatggtctaattataattttttatttactttgagtgtccaagtattttcaggatttttcttgaaattatttgagcattggaagtatttttaacaattcaaagatcatttaagtgattattttaattggaaaagtaataaaattctcctctcccttgtcttaggctgaatcggcccattcctttccttcctctctcttccgccggcccaacccgagcctgcatcctctcttcttctctcagccaaagtccggttttactccctcttctaatcaggctgagaaaaga

SEQ ID NO: 42169 - DNA, 1501 bp, Oryza sativa
aggagcctctgctcggcgctcggccacatgacgtgctcgctcggcagctacctcagctccgtcgtcgtcaccgtcgtgtcccatgccaccgcgaggggcggctcgccggggtggatcgccgacgacatcgacgacggccacctcgaccgcttcttctggctcgtcgccggcctcagctcgatcaacctcgtcgtgttcatctgctgcgcaaagcgatacaagtacaaggattcaatcaattaattgagaattgctgatcgaattgtgaatctgtaaattgtaatcagctcatgtgttctttagtttctgtacacgggaaaatttatgttttctcattgttatttttggaatagaaatcaagagctctgtgaattcactgggagtaaagaattacagctcaaatggcgaccacgttgactgtagcaaaaccggcaaaattgcaagacagataacatgtaaataaagaaaagaaactaaaccaacgtgcatccgaatttcttatctcacatgactctcgatcaatcatttctctgtaatgcttttcgattaggatgccattaatttgaagagtaatagattcttccattatgtaaagatttgaagacaaaattgttagttcagtttggttctattgtaaacaagtgaaagagttgatctattgtttgctacttttatttttcagtacgagcgtgtacaagaaaacctgtacctttcagcaaaggagataaatttgagtttctgctcggtcatggatttgaatcaatcagtcattcgctgtagtgcttattgattaggatggcatttgggctgtgtacatccttttctgggtgtagaggccagtttaatccattatctaaaaaaaatcagtttgactctgaagaagctttatctgcatgaattaatgcatgattacatcattgcactggactcaattggtaatgcagagacaactcgtatgcagcaccaatgcactttaagcctcatctgaatcttttgataggccagatgaatttccccacattgcaaacatgccaccgttgccactacttaactgaacaagtgaacaatccacttatcttatcatgcttcagacatctgcaatacccaaatcaaacacgaaactgcgatcgatacgttaaaattccttctcagctggttggaacacccactaccactttggatttgatacaaaaagctggttagcactaggaagcaaggatgctaagtgcagctccattacactagttagtgacttcaccattgcagagcagaaaggagaaccaggctccagtagccattttcagaaagtggaatatctggatagaaaactagttagcagcatcagaccagtgcatgcgcagccgcccactatcatgccgacttcgcctatcggaaatagtataattcatcgatctatcgctttaaccgcctataagaacatggcaagaaaacatggactgtgcaaccagcacaagagcagggcagtaacttctgtgagaga

SEQ ID NO: 42170 - DNA, 1501 bp, Oryza sativa
caactgccccaagcattccgtccctgatgaattcatatttcacaacaaaccgaatttcaatatgcaacttattacatgaacctgcagatcgatgcaactggtataagacaggttgaaatgggaatagaagataaggaaaattggtgaaaaccatgtagcatctgtaagaattcagaacatggagaaactgaacaggcagcatggccggatccgtactaccaatttcaagaaactaagtgagctaaatggtatatttcaaaatgccattttttttattttaatagcacaagtatcatttttttttcatgtaaggtgttgtatgtttaccaagaacgaaagcacatgccctccagcaaccagtagagtgtttggatgcaggattccctttgacatcaacagatccatctcctgtgtgctggcttagtttaccctgcagcaactgaacaattgttacctacgtgccactctgtaaattcttcatgtctgttcatccctagctgtcactatatagtagcatccatatcagtaaatttatatatatatatatttcaagaatttttctacaacaaaataaaataaactgttggggcacaaacatatcttctttctttgttttttttttgacaggagagaaaagcactgaactcaacgtaaccatgaacacaactttgtgacagtttggacttgggatccattctccttggaaaaaaaaaggataagtagggccgtttttaattcatacaaaaattactatgccctaccattttttttaaaaaaagaggaaatgtggtagcttcaattgaagccaaataatgtggtaccagtttcttcaccgtagtattaatatttgacttcattattgatctaactttacctacccaaaatttgtcactaccaaaaatttctggtagggctttaaaaccaaaatggcccgtcataattacttcaacatattcctcattttttgatgtgtattattccttttcacgagcataggtaaatttgtagcataccaataatattctttttagagtatttattttttattacacggtgacatatagggaagaaaacggtcagaaaatagcctcaaccatttcaataactttttttctttctgtacaacatagtcaaaaacagtaaaaattagaaatgagaacggtatctagaatatcaaaaaaatcagaaacgaacgaggacagggataaatcccaaacctcactgaattactgttgggagcacagatatatgtgtataatatttatggacaccttgattgacacgtgactttgccgtcattctactatttctttacattttcttcctcaagaactgtaaaagctgaactcaaatactctgaattacaatttgaattgtgcaggtagatttattttttcgtaaacgtgggaaaagaaaggaattaaccacatttctttggcacaaagaaatttatgttaagtgaaaagtcatctgaatattttttggaaataaaataggaaaa

SEQ ID NO: 42171 - DNA, 249 bp, Oryza sativa
cagctgtaaactacaaaacttgcagtctgatcaccctcaactggctatgatgtgcaaaccatcatccttgtccaaaataatcgttgtttcaatgatgcgaaacataccctagctcttctattcacatgcttcaactaatgacttcctagtcaattattcctcatcttatttcatcaaagttatcagatccttttttcatcctcaaaatcaatgtcttcctcatcttattcctccatttatgccttcagt

SEQ ID NO: 42172 - DNA, 1501 bp, Oryza sativa
aacttttaacttttctatcacatcggtccaattttaaccaaacttttaattctggtgtaaactaaacacattacatttagcctagctataccagattaccagtacatgaaaataaacttaaaaaatacgctctcaatgtccaactaataatacgtgtagacgaaaaaaagagccacattccctcgaaagaaagaaagagaaaaagagccacatgtaaaacactccggaggggagattaggtgagcagtccaagtgtctgcgcgtcctgtcccagttagtcaaaaaggaggaagcagtaccgctgctttcagttcctaccacacacacccccatcctcaccgatctctctaaacccaaatacgcaacaaatactcaatcgtcacatcttaaaaaacaaagaaaaaggaagagagagagagagggaaaacaaaaaagaaaagaaaaatcaattcccaaccttgctgctacaaatgcctcaggcttagcaactcgacctcctccccccttctccccttcctcccttctttgacttcccctttcctcctccgtgcgcacgctctcctgattcatacagcatttcgtcggggatgacgtcgacggcgtactcccggccgtcgaagctgccgggcggcggcaacggcagcgaccgcaggctgccgccgcggctgatgaggggcctcaccaccaagatcgagcccaagaagctcggcgtcggcctcctcgccggctgctgcctcgcgctcctcacctacgtctcccttgccaagctcttcgcaatctactcccctgtgttcggtgcgtgctcccctaatcccgatccgccctaggagcttacttttggttaaatcccctcccgcgttgtctctcgaatccaatccattttgatttagtctaatgggagctgttttgaatccgttttcagccagcacagccaacacatccgctctgatgcagaactcgccgccatcctcgccggagacgggacccattccgccccaagaaactgcagctggcgccggaaacaatgacagcactgtggaccccgtcgatctccctgaggacaagtcgctggtggaggcgcagcctcaagaacccggcttcccctcggcggaatctcaggagcctggcttgccggcggcgctctcgaggaaggaggatgatgcggagagggcggcggcggcggcggcctcggagataaagcaatgtaaggaaatcttgcctctttcttccgctcccttttatttgcgcacctttactggaaggcagagcaagctacagtagagcaagtccccagttgttgttgagcgcaagcaagcaatcaatctcgtttggatttggtagagacgcacgagatctgggcggtgttttattggggatttgatggtaattcagtctcgttggtttggttaattcagccgagaagaagaacggcgtggcggcgggtggtgataccaagataaagtgcgacgagaacggcgtggacgagggcttcccgtacgcg

SEQ ID NO: 42173 - DNA, 1501 bp, Oryza sativa
agttacgctcattgagctgactgaaccaccatgcagttgtatgaaggtgtagattggcagatcaggacttcaggatgaacaagtatcttcctagtagttcttaaaacagttcagcaggggacagttgctttgccatttagagcacccatctgaaaacagaacggtgttcccacagcaccactgcaccagctcgtccaatgatccagtccatgtagcaacagaaaaattgttacaacttctaagtatccatgataggcataaaaccttaaagcttcagcttccctttatgccgcctgtgaagcttctgcttcttctaggcgcagcttctggtaatcgttagcatgcattatgtcctcatgattgattgcactctgagaaaagtagaaaaaaggtattcttttcagaaacaaaaattgacccaaattattcgtgttagagatcataatttattttcttacatgaatgccctgagcacaaaaaagactcttcaaaatgttggatacttcatccatgcctagaagagctcagctcagtctcagaggttgtcggcgcagccaaagctgcacatggctgatcttattgcttcatttggaatcccgatattgacatcttcagacaattggctgaaaatatttgatgtttcagttcaatcattattgtcatcgtcttgcagttcgaacaaatccttcacatctttggctttaaaaaaaatttcacctctgctaaatttttaagtttagtgagtagttgtgtcaactacccattttgttgtaccagaaccgacccaagcggctgtgggatgccaccactaggtttctagaactctttctcggccaatagtctgcgtatgcttttttgttgaatgcttcttgtgttgtatgcctttttgtttttgtttgataatgcttgtgcgagctacaatatggttatgaaatacattagatctattcacggggactactttctcatttgttttcctgtaaaatgctaattttgtagagaattactgttgaaaataaaactacatataagccaaaattcagtgaataaatgacaaagcattactatgctagcctagcagtaagggaatatcaaaacagcaatgtatctcctctccaaccctatcttaatgtttaagataattggctgaaaatattggatgtttcagtcaaacatttactgaaattattggatgatcagtctatatactatcacatctcctctcccatcatataataatgttttaagacattaagcttgtctctgcttaagacacggttttctgattattgtgtgcatggagtatgttgtatggaggagtgttacggagtaatcgaactattttgcaattggttgaattatcccatgagtagcaatgtcaacagggaaaaaaaatctaatctacaaatttcaaaaaagcaaagcgctaatgtctagcgctgcctccaaccgagagacccgactgtgtgcctctagggcatctttacttctttttttttta

SEQ ID NO: 42174 - DNA, 1501 bp, Oryza sativa
gtatgacaccatgtcatcgcaatcagggtttacaaataattcgtgatatcacagtttatatcaaatatttacttgtacctcagtaaatatcaccattgccctactcggcataagtttgcctcctgtgcaaggacttaaatatagaaccactatagagagaggtaccacctttgctagataacttaattggctaggtctacacccatccgagaattgctgtcgtactcgttcgttcttcacaggtacttggcagtgcttatgttgatcgacataaaaaaaaagctcgaaagcatttacccaaattcgagctcgaaaactaaaaattaattgcgacgaggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactccattgaaacgtaagggggacggcggttttcgaacaaggttttgccttagctcgaaaacatgacataaaaaaaagctcgaaagcatttacccaaattcgagctcgaaaactaaaaagtaattgcaacgagggaaacacgttcggggtaccgagctcgtcactcctttgaaaagtaagggggacggtggttttcgagcaattttttgccttagctcgaaaacaggacataaaaaaaagctcgaaagcatttacccaaattcgagctcgaaaactaaaaagtaattgcgacgagggaaacactttcgacctcgtcactcctttgaaacgtaagggggacggcggttttcgaacaaggttttgccttagctcgaaaacatgtcacatcctgaatttcgttttaggatttttaaagtatttaataaattattattagaatttatattaaatgttcattaattttcaagtgaagttaaatgtgggaaataaaatttcctaaatataaaggatggatggatttaatttttattaaattcttcatggttaattatactctttggaattatctcggattttttcggagctcaattcctaattttaatcatacaaagaacatttcagtaattacccacatatttaattaataattaaatggtctaattataattttttatttactttgagtgtccaagtattttcaggatttttcttgaaattatttgagcattggaagtatttttaacaattcaaagatcatttaagtgattattttaattggaaaagtaataaaattctcctctcccttgtcttaggctgaatcggcccattcctttccttcctctctcttccgccggcccaacccgagcctgcatcctctcttcttctctcagccaaagtccggttttactccctcttctaatcaggctgagaaaagaaaagcccggcaagaagtctacttttcctccctgtcgctacagtgcgtcttcaagc

SEQ ID NO: 42175 - DNA, 1501 bp, Oryza sativa
ttcatattttatttacataatcacaaggctaaacttgctttaaataacctataagtcatgggtttaattatatggccattgaatattaaataagtactaatattgtcctatacatccattcatttgagacatcacttatacttaatttacatggttgctactgtgacaaaacatgctagaaacaaatattattacatttactctactgtacaataccaattctatttattagcatatttttaagttgaccataacctaatcatatgatattaattatttataattataaatatattttattaaatagtgaattacttcctccatttcacaatgtaagtcattctaacatttcccatattcgtattgatgttaatgaatctagatagatatatatgtctagattcattagtatcaatatgaatgtgagaaatgctagaatgacttacattgtgaaacggagggagtatataccattggaaagcttatgaatttaggttcaagtttcactcaaatccgagttaaaatgaataagttatgctaggtaaagattcaaatttgaattaatccgagaaattgtaaaaaggcactgttcataattcatttatttttaatccaaaatatatccttatccctaacagctgctgacatgtggggtcaaagctttgattttctttttcatataattaattttccaaaggaaataggaggagtggagacggctcgtcagtggctcggctggaggtcgtcttcaacctcccgactgagcggaagtagcgagggaggatgcggctgggcgcggccgggttggcgcgaggccggcacggcggcggccgaggaaggtgcggcgagctcgagcgacccaccgactgcggcagcggcgcgtggcggagagagggcgagtggcgcagcatggacacgccatggcccgagctcgggttgcaaggggatagggtgctagggctaggatccaacaaaattgatgggagcgtgaacatctacggggtatggggattcgatttcaccagctagatggagaggggagttcccgggatggcttgtcacggcgacctcaccgacggcgcaatggcggccaggccggcacggccacaggtactagttggcaaaattggagctggcgctagctattagagggttagaggatgctacgtgcgcgagggtgtaccgtgagaaggcgagacggcgaaacgcggcggagtagggctcggtgtgtcgcggcacagaggcaaacagcgttgatggcgcccgaaagtgttcgtcagcgttccttgacgtccaacctccccaacggcgacagcggcagcgtcgctccgcctccatttcctccaacctccagctccggccggggagcccctcaatggtggtctctagtagcggtgagatcatgcatagaaggtgctcgatgaaatgtatttgagggcaaaagacagagagaaagggggtttttatggggcttggcttagggataagccagaatggcatg

SEQ ID NO: 42176 - DNA, 694 bp, Oryza sativa
ttccctcgtcgcaatacttttttagttttcgagctcgaattggggtaaaggcttttgagcttttttttatgtcatgttttcgagttaaggcaaaaccttgttcgaaaaccgccgtcccccttacgtttcaaagaagtgacgaggtcgaacatgtttccctcatcgcaactactttttagttttcgagctcgaatttgggtaaatgctttcgagcttctttttatgtcgtgttttcgagctaaggcaaaaccttgttcgaaaaccgccgtcccccttacgtttcaaaggagtgacgaggtcgaacgtgtttccctcatcgcaattactttttagttttcgagctcgaatttgggtaaatgctttcgagcttttttttatgtcgtgttttcgagctaaggcaaaaccttggtcgaaaaccgccgtcccccttacgtttcaaaggagtgacgaggtcgaacgtgtttccctcgtcgcaattactatttagttttcgagctcgaatttgggtaaatactttcgagcttttttttatgtcgtgttttcgagctaaggcaaaaccttgttcgaaaaacgccgtcccccttacgtttcaaaggagtgacgaggtcgaacgtgtttccctcgtcacaattactttttagttttcgagctcgaatttgggtaaatgctttcgagcttccttttatgtcgtgtt

SEQ ID NO: 42177 - DNA, 1501 bp, Oryza sativa
ggtacatcatgcctagacagcccatcactggcaccccatcgtcgtgtcacccagctatacaagccggctcttctatcttccttgttcctcctgcatcagcgtgactgtgaaggctgccgcaacctgtgggatgccaaagagagaggatagggaggtcgcgggatgacgacggatgtacgacggttgtggctttaattaggcggcacgattgaggtttgacgggggggaagggaagcaatagtgggttgagctggtggtagtggagcgcatactggcgctggcgagttgggatgatggccatggtgtttggtggccaccggcaagcaccttcggcgtgctgagggagggagaaaaggaactcaagggcatttttcatctataatagtatctagcatatagatatcatttgaaagtggcaatttggtgaagccaaaatgcaggatggcattatggtgaaacccgtgtttgaagatggcacaacaacattttttttcctttaggttaggaggtatgccctggcgagatgggtcagctgacccaccctattgaatggggccctcgcattgaagcatacatgtattttgttgttataggttgtactaatagagaaaaaagtgtttggttctcaagtttgtttaataataaaagaggatgcatcgttggggaaaaaataataccaaaattctagtgaagcataggcattctgtctcctgttaaaagttttcgcattgaagcatacatgtattttgttgttataggttgtactaatagagaaaaaagtgtttggttctcaagtttgtttaataataaaagaggatgcatcgttggggaaaaaaagtagtaccaaaatttctagggaagcataggcattctatttcctgttaaaagttttgtacaattgcttataagcttttgtttaatgttggcagcgccaatttttttttaaaaaaacatgtgaatatattgttttgatatgtaggcaaattctcagtgtagttggtttgaacagcaaaccaaacagcccataggtcctttagattagcaccatcaaccgttcaacattattacacctatttttcatagaacacagaaaaaggtacccacctaggagtcaaatgctcatgtgtcaaacaaacaattaagatgctaaagtaatggatagaagccacgaaattcatagaaaccaatttacctttctttataaaccctgacctttggcctggccgtcggattggcagctgggcacccggattcggacgcgtggctctcttgcatccatccatcccccacttgagcgcaaaagaggtctctcgatgcgccgcgccgcgaacacgacaactcgacggttcttcttccaggcttccaccgtcctcttcgaccccgccgccgtccgccgccgccgccgcgcctagtgccgctcccacttcgactcttctcctccatcgaattcctcagagactccccacctccggtcgcgccggatcgaggaacatggacgagg

SEQ ID NO: 42178 - DNA, 1411 bp, Oryza sativa
ttccctcgtcgcaatacttttttagttttcgagctcgaattggggtaaaggcttttgagcttttttttatgtcatgttttcgagttaaggcaaaaccttgttcgaaaaccgccgtcccccttacgtttcaaagaagtgacgaggtcgaacatgtttccctcatcgcaactactttttagttttcgagctcgaatttgggtaaatgctttcgagcttctttttatgtcgtgttttcgagctaaggcaaaaccttgttcgaaaaccgccgtcccccttacgtttcaaaggagtgacgaggtcgaacgtgtttccctcatcgcaattactttttagttttcgagctcgaatttgggtaaatgctttcgagcttttttttatgtcgtgttttcgagctaaggcaaaaccttggtcgaaaaccgccgtcccccttacgtttcaaaggagtgacgaggtcgaacgtgtttccctcgtcgcaattactatttagttttcgagctcgaatttgggtaaatactttcgagcttttttttatgtcgtgttttcgagctaaggcaaaaccttgttcgaaaaacgccgtcccccttacgtttcaaaggagtgacgaggtcgaacgtgtttccctcgtcacaattactttttagttttcgagctcgaatttgggtaaatgctttcgagcttccttttatgtcgtgttttgtcacgcccggaaattcactaataatttccaaactaatttgtgcataaaatcctcgtccagaaatcagccgaggtacacaaactgacaatttaatatacaaatccatcataataataacgttacatacttacaaaagaaaagaaaaacagcagcggaattaacggtctagcgatggcttcagctccactcccacaggcaactcaactggggtataagccaaacgtcttctccttctggatcccttttcttcaactgaggttgattgattattgcaagaatgagcatatgatatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacaacacacccatgctgcacaggcccaaccatcctgaacaaccatacccggctgtacagatctaactccaaaccaggagctaaacaaattattaccagttatagcatcaataattattgtgagaggcgtgagactaatcacgaaaaacattgctcaactcgcccataaccgcgggcacgactattcgaatagttttactctagccagaggtgtaccactgtacctacaagacacagcctcaacatcatgtctaccatgcgtcgcgatactggaa

SEQ ID NO: 42179 - DNA, 1501 bp, Oryza sativa
aatctgacattagccatcaatctgacattttggataataatcagtcatggaacggtctgaactctcgagtaacaaaaacaggtgcatcgattgggattcagattgtgaggacagaagagaggatttattttcctcatcacaatccatttttaatccattttctaaaaaataaatcacaatcaagttcagaaaattgttaatcgcggcactctttttctttccagtagagagcacgaggcagttcacaatcaaaccaatccatctcaatcgtatcaatcaagatttttttttctataacttgttcggatgggtaaattaaagcgaagacaaaatggttgcaataataagcgagcaaagctagaaatggtaccttgaaggtggtggtggaggaggaggaggaggcggcgagcgagcgagaggcgagggcaaggatctccgacgcgttccccctgacgacggcggggcggagggcgaggagggagaggcaggcctccatccggaactcggaggcggcggcggcgacggggtcgagcacccaggggcggcccgcggaggcggcggcgcgcatggaggggagccagccctcggacagcgtgccgacgttgacgcacacggcgtcgcagcgcggggtgaactccgggacctcgcggagggagtggaccatggccggcgacgcccccgcggcgagaagcgcgttggcggcgatgtccatggagacgaggttggtgacgcagtgcacaagcggcgcccgcgcccgcaccgccgagaggagctcccacgcccgccggccccaccacgccgccgtccgctcctcgtccatgttcctcgatccggcgcgaccggaggtggggagtctctgaggaattcgatggaggagaagagtcgaagtgggagcggcactaggcgcggcggcggcggcggacggcggcggggtcgaagaggacggtggaagcctggaagaagaaccgtcgagttgtcgtgttcgcggcgcggcgcatcgagagacctcttttgcgctcaagtgggggatggatggatgcaagagagccacgcgtccgaatccgggtgcccagctgccaatccgacggccaggccaaaggtcagggtttataaagaaaggtaaattggtttctatgaatttcgtggcttctatccattactttagcatcttaattgtttgtttgacacatgagcatttgactcctaggtgggtacctttttctgtgttctatgaaaaataggtgtaataatgttgaacggttgatggtgctaatctaaaggacctatgggctgtttggtttgctgttcaaaccaactacactgagaatttgcctacatatcaaaacaatatattcacatgtttttttaaaaaaaaattggcgctgccaacattaaacaaaagcttataagcaattgtacaaaacttttaacaggaaatagaatgcctatgcttccctagaaattttggtactactttttttccccaacgatgcatcctctt

SEQ ID NO: 42180 - DNA, 1501 bp, Oryza sativa
aatttggtaatgtaaatatttcaatatttgtctataaatttcgtcgcacttaaagcaatttaacttttgtcatggttacggataagtcatacctcctatcctacgacttatggaatatacgagtatggtataccttcacgtgcacgggttgtgtaacatcctgacaacaataaaaataactaaaatttcgaactttttaaaacttttgcatcatgctagatgttatggttgctattgcttgccaaactataaattgtcacaatgaaacattaaattaaagatgtacaatttgcaagaatacgctatctatcgattccataaatattatgcacaaggcagaaagctaaatgaaggaaaagttaattattagttcctccatttcacaatgtaagtcattctagcatttcccacattcatattgatgttaatgaatctagctagattgatgttaatgaatctagacatatatatctagctatattcattaatatcaatatgaatgtgggaaatgctagaatgacttacaatgtgaaacggagggagtaatttctattggataaattacaaatcaaatattaaatattcaaaccatgtttgattatttaacaaatggaaacagtaagattaaatcgaattcatctgaatccaatctcacatgaaataatgaccacctcattacactaatcccattataaaagagtgtttcgctagaatatttaaataaatatttaaaacactttatcaagtctctcagggcataaaattcattcatataaaataaacggtcgtgtaaagtaatggagcaacacaccatcactatgtctacttagattattttaataaactcctaagatatatcaacgcccccaaaattgtctaggctaatatttgggattaaacctaatttaaataatgcaatggaaatataattgtgccatcacaacttttgagtaaaatctagatttttggatattaaatgttaaattaggtttcctggcaaatttacagattaacccttcctttttcccttatcctttctcttctctttctttttcttttcctggcgcaactgttcatgggccgccaggtgctcgatcaagttgtggcccaaaccgactgagccagccacgcccgtgtctgcccacatccatcccgcacgcgcgcagccgtgcgccaacccaactccacccgcgccgcttctatgtgccgcgcctccctcccctcgcgcctcatccctccgcatccgcgctcgcgcccggacgccgcgcacgcgaccgaccatgccacctctgcaataataggcgctttgttttttgtgccggggaggagggttcccaacccctcctcccgaacacaactttagccgcgtcaacttccctaacctagaccgtagacagccatcgagtgcgccagccgccgattttatcctccatgccattctggcttatccctaagccaagccccataaaaaccccctttctctctgtcttttgccctcaaa

SEQ ID NO: 42181 - DNA, 1501 bp, Oryza sativa
atcaaaagctaagtctgttgcacgtgtttctagtgacacccctgctgccggtaattctgcatctactggtggtggttcaactgaaagggagaagaaaggggtgtcagtattaatcactgatgaaatgtacagtacaattttggatgttacgttcaaaagaatgcttaaaaaaagtacgagtgcatcttcagggctgttagaactatggagtgaagagctagaggggaagagtgacttctgcaactaccgtgccaagctggtaggtcttgttttctcctgacatgtaaaaactgtagttgctgttgcctcttgcttaacattcaacaatttcatgaagttgcctcattcagtcgttatatccttggaaaaaattaagaaaaactactgacacttattttggcatgcaaacctgatgtatcacaacacaaatatcagtccaattgcactcaacttttctggaatagcctcgcaaacaccatctgacatctacagctttagtccttgggttgtgttctacatttggttggtcccttggttgatgtgtatgttagacaaggatattgacagagttcagacacacatgttgttgatcaacatccacataatttcagctgtttaggagccaagggacacgggacatcgtgagtgcctgcctgcctgctacttggagagtttgcctgttatcatagagcttgtttaggttcttaaactatttatcaactagagcaagcaaactgccaatctgcttggtcagtttgttaccaattgcaatcagcatgttctttgtttgacgcagagcagcaaattctctggcattcatcaagttctatgctgcaatttgttttagttcaaagtgcaaattttcctcagtcgaatctgattttactttaagtgcaagttatttgttgaggcactggagcagtgctgctcaccgaggcagccacataagttcatgggtatgcctattaggtattctagctgaataaaagcatgattgttattcttttacgttcagccacgaggcagccacataagttcatgattgttagcatgggtacatattgtcatatgccatttcatgctacaagtatccatttgtcttttgtgacaacatgcattctttttcgcagattttcaatatggacatgtgatttgtggcaatgcaggatatttgccatgcaattaattttgtacttccacaaatcatttactacttaattaacaagttccctgaattcttcctgcagctggatctcataaaagtcattgcatctcaaaggcctggtattacagcaacaagcattgtacagagaataaacattgtatttggagatgctaatgaagcaacgaaatcatcccaggttggatacattacctacatatatttgcgacatcaatttaatggagtcttgcaattttgctgaaagaaagttttaccttctatttttttgttgttgttgtgtaacttgagttaaatatccatgccaggatcttgatgcaa

SEQ ID NO: 42182 - DNA, 1501 bp, Oryza sativa
tacacaacaaataaaggtaacttagacaccacatttaagttattaattactactctaatacttgcctaggaacttccttctttatccggagtcctagtactagagtacttagtatgaatactaaacaatgaacccataaatatggaaatctatcttacttagactaaatctctactgttacaaaaattggagatgttttgtcggtattttggtacgtcatccgtgtatgagtcggtttttaagttcgtttgcttttggaaatatatatctgtatttgagtcggtttttaagatcgttcacttttagcaatacagaaggaatcatataagaaatctgtttaaaaaaactcgcatactaacttgagacgatcggactcctaactgcagctcatgattttctaaaaatagatatatccaagcgaactcccacagtgaatttcatcttaaccaaaccatataacaataataagattaaaatagacttcactcgttgcaacgcacggacatattttctagtaattaaataacatcagaaatgatcccgaatgcttactttatagaagaagtttctccgaacccagagtagagtgtatcgacaactccggtactcctctagaattcctcttagaaagctacactagccgaggtagaagtcagagagagcgccaaccttccggtcactcctccaaagcttcccttcactctacctattttataacatacaaaagatacaatagagtctcttgtaattcagctcaaagttgtgggtgttggaatgaagtgagctcctccttttataggctccaaatgatggttacacctattgggatgaaatcaggagcgtacatgtggaagatggcgatcagcggcctccggatgtgttcggccaaacccaaaaaccctccctttggctgggaggtagcttaatggccccccaacatcatgtattatgatttggcccaattctaagtggttttattgacatatgggccctccaattcatgcaaacgcgtcctaattgtccgaagttgcattttgtcgcatgacaggtgtgttttctctttaaaatacctgtatacacatattttaatccacactagtggaaatgattagtaataaaccctaccactaagttgaataccatattttattctattatatgtaggaattgacggtcatatattatgatttaaggatcgtcaacaaccaactaacgttagctgatgataatggcaacagagaaatgagtatagatgggacagtggtaaaaggacattatgattataaagttttataaatccccatccttataaatttgcaaatgttcagcgcatatttacttaaaattttaaaatatggagtgtagaagaaattttttaatcgtggatttcttgattaaagttgttggttaaaatcttcattattttgaaaaactaatatgatcaataaatttcacggttcataaaatatcttaaaatgacttcttaaaaataagaatcatg

SEQ ID NO: 42183 - DNA, 1501 bp, Oryza sativa
taaactatgactttaggcaaaataaatcctattaggccatttccatgttttccctatgcattattgttgcatttccggtgtgacttgctgagtatggtggtggtactcactcttgctcacaaaaataatccagaggatggacctgaagaagatgaaggcttggatctctaatttactccaccgtcgagtgcctgtggctgctgttgttccgtagtcttccgctgttttatttgtttatctttgagtgtgagggcctagagtcgcccatgtaataaagttcttcctttacgtttccgctagtgtggcttgtaataatcaacaatgtctatgtgtacctcgcctcctgggacgaggattaatgcactgagcgtttggcaatggtgtatatttccgggcgtgacaagttggtatcagagccaccttgaccgtaggacgagccagtggtctaagccttaggatgatattttttttagaaactagttctttaattgtgaaaaccttcgttattctatcttcacctgtccactctttacaaaactggtcattgactcttatttcaaaatgttgtagatgcctgagttcgagactacccgctgcttcaacttggccggttttgtggagcaacttcgtgccttggccgctgaagtcggatactgtatcactatggagtaccgcgtggttctcaacttcgaagacgagggtgtacttgaaccactttggagtgccaaggtgatgatcatctccaaccggatgatgctagaaagttgctggttcacaggagaaggtgacagccgtgaatctgcctgccaagaagctgcattccatgccattggggccctttgccagagtcactccgaccagttgaagaccactctgttccactaccaccctgctcgcttgggtttcgcagaagatgctgacttccgcgatgcccgcaatgaaggggacaccaccattgtgcacatgtccaagatgatggccgcgatggacaagtaccgtatggtctactacaggatgacggagaggatgttcgaggcagtgcttcagaagaatcgtgacaaggagaatgagcttcgcgctctacgcaaggagctgaaggacttgaagagtgggatgcctggaaccgtcgtcaagaccctaccacctgttggatcaagcgcctgtcctcgccacggcatcagcaacgtggatgagccatttgtggaccgtagcccctctaggagtcgttctcaagagtagacgcgaagtcttagtgcgcgtatgtttttatcgtttatcttctgctggagtttgttgccttgtgtgctttttggtatggactatatcggcccgttgtgatatagctatacctttgtggtgcttaagcaacttgaactctatgtaaccaacatcacattaataaaatttaaataagttggtttaatagctcgtgttcttgtcctgatctctcccttcttcttttccctcttatcttggttactacagatggtgaacacaagga

SEQ ID NO: 42184 - DNA, 1501 bp, Oryza sativa
gaagaaacaccattcgtgtgttcatataaatatgctatgcatagagatgatacgctaaaggataatcaaggattaatttcaatgctaaagtttgttttccagataaataacctcctaccttacagatcactgtagctcaaactacatgtccatgcaaactccaacattctttgcgcatggctcatgccctggttaaacctaaccatatcagcccttaaatcattggtaacctgccattccttcaaatacaaaccgaaagaaaataatacttcggcaacaaataaaaatggtattagccatatagcagcccttaaaacagagcctttttcaacaataagaagactgctgtataattttactcatcccctatttgacccattatacatcacaatatacaactcatgtttagtatctgaataaatccaccgaagaacaaagatcagtgctcattaccactacactataacaagcacctaacactctcctctgcaatctcagctctgttatctgtccctttgtttatcactgtgtacattgcaacttccctaccactgttaaatttgcacttataaatttcttttaactacctttttttttttgcagatacagccatgaatccacctaggtttttcacggttagactaaccacagcaaaccagcgctatgtggtaaccttaccaacagatataacatatacagtctagcttaatacacgccagtcttaatacatcatttcaattctgcagcgcagaccagctgcaatcgcacaaggatatcagctggaggatggccagagactcaaattagtaacaacccataacctaatggtctacattgaactaaagagagcatctggcaaaatatacatcactacaggatggccccagttcatagaagccactggtttgcagcttaaagaatatgtggttttcaaagtcttatcacgctccaagatgcatgtcatcatataagccaagagtggttatcttagatgtccagtgccaagcaaaccaagcaactcacagctaaagaaaaacgcgcttcagaaaccaaaaccaccaggtaaatgatcttcaacccactttccgtctcctatcaagacaacaaatcattttcatctatggcaccatatctgaaactattacattactgattccactctctacttttgatttccgttaatgcttgcaacgccaattcacctgcagaaaaaaagaaccaagactaagccacacatgcaacaccccatgcaacagaaattaaaagccgatatagggtcagcttgtacaggtacagatacttctctttctattttcagttccattgatttgcgtctcttttaatgtgcattgatgtattcattcactcctctttcgaaaggcaacaccaaacgcactatcaatgaaatgtgcttctgcaccggggagggacatcaatctatcaactgaactcaaagactacttcaaagatattgcgcaatttctgcacccctcaaacgaat

SEQ ID NO: 42185 - DNA, 1501 bp, Oryza sativa
gaaatttatttaaagattcaaatttcagttgtcaaatttgtgatcaaataattctaccatctttgtttattttgcaaataagtgtttttttttgcattgagaattttgttgtcccaaataggctagcatataagtatgagataagggcaacataggctcagtttgaaagttcgtttagcttttgcaattctatcatttgtcgtgatctcattttctaaattgttaaacggtgtgtgtttgcaaaacctttttacatacaagtttatttaaaacaatactcatttttcaattttatatttgttaatatttaattaatcattcactaataacctcctgtcttgtttcgtgtggaacatatcagtttaccccaaatataggttggaacgcagccataatcattttgaaggaaaattacacttcaatatattagtacaagtcaactcacgatcaaaactatttggacgaggcaaaatttatgtgtatagcaaggtttgagggaaaatttatgggctaatgttctaaaaaaagaactaagccgaagttgcctaacacgtttgaaaacgatactagtggtgatatccgtaccactaaaatatctctaactagcgcttgtctaaatttagagttaaaatatctttatattttatatttcaagatgaatgtagcattattctagtactccatacaacataacctctccatcccataaaaaaaattaaatttaaaaatatactgttcatccaagttttttttaaaataccacccgcgacgtcacgcccacgtcattttcgtgcaatggttgtacgaaatcgacggtatatttttggaaaaattgtgcatcccaaatatcctagaaattttttcaatgaacagtatttttaaaaatttaattccaaatatgacacatcctaataatataataatatgagacgattacaagtcacaaatcgtattattattattatatttttttaatggaaggagcgatgcacaatctaaacacatcgcaagtcaaacagaaaaaaaaggataaatgaattaccatgaacggttgtttggaaaaaaaaagcagcccaaatgcgacctgggcctcatacttcatcgatcccctcccgacttccctcgacaagaaaattgtgattttgctatcgcaaaagaatgatttcgctggaatactattctttcaaagtgattaaatgctattttgggtcttttggttagaaatgattttgctctattttaatttttgttttgaccaaaatacccttgtctcttttacctgtttgaccagatcgaatcgatctcatccagcctcttcggctcgaggagggaagcctcgccgccgtcgcccatggtggcctacgcgcggcgccgccggcgccacacctggctataggcgggctgaagagggatgcgctctgccggctagacgccacggccgagcacaagcaggacgagagtggcctgccgtgccgctgcagcaggggcggacggcaacgtc

SEQ ID NO: 42186 - DNA, 1501 bp, Oryza sativa
tgagagaggaagcatacaaggaaagaatagaccagaactagggacaataccttaaaggaactaactctttttgttgatgtgttgtttgttttgcttattctgcaagttgattaagcaaacaacctagcatggttacatcacaacccaccgatgcaaaccacgcgctacacacacaagcaaggaaacacacgacaaacgaaacactagagggtggcttaggttctgcgacaggttctccaagatcttcactgcttcttcacagctggcttcactgcttcctccactttgctaacggatccaacagccttccggagcttcggcagacaactgacgatttcttcttcttcgctgagctgaccatctagtactagttgaaatccgaagaaggaagaagggagtaaaccttttgcaaatagcattaggggaaggagaaaaaaaggaactttcgcaaatagttttatttataaaatatgtccttaggttttatccacttggcttatcctacagtcgagatggctctgataccatcttgtcgcgaccgagaaaatttgcattttcccgaacgctagtgtattaatcctcgtcctaggaaaagccggggtacaccaaacaaacatgatacaaaaggcacatctttattatatcgataatatttacattattacaaaggcatttcaggcctgacaaacaaaaataaacagcaacggactagcgggcctacggctccatcttcacaggcgttcaactggggtataagccaggactccacctaagaatttttctccaaagcttctcttactgaagggggggggggagattgagcaagaatgagtacaaccacagtactcagcaagccacaccggcaaatgcatgattaatgaagggggggtacaaggggtaataatataggggttaagttttgcagtaaacagcttttaaaagtcacttagttgcccaaagccattttataaagacgatcctagagctacacagtgttattaatcaaggccgtgaaccctcacgaacctgccttaacttaaggcctacgatgattcagaccgaactggcaacccgaccctgggtcccagctcgtcccaagccaacccaggccaaccattccacattttagttgttaagcaggttttaagaattaaaacactaacttgggtacattgctaggcttgcccataaccgagggcgtggctattcgaataggttatactctgatcagagatgtacatctttacccacaagacacatcttcctacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactactgggccgcagctcgtgtaaccttcatttgtcctaga

SEQ ID NO: 42187 - DNA, 1501 bp, Oryza sativa
ctgctgttcaactcacgggtgaagctattcggacatggaaaacttcgaaataaatggatgggcccatatatcgccgtcgacacttcatcacatggagccgtcatacaataaaagtaatatctttaagataaatggctatcattaaaaagtttttcttgatccgttagaagttgatcgtgttagacgtagtgaatttagtcgcttctagcttctacccggagtccttaggcccccctgatccgttagttttcaatgccctgagtccttaggtccccctcttgttatcttaggtctaggttctaataggtgcacttaggtctaggttgtttagcttatttttatttcatttcattcttgtaatgtgcctatcattgacgaccgtatttgccggccgaaagaccattatgcacttgtacaactaaaatggtataagaaattcataaaatcaaacttttaaaggttgtaaaagaatgttctcgaaacttttcaattagtcgagggggcatatttagaggaggtttagatttcgagaagagctggttggaatccaactagtgaaaatctagaaaagctgggaaaaccactttctgtcttctagttcattttcaagattccgcaactacaactttatagaatctacaaaaaggtggatattttaggggagctttcaattctaggagaaactgtagctattagaaccttccctaaacatgttttagaatgtttctacatgtagctcaaatgaaatattgaaatgaaaaaaaatattttatgactcacaaaattagaaaaaaaatacaaaatatccttgtgtatattgactcgacataaattattttgtgaaacatttaaggattaaatcattcccacgatgcaatttagaaaaaccacacataattcacttattttatgttcccaggaaaagttaatatctttaaatgaaaattgcttccttcatattatgtggcatttgttaaaaaaagtgttatttcattacaaaacatatgctagggcataaatggtccttacaagcaaacttaatggtcaattgtattgtggtatcattggaattaagatgtttattgtaccgtttgttagttgacggataacaatatcatctctgttctttcttttcctccacaccttaaaaaatgttaaatgacatcttatcaatagacaacacctcctatggccatatgaagtgttgtcgcttcttgatatggttacaagtgatatttgctatccaaattgaaagggagcataatttgaggatcatagatctcgcctagatggagatgaataggtgtttcctgcaattacaaacacttgcagcgaaaattagtattgaccggttaatcaggtatcattgcggataatctaacaatacacagtgtcagaaaatctaatcacaactagacagtgcaaccaaacacagagaatataggaattcgcctatgcacaatatagacccgtacaatccaactaagagtggacaaccttg

SEQ ID NO: 42188 - DNA, 1501 bp, Oryza sativa
cggcttaagcacatcaaccacaaacgatgtgaaaccctagtattgacagcgctcatcagtctccttgcttgctgctatcctcgagtatgctagggtttaggtcaccgccgccgcccttaccacattcctcggcagcactcttctcgctgcagaaatacttaatgccgcggacctcgctggctgtatcttcgctgagatcgccgccaatgatgtagaccttgccgctgccacccttctccttggcagcactcttctcgctgtagcggtactcaatgtcatagacctcgccggtggtatcttcgctgaggtcaccaccaatgcttctctcaccaccaccacccttgccacgttcctcgacgatgctcttttcgttgtagtatttgttataaaacaatttgcatggatcgacatttatcaagttttgttatcattgagttttttcttcccatctcgtgcctcattatgccacacgacagcgacgccgatttgcttcagaatcctcttctgcttccgcttatgcgccggctatcgcttgagcgaccaaatggtggcggtggccacacgacaaatagcgcaggtggggagatgttgcggtccggtgccgctgtgagatatatgcgccgctgagagagagagagatgaggtggggaaaggacttcggtgctgcacggacctcacatgacacgtggaggaaaataaatgagcagcatatattctctcttttgttacaaggtcgctacccatcctgcccatcataaacggactatcataattgatttggtacctctaggtacgtatctggtgtaccatttgttagaccagaacaaaccttaaataaaaaacacaacttccactatcttttaccagccattgatgtcaggaaatgtattttctccccttttgtaagctcccgagtcttgaacatatttctttttagagataatactccctctatcccaaaaataaatttacttctatagattcttgacaagcttatccacattcatatataaaagtagacttaatacgcaaggagtagatataaatccggcctctatatatttataagtggatatacacaacctccttagtataagaattatggcggcattatcactcattatactatcgccgtgtttagttccaaaatatatcttcaaacttccaacttttccatcacatcagaactttcctacacacataaacttccaacttttccaatttcaaccaaacttccaattttgacatgaactaaacacaccctatgtatctaggcattttggactttttggaggctacatcatagcctgtgtgttcacggtcgctgattcgcctttctactgtccctctcccaccagtgaagctccaaccccagtctcaagctactctcttcctcccatgaccaagaaaatttgcaaatggactaaaccataaacatagcttgtcagtcttgtctttctggtttaagggaagtagtgagtagtgcgctttgatccatcac

SEQ ID NO: 42189 - DNA, 1501 bp, Oryza sativa
taatccctcactaacttttgatggattcccttatgattacaactttctgtatcaggaatctcttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaacatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtactattctattgtgattcccagtaagagggtcaaaatgggtagaatccatatcagtccatagacttcttttaataattccaagttcgaaaaagaattgatagcttctacatgtaccctgtctattatcatttcaacgatcaacttctcccataatgatatctatactacctaatatcgtcatgatatcagccaatttcattttttttactagctgaggaagaatttgcaaattaataaaaccgggtggacgaattttccatctccaggggaaaagactatcatctcctaccagataaattcctaattcaccttttagattaatctatcaagaatagtttcgccgctagatcggtttgtaagaccccaacttgtgagcttaatcattcatctgcaattttggttgtattctttcttgttcttgtttttgttcttcaattcataagcagggattagccttctcggcgaggtcaaccgggtttcggcactgttgataaccagaggagacgtggtgctgcgattgcggggctcaagaacgtgctcgttcaagaagccggatcgatttgtgtcatgactccaccaaatcgttgattatccgaacctttcgaaaaatcgggaacccttgtccacatcacatttcctcgtgaaaatcctgccaatctaagtacatatttatcgtgtagctacaaaagttgacatatcatctgttctagtaatataaacataaattgtaaggtatagatgccacactattaa

SEQ ID NO: 42190 - DNA, 1501 bp, Oryza sativa
ccattgggctacactgctacttgttttaatgagctaacgaaagaacatatatgtagaaattagtagtccggttctgcaattgacccgggtgaaccggcggttggaccgctgacccggtgacccagcagccacgacggttcgagtgccggtccggctttttttactatgggtttaagcctccgggtagatgagaattttttttctcttttttccctttttttttagtttttcatccaagtgatcatgacggtgatgaagagcaacatggcatttttctttcactagccctacttaaatccaatttaaaacacatcaagtatgaatatgacattttgatcctcaggatttgaattttttaataggtgcagccatacccacgattccatcaatacactatcattacttccctaaagcgtgtctctaaatgcattataaattttatcccaaatttatttgtaaaagccattatcgagccacattcgattttgcattcagatgaaatttgtttttaaaatggccatactataaatcgtcaaatcgtactagtttagaaggtttatattttgcactttagagggtgaaaagtgcaacctttgagaatcgcaattggaatgtgtacagaaaaaggcatggccgcatgggtacaaagaaaaggtataggaatgattcattttaattggcatctgtcatgagttagagctgaaataccatcacacagcagtgaattgcacccccaaaagcagtgaatcattttaaccggattttccagcttctagtttattttctgaattccacaacaacatcttcttagaatctaaaccaaaagctagactgtttaggagagcttttgattttagaagaagctgcagcaactagaagctcctccaaacagacccatatgctccgtaccaccaccagatatatataaaatatactagtaggattgaacggagccaggcatgcacgagcacaaaccaactgataatctagcattctagctgaattccagcgtagaagcagggatctgctgataagagttcaatatgatattcttcagaaggccaagatggtgtggcgtcaatcacatacacagcggattaaggctccgcaggtagacgacaccctcatgctatggggaaaaaagatatatagcccctaaatacaaacacggatatgtcgtttatgtttaccggggcaactacaaggctatttacataggctacttccaggaaacggttagaatccgggggcataatgagttgaggatcctatttcaatagcgaaattattactcccgtctatcgaccacgcgaggctatcaacttatagcctcaatgtggtgtctgctggagctctagaagccgcggctttggccttctcagctaggaatttgtcacactctgctcccttgacagtgaattccatcagaagttcctcaaataatctcttcagcgcgctcttaaacctcgccgagcagctcttgtcgccctcatcgacatcc

SEQ ID NO: 42191 - DNA, 1501 bp, Oryza sativa
tcaactttgctgaaaaaaatgagacagctaactgaaatcctatgtagacacataaagaaatactactaatatatattgcaagcaaaatcccagtccatgaatgacttgaagttgtatgtactaactcttttgaattccctcatcaagttggtcttttcagttgatcattactgaatgaaacaatttgatcataaggaataaatattcatcagcatcgatcctgtagtattaccaatacgccacacgaacaattttgcataatcaatattcaattaaaatcatgcataccctcctctattcccacaagatggttggagcaaagctattagcttgaactattcaaatatgtgatcgctagatacagctttcgatgcaattatgcaagtcggaccatttattcgcccaccgaatgttctcaacttgcagtagtagcatgttataaatataaaccatatcatgttattggtctagctaagcaatagtgcgcaaaaaagaggttgagctagctataatatgatagtgcagattatagatcttatgttaaaagcatactcacatgtccatcctacatcccaggttcttctttgagaactgtgtcatttttcagactgaactgctgatttaagactggcaagatagcttttttttttcttctatttgaagaggcagttttcatatgacaaataaatgtcaccaattatcaacagaaaagggtgtgtaaccttaccaagtcacaccttagcaagtaaactctatgtgtaaacctcctaatttttcgtaatgacaaaattcaggtggggaagctctcccccggtgatttagtcaaaaaaaaaaaaacaccttagcaagtaatccagtgggaacacagcaacgcacctttttttgtttttgtttgaggaagtaggcctcgcctcacacagtcacacctattcagaacttcatgtcagtactgtcatttaacttgagaatagaacacagaacaggcaatacatgaatggaacccataagttcctcacacttgtgaatttgtgatggacattcaaagcaaaaacagaaacattatggagggaaaattcaagatcttcaccctcagtcacctgccctgcattccttggcaagatacatcgtcaatgttcaaacctcgacaccaaaaacctccaaatcggtccgagtcaagtatcactcggttgaccactagcagcctcgtaacgtttgcctcatttcatcaggtggcatcaaacattcgattatcaatcagaagcaggagaatcaaacgaaataataagcaggtagtacatcaacgaagagaactccttttccaacctgttaatgggcctgactgggcctgaaaggctagaatcggaggcccaataaactgccacgaaatcctagccgtccaaatcaaatcagtggctaggattgcttgacgcagctctcgtgcccttttatacttgcaactgcgagggattctcgcctcctccgccgccacacctccacctct

SEQ ID NO: 42192 - DNA, 1501 bp, Oryza sativa
ccggctggtaagcagtaacctttttttttttgttgttgctgtcaatgctgaaaaacagagtatgataagaaaatctcaaaattttaacttttcaaaatttgataagccagcaagcaaaacattgaagagttggaagctgcagttcctgatgggcaactctgcaaaggttcaaaggctcaaaggttgcatctttggcctttatgttttagctatttaaatgtcaatgctaaaaaaaatagagtatgataagaaaatctcaaaatttcaacttttaaagtttgataagccaacaagcaaaacattgaagagttggaaactgcagttcctgatgggcaactctgcaaaggttcgaaggctcaaaaggttgcatctttggccctggaagagttggaacatcttggaaagccaacttggcaagctcgaactgccctagtctaagagcaaggataataatgggctataagggcacccacaatgattatctataagctctctacaagagatccatgttagcatatttttctacttgaaagaggttaaataaagagaaagagcaaagctaacgaggcaatggattagagagctatagatacctatatagacataccattgaagtggtttactataaatctagtctattgctgagatgtacatattttatagatagcatcttactttaccattgtggatgctctaagcaagctatatgcttatatggaagagagagataggaaaaagtgggtagtgttggctctcatacaagagctagctccacacaacctccaagaaatatgcattaaatttatagagtgagaaagagagagaatggaaaaaataaagttaacctgttgacttattatacaagttaagtaacagtgagctttactattaaacttgttctaagcggcgagccaaccaaccagagcgcgacaagaccacacaacacaagcaaacactggaagcggggtcactgctcattcagataggttcaaagatttccagagaagcttgaccaaaacttttcccggagtatgggcgccgctcccaccggcaccacgcatggcgcgccacggaagccccgctcgagcggaccatccccacgcggcgcccatgcgcctcacccgcgcgtcgtcgcggcgtcacgtagcgcaggcaagccagttcgccgcggattgtcgtgagggcttctttttgacctcgttccctacctccatccatccacgcacgccgccccccacattgggagagacaaaaggcgggacgctgatcgagcttcttctcgggattttagggtatgttcttgctgtgttttccctcccctgtattcgtgataacggtgcgttcttgaggctacttcggtttgcgctccacgtgttcggtgaaatgcctgtgagagaggaggaagattcagtactcatgcctctcctactctcttcttttattctgttgttgttttgataatttgtctggtcttcttgattattttgttagattgcagatg

SEQ ID NO: 42193 - DNA, 1501 bp, Oryza sativa
atcatcatactaaagtatccgtacaagattcattgtacaaaacctttttttttggtaaaatttttttcgataatgttttggtaaaatttgcatcctatcaacaagcaacatgaaaccatgcatatacatatatgtagagttgtaaatgatcctttttttttatatcctcaaaaagaccaaaacgcacgcatatgtccagcacaaacatttgtagcaacatataaatctttatgaggttgatctttgtgcctaataatgccttttgatgagagtgttctctaaagcatctaagatactaatatttttctcaatttggattgtcgtgaccaattggactgaagttctcaccacatgtttgcagggcctgctgatcaatgcaaatagacttgaaagaacattatattctcgtgatcttatcaagtgaagccatatctaatgaaagcttgttatatttgttgctttcttgatgagatttgttgcttatgaccacttgtgtcctctaatcatccaaagcaaaaaaaatcattcagccggtctttacctctccaggaattaacacctgtgacaagttattccttgttttagggcaaatctcctttggcaattgcaccttcctgtcgatcgattatcctgagcatattcctcttattgagagaacccttcagctgggcaaatctcctttggcaaaatacctatctatagtctgtctattcgggcaaatctcctttggcatttagcttagattgcttccgggcaaatctcctttggcactacctttagcttcagattgctctttgggcaaatctcctttggcactaggtactctactactatccgcattagatatttggatcaaatatcctctggaagttagtggtattacatcattatttcctgcaactatatatcgtggtaattctcctttggcattagcactgtacacacattggttctaccacaatatcgatctcagtgaaagactgaacaccaggaagtccagaacgattcaaggtaatttgtcctcttttatggtgtatattttttatgtgagccgtcattttctataatatttattcacttacaaaagctttcctattttgactcaattttcagaaataatttttggctggtggccgttgtattttagcatcttggacaggaagctttcagattctgattgttcagtctggaagattgttttgttatttatcaactctatacatcagtgcgcctatcctaagaaggtgagcatgtagttaatagtatatttcctttaaatatttctgtgtctattccattatctaaaaaatatatatttctgtgtctgattccatgtgaaaaatgacaacgtactttgttttagggctcggaaagatggatctatatgcaattgactcggacactgagtcatacgctgaaactagtgacagtgaagaagaccaagaagaatgtgaacttacatactgtggtcatgcccagaacatcttgtccagcttggacg

SEQ ID NO: 42194 - DNA, 1501 bp, Oryza sativa
aaaagtttacttgagattggtctgctatttgatcagtccgtgggaactccccagctagctagctagctagcttaaacttgcgattaatttaactcaagcaatgaagcgaataagcgatgcattcatccgtcagttgatgatggcttttggtatgtagcttttgaacttaatgtgctttggttttatggctgtgtttagttcaacgctaaaattgaaagtaaaaattagaacgatgtgatggaaaagttgaaagtttgtgtgtgtagaaaagttcgatatgacggaaaagttggaagtttaaagaaaaagttggaatctaaacaagacctatattatatttttgttctcttctgttggtgtgtcctaacattattgtcttccctcattaactaaataattaatactggagtatcattttaaataagagaatagtgatgaacacttatcaattatggtctagaaggagaaggcactgaaattttctgtaactgatatacatcttcaaggaagaagcaccaaccttttctacgattgataaaacgtatgattgtttgtcacatgataaagtaactcacagaatgccaatttacctattttactacattgtcagattccatatgcgcatgtacagcatcacaatgattcatttgatgctcatattcggttttagaaatattggtaaattttcttttagaataactcctatgactctaattggtctttatatttcacatatttcattttgctgctgaaagctagattgaattgaagagctgcaaatacagaaatccgtatggatatacatcggatttgtttactcttttatcatactccaaacccaacctaattcatttttgttaactctgcgaagtgcacatggtaggataacttaggttcatacacttttgaagtcagaaatattttgtacatcactttgttagattttactactctctgtcagtatatgagtcagttcctctcatcaccaagcagagatgatttataggtattgtttccaatttcgtactgataacagtacttgcgattattacttaagataggcgagagagatacttccaacctatgcagcggtggttctaacaattatttattaagttctatggtattgtcaattttcaaatttaaagtagaatttcataccatatattttgactcatgtatacaaggttttcatacgggtatttaatgtcgcgcaacgtgcgactaagtggctagtccagctgtgacggggaatcacggtcgtattccagcacgaatcttaacttcaatcgaacggcccacatcgacgcaatgtcaggagggccaaccggccaagcccaacttcccccaaaagccctaacgaaataaacccttccgcccccgccgccgccgccgccgcctcgccgcggctcgcatccctcttcctctccctctcttcttcgccggcgcgacgcgacgaggcggtagctgcctgccatgccgaggagaggtggagcggcga

SEQ ID NO: 42195 - DNA, 1170 bp, Oryza sativa
tttataaaaccttgtttagcaaatgaactaaatttctatatattctttcttccccacacacattttctctctcatcaacttacaactaaattttggagacaaaaaaagtgtgtaaaacataggtgcaaatgtagtatgataaaaaaaaacattggaggatgaagttgcaaaccttttaggcacctccgatttgtatgtaatcaccaaaataaattcaatagaaattttggcatgacctcccctctttttgaagaaattttgaagcttgctcgggcagctggaggaggaagaagacatatatataggggtgggactttagtcccggttggtagtaccaaccggggctaaagatcaccgggatccggttggtattaccaaccaggactaaagttaagatctttagtcccggttggtgttaccaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatattgcatccgggactattgtggaaatcggccgaccgacgaaagatggtttctccaccagtatacatatactttagtaaaataagttgaatttgctacaagagcgttattttcaaagaaccccctaatgtgattttagctttcaatgtaaccggtatcttataataatgtagtgaaacatgtatttttgaagaaaaagacataatatttctccttttctaatgctattttttctcatccttttattttctgttagtgaccaaattaataaacctgtgaaggagtaagatggcaaatacatacagatatttagtagataatcatatcatcgagctagttgggtattggagaagacacgaatattagggaatgatctaacatcaaataattagaaagggtgatgcttcgaatccaggtcgtctagcccaccaccctgtggagctagccggaagacccctgagtatttctcactagtaaggtattggaacgaccgaagaagagtaagatagttattcatatttataaggctcgggtttttctccgttttagttcagatttaagaaggttctagattttcccttagtatttgtttgatttatctcagc

SEQ ID NO: 42196 - DNA, 1501 bp, Oryza sativa
ccatcatctgagaacccaaagtaaataagcacgccgccgcgccgtgagttaccgtgggattggaggcttagagccgtgctatgaccccatcgggatagagagactcgggtgccaaacctggaaggtgtcgttgatggtctggaggtgcgactgcaggaagcgggacagctcgccgccgcccgccggcttcttcgccgctccacctctcctcggcatggcaggcagctaccgcctcgtcgcgtcgcgccggcgaagaagagagggagaggaagagggatgcgagccgcggcgaggcggcggcggcggcggcgggggcggaagggtttatttcgttagggcttttgggggaagttgggcttggccggttggccctcctgacattgcgtcgatgtgggccgttcgattgaagttaagattcgtgctggaatacgaccgtgattccccgtcacagctggactagccacttagtcgcacgttgcgcgacattaaatacccgtatgaaaaccttgtatacatgagtcaaaatatatggtatgaaattctactttaaatttgaaaattgacaataccatagaacttaataaataattgttagaaccaccgctgcataggttggaagtatctctctcgcctatcttaagtaataatcgcaagtactgttatcagtacgaaattggaaacaatacctataaatcatctctgcttggtgatgagaggaactgactcatatactgacagagagtagtaaaatctaacaaagtgatgtacaaaatatttctgacttcaaaagtgtatgaacctaagttatcctaccatgtgcacttcgcagagttaacaaaaatgaattaggttgggtttggagtatgataaaagagtaaacaaatccgatgtatatccatacggatttctgtatttgcagctcttcaattcaatctagctttcagcagcaaaatgaaatatgtgaaatataaagaccaattagagtcataggagttattctaaaagaaaatttaccaatatttctaaaaccgaatatgagcatcaaatgaatcattgtgatgctgtacatgcgcatatggaatctgacaatgtagtaaaataggtaaattggcattctgtgagttactttatcatgtgacaaacaatcatacgttttatcaatcgtagaaaaggttggtgcttcttccttgaagatgtatatcagttacagaaaatttcagtgccttctccttctagaccataattgataagtgttcatcactattctcttatttaaaatgatactccagtattaattatttagttaatgagggaagacaataatgttaggacacaccaacagaagagaacaaaaatataatataggtcttgtttagattccaactttttctttaaacttccaacttttccgtcatatcgaacttttctacacacacaaactttcaacttttccatcacatcgttctaatttttactttcaattttagcgttgaactaaaca

SEQ ID NO: 42197 - DNA, 1501 bp, Oryza sativa
taaatatctctggctggcctggctgccggtcggagtcaaccgacgcggaggaaggggaagtttgggaggaaacggggccaaaagaaaaaaaaaaaagagggtaaaaccgcgcgttgggcgagggcgaggggtttatgcgtgcatcggcgcggtccagtccaggggccgtgaggcagacggggtcaggttggaatggaatgtggtggatgttgtcatgtccatgcgatgcgactgtgtttctgcctcaccacatggtggcgtgcacgttggattggcgtagagatgggcgcggttctatgatatatatatctctctttcttctttctttctttctttctagtacctccacccaaatcagatgttgtttaaatttttcttataacgtttaactattcacctaaattagatgatattaattcacactagtcgactaacaaaaaaaagaaggcatatatcaacctgaatatgctttagttttaaaaacctaagccctcgttgacggagagtcggacacaaacgagtagaattgttattacttccactcctaaaatatgaaagatttttaatagatggaacatataatactagtattatgaatcttgatagactctatccaaattctttgtagtattaagatgtgtctcatctatccaatatcctttttattttggaagggagcgagtacaaacttaccattacaattaacaaagataggatggactaacgggctgatatagtttgggctaggcttcgggccagcccactacgcgttgggcccaataaaaaatatactagctttcaccacagggaaaattagggcttagatgatgctgaaaccgttgtctgtatgtatattactcccgtttcatcatattataatcagttttgagttttctcaagtcaaaactttttaaatttaaataaatctataaaaaaatttgacaacatctacaacaccaaaattagtttctttaaaactaaaatttaatatcttgatttgttttgtatcgaaaatgtcactatatattttctataaacttgatcaaacttaaataggtttaactaaaaaaaatatgaaaacgacttacatacgcatgtgcgcctctttaacatatgaaaagaaaaggaacacggaggctaacggtaaatttcttctctctcactaaattatcatgcaaagaccaaaagcatctgcgtgtgcgtcgctggctgaacctcctaatttctgtgctcctaaagaaccgtcaagcttctaacaaatgttgttgctttaaaacactacatactcgtacggtgaattacaacgtacggacaacggcaaacaaatcaatggtgagcattgcaacgtacggacaacggcaaacaaaatcaatggtgagcagtgagctaccgaatcgactatgcatcacatggcctgcaacccggacaactgaacaagatctgcaatgactacccaaaaacagcatttgccataacttcacgcagatgtaaattctcatgg

SEQ ID NO: 42198 - DNA, 1501 bp, Oryza sativa
atggctagttgcaagcgcatgattagttatttatgtagttcacaaatttgttgaataaggggttgaatcgagatctcctatatgttttttgttctagggtttgaatggtgcacccacaaggagacacggtcgtggaatatttcatctttctaggaataaatcgataaaatgtgtaacttaaatcgatgcaaatcttcggtgatattttaaccaatcatgtttgtgaaacacaatataaatctcttcttgtaaaacaaaatatatatctcaaaagaaataaagggaggagttttgacatgttctttagaatatagagtaatatagagaaaataacgcaaataataaaattttacgctagtaacgtgttcttcgaaacaaaatacaaatatagagaaaatcacgcaaatgagaacattaaagtatacgacataaatctagaaaaaatcacacaaatgagatctactaatctagtactaggcaaatgacttaattggttgattaaaatttagagacaattctaccattttctctcaactagcatatttgtcataaatacttaactagcacataattaattaagttttaatatagagaagcttaattgttactaacatatggctatatgaggaaacttgatttttactctagttattgatacgagctatgctgaaaactacctttatttatttacaaagtgcatgcgcaagatttacttttgaatttacaagataatcatgtgtatttaggcctgcgccactgaatttgtcggagtgtgaaggattcaatactaacctttcatacttcaacctgcatcacacctataaacactctagtcctgcgcgttcttctcaaacttccattatctttactgaggaatacttttggcatttatgtttcccatttaaggtgtttataagacatctgatcatatgtgttagcagtacttttaacaacaaaatatgttatataaataataagcaagaaaatatttgcttaaaggaaaaatagtgagaattcttggagttggtatgattgactatacatttaagaaagcaattagtaatttaaacaatgttgggttttttagagttttctaaagcggatggatttgcagcagatttgaagctagtcatgaaaaactctgttgcgattataacatgatcaagaatttatctgttggagggatgaaaatgaaaaaaaaaatcatgtcattaaggatctggtgggtaacttaacttgaggttggttagtatttcctgctttcaatgtgtggatggataaatttgaacagaaaaaactttctttcgatgattgttagggttttcaatttccttaaaaataaaacttaataaacagaaaaactttatttcgaggatttttagtgttttcaatttgcttaacaagaaaacttaacgtagacgtagaagatttgtatgagataagagatttgtatgagataagaaccgacctacttatcaatatgaatcatgacaaacattta

SEQ ID NO: 42199 - DNA, 1501 bp, Oryza sativa
aaactaaggctgtcccagacacactaatcaaaagcattcgaatttagaactcctataatttgttagtttgtttaatcactctttgtgtctcatgatgattcatgcttgcataattgcatacacttctcgactctaagcttggaccacacaacccgtacataggacgaaaccgaaagcatcacccaaaaaaaaaaaaactaatgtgcccctctttagcatgtcagaataatatggaaaaggcgtcgagcagaaacaaatatgtcaagagtttgacaaacctgacaactgccaatgcagccaatgagccaagcagcaacttgttgatggctggtaggctttcccattatattctggcaaaaactttgcttccatttttctattgacgacgatgagttcgccgattccggccgggccggctcagcttttctccttcggctagcgtttggacgcacacttttgagagaatcgaaacacggagagaagtgctccgatgcatgacacctccttttccacgtacttaacgccaaagggaaacaatgatatgcagtgaacacaaagggattgaccctgcccaggatcatcaatacacgttgaggcttcttcgtgtgtgaaagcatggctaactcgtctggtcaaaggcaaaattgctgctatcctaaaacaaatagtactaggataaataaatgaaagggctaatataacactcgcacacacgcgagacgacaaaatggagagctagcacacacgatagggacggctcgacggtaggggaggaggaataatgcaggcaggatgttactatggccacgtttagttggttagtgtgacaaaaaatttttaaaagtatacagacatacataatatatatttaaagtattaaaggtagactaataacaaaataaattacagatttcacatataaactgtgaggtgaatttattaagtttaattaatccttcattagcaaatgtttactgtagcatcacattgtcaaatcatggcgtaattagactcaaaagattcgtttcgcaatttacatgcaaactgtgcaattggtttttttccatatttaatgcttcatatatgtattcaaatatttgatgtgacggaattttttaaagtttaaattcaaatatttgatgtgacggaattttttaaagtttgaagggaaataaacacggcctatggcgcaaaattgtactacaaactccctttcgcgagacgagagaatgcaacgccgtgccgctctggcggctggggcccaaccgcgaaaggcaatccatccctctctctccccgtcgcgtaaggccgctataaatcaacccgtcgcgggttgcattgcatcggtcggtctcggtcgctgccgtccctgtgcttggagtagacacgagccggtgacgcgcatatcgtcttctgctcgagatcgatcgatcgatcgcttggttggttgctgcgactgcgagggaggccgcgggtggtgaggaggattgtgcaaaaaaaa

SEQ ID NO: 42200 - DNA, 1501 bp, Oryza sativa
acagaaaagttggaagtttacgtgtgtaggaaagttttgatgtaattaaaaagttgaaagtttgaagaaaaactttggatctaaacacggcctatgtacaaagtgtatccacaaatatggtatgcaacagtatagctttgatttttaaaaggactgagcaaccgggggaatctttttgtcaaataattaaaaataaaatattatcatgttgagaaccaaaataaagggatcatatggttaaactaatacatcctactacaataccattacactagcaagtgcatatcattactttgaaattaaactctcctgttgctagtggcctcgcgggaccttccaacaaaaggagctcctggcaaccagcctcctagccaagattaaagaggaagccaaaacatgtgttttggtgggtgagaagaaccttggcaactggctcattatgtggttagctcggtccaaaggctctgagcttgtaacttttttcatttttttttgggttttgtacaatttactccatctctatttaatgaaattggcggcttgccagtttgttcaaaaaaaaaaagtcctcgttaaaaaaagttcttacagagaaattctcaataaaattgtttacatctaacaggtatatacatctcataattgaagcagcaccattttacaaggtcaatcttgttacccgttctatatattcttttgtgtttcgttgctcaatccagaataattattggtcgtcatgcacgcagtcactaatggactgtacttttttttttcataacggcattgccaatttagaacaaggcatatcaaatatgaatttcttttgcctcaggtgtcgtcagtaatatcttctagtcagactaataatgcgtgacttcgctccaattataaaacagttaataacaaccaaacatgtcacacgaggattgagtttcttttcaataaaggaagcgaatcaatgaaatgaaacagagcttctgcttttgtttaagaaaaaaagtttaactgattaattatggctgcagatcgattcttgaactactcaatgacaacacttcaaaaactttaaaaacatttacaattcatgcagcagcattgtggtaggttcatggatggaagagaaacacgaagatccattatgtacttacacataataaatagatgtttttaacagaatcccctcacatttatttaacaaaaaccagacattgctcttataatcacaggatttgcatctcttcacaagaagaaacagggaaaaaatatacgcgtccgcaaaatttcccttttatcatacttatataaacaaaagggcccccttttcttgtaaattatttacaggccctttattttacctttttatagctaaaaaatgcatggccctactatcttcgcatcatcaatgctgtatcaaaattgcagaaatgttctctcggcctatgcaactacgggttggaccagaccttcacttgagacagcaatgtcctctgtgccattggtt

SEQ ID NO: 42201 - DNA, 1501 bp, Oryza sativa
aagccaacagttttgaacttttgatacgatgatttggttcacaatagcgatgttatgtttgtatagatcaaagggcatctggttcatggaaagctatagaaggttgcatttgacagtcaccatgacaatcagacagaaattacagataaagagttaacaccgcatggaaatatcatttcaacgcaaatgagtgattggcatgcgttgtacaagatgcaaccagatagtctgtgcagtaaaacaaaagctaaactcctcaaaatcgcttaaatttctctggccggtaaaccaagtgactagctgatataaaacctccacgatgccaactaccagttttgcagaataggcaagaaacctgtttcagttaaaagtgaaattactgttagttttcaaacttttgacttgttatgcaaaagggagataagcacaaaaaaaaaaacacaatgatagcaaaatatattataccaaacggactgcattatgctctgaagacattatcaactatcaacacaaagtcacaaaattatgaagaaatcccacacggtaggtttctatcataccacaataccgagagatggttgtgttccaagttgtgttccactagtcaaccaggacaccactggatcagataatgcagatagccgccaataaatagtcattaacgttttcaacttccaatgctaagactcaccaatttctacatttatgcataataagggatttgatccatcatcaggtaaaaaatccagagcaaaccgatctcagggatctcaggcaattcctcctgccaccccaattcctttttagtcaggatggggctatcatcctaaactggattgggacccctaaacaaggacaaagtatgaaggacacctagatcaattaaacggcaaagcatatagtgtaacacattagtttacaaccctcgagatcactatgtcactcgggctcgcatgaatactagttaacagtaggaaactgacatattagattaacagatattgaggtcattggaggcaaggctgtgaggaacaggttgatgagagacccatcaaccaaagcatagcctcgtactatgagaccgctgaattttatctagggccccaacttccgagcaccccgcagagaacctgcaggtatttcgaagctagcaaaagagcttcccccattggcatggagcccttagacacaaacataatgatcactcacaccaaaacctaacaatgcaccattccatctaatcaggcaacaactgtcacaaatacagaatccagggaacaattgcacaagattctgaccaaccccacgagctcgatgattcaatgaacaataaacataaccagaagcaatagtcaataatacatcaccacattgtaaaagcttgaaacaattggaactaagtacagcactctaccttagatgctgctagggtacatgaagacgcggaccttcttgccctgcaccaccaaaacaatccagcataaaacatcagaaatggaca

SEQ ID NO: 42202 - DNA, 1501 bp, Oryza sativa
ttgtggggcgccgagcacaaacttcaactccttgatttggaaagcctgggcaccggggaaatgcaaatttcatgcttggcttatcatccagaatagagtctggacatcaggtcgcttgcgattagggggtggcaaaataacggttgttgctctttttactgccgcgaggctaagacggcactgcacctcgttgccacttgtagatataccaagatgatttggcaccttgtctctgcatgggtgggctatcaacagctggagccgactgaatgggaggaaacccagtctgtcaaacaatagtgggagagcctcgcaaacactcctagtgtcccaagaagggggcttcgatcgctcatcctattagtcgtctgggaaatctggaaagagagaaatcggcggatctttgatcataaagaggtggcaacgagttttctgctaacgagaatcaaagaggaggttagcctttggactttagcaggggccaaacggttgcgtgagttaatcccgcattctgtatagtgtacatctatagtgcttctctttttccctttgtcccttggggttatattttctcatgttcaattcaatgaaaaggcactcgtgttgttttccgttaaaaaaaataacatttataaaagtaaggtgtttatataaaaaaaagttgcatatattatgatagtttgtttaaatctagtaacaccaattttacatgattgatctttttaatttttttactatcaatagtcaaaattaaaaatgttaaacctgtcactattctaaaaatgcttatattttggagcggagaaagtattatgtgcggccagcagccaaggacaaagacaaagcatgttgcaattcttgagtaaagggaaaggagcaaataatgttagattcagagctctatccatgatctgcaaaaaaatatatcaaaatcgtccatataaatcaacaaattgatagccttgctaggtgggaaaagaagggatagccctgtaatatgaagctctgaacttgatcttgacttcttgctcctgtagatttagctgaaacaaaccaaaaatcatgcactggactactggagtaaaaaggtactactagtagccaccataattatcggcgaaagggatgtttagtttttcagcttagctcagaaaattatgaatatcccgaaacgaagatgtaactgaaatcaggagctaaaactgatttgttttccctagctgatgaaagatttggtttcatccattgagatccggagctattttttttttcaggctagcatgtcttcctttctcaagccatcatggaaaccacctcactggtcactgcaaagccagcagggagccaactcttctagcttaaggtattgtacaactctatattgtactcccgatattgaacagtgcaaaatgttgagctcagtgaatacccaattttattcacatatatacatatactgatattgaacagtgcaaaatgttgagctcagtgcttcacttgt

SEQ ID NO: 42203 - DNA, 1501 bp, Oryza sativa
gaacaatccattgatgatgtgcacgtgtttgtctgcaaccttgcgccagtgttctgggtgacggttgtacatgcatatggtcgatcgagccggccagaggtggtgaatcttgaagatatttggtgatccgatccgatccaatgcagacacttttcatcttatcatcatgttctaatacattgacgtgtaatccttttaacgtgttcgcgaaatcttcatcatcatggggtgcctaattcgatcatgccgcgtaatttatcaaaacttctacaatattgttcaggacaattctcaactgatcgatttcaatggaacatatacatgcatgcatgctaaactagctaaagtaaccaacatctcatcatctagctagattcttcttcctcttcttctgaaggatcatcatcatcatctggattctggatggggaagaagatcacttcctgctcctgcatgcatggatcaaaatatcctgcagggttatggataaactcgaggcaatgactggctgttgcgtagccaattgtcgcagcagccaccactgtccactgctgacacgaccggccggtgttgggtaccaacgacagcagatgattgtaccaccacattggttgccatcagttcagtgcattctctcgtcaacctggcctctctttcacaggcagcacaccgaatcgcccagcaactagcacaccggaaagaaactaacttaaccttcagtaggagtcatgcattgacgtcgcccttgatcgctagagctagctgcaactcaaggagaaatggaacacctcaagcagcttttgtagaaccaatcaatatataattgtgatcagtttggatgtaattgcgagccagggcataaacgtcgccgcacactaatacactatcatattctaatgcaggagttgcagaatattaacccattgatgccaacttggattattctgtaagtaatatgcacgcatgaacgtgtgttagttttgtaaccatgtcatgtcatgtcatttaaagtccaaattaacaatgtgtgacgcatcaaaaaaaaaaaaacaatgtgtgattccttcgctatatttgtgggcggacgcaggctagtcgaaaccgtgaagggatcaactgatggcgaagttttagatcagtggatatttgcatgattaattagttactcgatctgacgacctgactttgtcgttgcaaaggttgcagtagaacggactaatttttttctctctttttttaaggaagaaaatctgggctggatgatacgtacactatatccactttactttttgttatggccggaccttgaatctatgggaagattttgtagctgcagccaactgtttaagcaatgagatacttgtctggtggttgcccactcagacgtgtccaaagatgaaaatgatatgggatttcatggcatcttctcgatcctaatatattgacaggccaagctttaatgtgatcgtgaaaattaaaagatatagaatattgtagctcg

SEQ ID NO: 42204 - DNA, 1501 bp, Oryza sativa
atataccagtggatacgtgcagacaacgagcaatatattaatcgtgatagtggcaaattcaacgctttcacctctcactaatcgcagttgcaacccttcaaatccctttcgttcacgtcaactctttgggtgctactagtggtcgagaataaggggatttaagccaaccttgcttggtcaattttgtggatcacggtaatgcgattggttgactacttaagcagttgtggatacgtcttggtaactatcatgtgtaaataaagttaattacttcattaccgacgaactaataatcaaggtgtagcttgcaattgttaaggcttaaattatgtgcaactgattaattgacatactaattctttgtgctcggtagcatgattaatcacattgattcgagcccagaaattattgaagacctctctctatcttcccttttattttatttttaaaaagaagcaaattcttgaacttctcatcttaggctttggtttagcattcaattttgcagagaagcgttgttttgtccatagaaatttgtcatgaatcattgtctttccgttgtcacaagccgttgttgtaatctgcaaggagatatccttgataggacagtaacaaggggtatatagggcatgtttagattgatgcccaaccaaaattttggtagtgtcaaattttgggcaagttttggtactatcaaaattttagtagggtagagttgaaaatgtttatttggattgaagccaaaatttgcccataagagacaagttcataggcaaagccaaatttatggcactggtagagttttagtagagatgtttggtttgctaccctaccaaaattttggtagggcaaattttggtagggtagcaatttaaattggcccataattttaacttcgagatcttgtatttaatccctaactcgctacaatttatacttaaaaagtatttagaagtacgactctcctccaaaatctcctcctgtttttgttgtcgcctgcacgagtgcacgtgtcagcttgctggtgcaagcgatcaatcggtgaccgcctgaccagccggatcgagatcgatcagatcaggcgccgcttgcgcctcagctcgagccgagcggatagcggcgttgtcctacgtgcaaatggcgctacgcgctaatgaacaaagaacccaacaaatccaacgcgacagccggatcgatcgccgttaaacttgtggatcgataagatgatgatgatgagaaaaggtgaaaaacaactgggtttcgccgcctaattgagcgcgcggctttggctccccgcgcccgctcgcctcatcggcatcgccgcatcgccggctgtgcctcgctgtcgccgtggcccccgccagccgctccccgtttccgcacgtcgctctcggctcgctgcagctgagctaaaagattctgctttagctgcgtcggattacgggctttgcggtttgcgatcaacaccctctgaagatgtaaattatcgcgcattttgccc

SEQ ID NO: 42205 - DNA, 1501 bp, Oryza sativa
ttcctttattgaaaagaaactcaatcctcgtgtgacatgtttggttgttattaactgttttataattggagcgaagtcacgcattattagtctgactagaagatattactgacgacacctgaggcaaaagaaattcatatttgatatgccttgttctaaattggcaatgccgttatgaaaaaaaaaagtacagtccattagtgactgcgtgcatgacgaccaataattattctggattgagcaacgaaacacaaaagaatatatagaacgggtaacaagattgaccttgtaaaatggtgctgcttcaattatgagatgtatatacctgttagatgtaaacaattttattgagaatttctctgtaagaactttttttaacgaggactttttttttttgaacaaactggcaagccgccaatttcattaaatagagatggagtaaattgtacaaaacccaaaaaaaaatgaaaaaagttacaagctcagagcctttggaccgagctaaccacataatgagccagttgccaaggttcttctcacccaccaaaacacatgttttggcttcctctttaatcttggctaggaggctggttgccaggagctccttttgttggaaggtcccgcgaggccactagcaacaggagagtttaatttcaaagtaatgatatgcacttgctagtgtaatggtattgtagtaggatgtattagtttaaccatatgatccctttattttggttctcaacatgataatattttatttttaattatttgacaaaaagattcccccggttgctcagtccttttaaaaatcaaagctatactgttgcataccatatttgtggatacactttgtacataggccgtgtttagatccaaagtttttcttcaaactttcaactttttaattacatcaaaactttcctacacacgtaaacttccaacttttctgttacattgttccaatttcaaccaaacttctattttcaacgtgaactaaacacaggcatactcgcatttagtttcaaagttaaatgtcattgcacaaaatgtatttgcggatacattcattatacgtactacctccgtcctaaaatatagcaatttttagttatgaatctggatacacagttgtccagatttataactaaaaatgattacattttgggacgaaggaagtacatactcgctgcagtatgcttggaaaaatatttttactattgcaacttatacgagccaaagaccgttgacaagctagtcaacagtcattagcgtacctgaccggctgactagtccatcgatcgaggttacacgcatgacgtacataataggctactatcagaattcttttttagtgcaaaaatttgcctaattttagtctataatttgataccccatcacttacgctcgcttctcctactgaacaagtcaagctctcctcttcaccgctatataacgcacactttctccaattctccatccaggtgccactcaaagctcacac

SEQ ID NO: 42206 - DNA, 1501 bp, Oryza sativa
gtcacactgccatgaatcatgatgggtgaagctattgatgccaacggataatactctaaaactcatgttggcatattgtggttaggcaacattgacctcttcataattcaaagcaagcaaaagctagctctatcatgggcaagctgggcagtatcttctgaatccatgacatttcagacttcagagttcagaggatcgaggtagctagtcagcatgaccagttcaagcatcagctatctttgttctatctgagaagcctgtgattaccattaggtattgttatctgcacacacgtaagcgttgaaaaaaaaaattcacagtagttagtctggtcgtaacactgacgctagctgtatgagaaacttaatcgagtgataatttactagtgtatatttttattctgttcacacagtaactttgtctgaacaagaacgttaatctgttttcttttatccccctgtggtcgttgtcatgactgcaataaaaatacgtacagaagtagagaaatttgcgagcaaatgatttgcctctgaaagtctgaatcgaagctaatctttgtccaagtcagcaataggtattataggtattagtccacatcattttatttttttatctgttattttttacacccagagtctgattatttatgtcacagctacgccatcaaagcataagaaaaccaaacatctcaatctgccgagacctacacttgcaaagtctcgtcaacacacatgcgagctcgacatcaacacaccaccatccagacaatgaacagaagcgtcaacacgtacgcagtgcgtaattccatactacaatatcacgtatatactctctcagtcttcaaatactactttaaaattattttttcatgcataataattcaatattattcaatagtgtaaagcatatattgattttttttgttttcagaaaaattatgtcatgtttttttaatattctgcagatgaaattttatatcacataattgaagccgtcgaaaaaaactgagatggttataaagagattattcagcccaatcatgaacgacatatttgcaaacaaaaaataatctgtgaaacttttatatatgtgttcttagtgatttaaaagcaaaggatggaaaataaaccttaatgacaaaaccctaaaattaactctaaatttaaaatttggctgataaacataagaaaaagatgaggctctatgttaacaggcccattttccctcgcaaaaaaaggactataggtccactttgtttgtaggcccatatattagatgggcctttcatcttgggccttctccgacggggatctcgatgcacatccgccgtccatctagacgcaatctcggccgtccaatctaccacaagaaacttttaaaaccccacatgccctagggctcatctcatctcattcccctgcgccgtcacttcccctcctcctcggttcccgccgccgccgccatcgccatctccaccctcctcggcggccgccggcgacga

SEQ ID NO: 42207 - DNA, 1501 bp, Oryza sativa
tctgagtgagattgaagagatcttggagacaatcagcacggcggaattccagaaatgtatggtacctttgtttaggcggattgctcaatgcatcaagagctctcacttccaggtaacttgcccaaataaatataacctatcgatgtttattttctgtttttgccactatgcatttccctcacctaagaaaaataatatataggtggtaaaaataatatatcggagtactacatatgaaagtagttgtggccctgtttgattgatcaattgccacgctgatgaattactatactagtcgctaactctaccgcttcacctagacattttattatataggtggtaaaattttatgtaaacatcactcagttgaaatggatcatgatcgtaaagctcacatggtatatagggtttttttggttgcatcatttatgtaaggtatgaaagcattacctgttgacttgccaaatggatgagataatagatgtctgatggtccgaaataaatgtggacaacaatagtgggccattatgttatcaactaatcatgctttgggcatggggttgctctgtactgttaatatcacaaatgtgagatatttggaccagcattaagaattgaagacatttgtctgccatgacagactaatgctttttatccaagtaattgcctcaacgagatgggttttttcaggttgctgaacgggcgcttttcatatggaacaacgataacgttattagcttgattgcacaaaaccgccaaatgatcatgcctatcattgttccagcattggaacataatagccagaatcattggaaccaagctgtcctgaatctcacagataatgtaaagaagatgttttctgagatggatgacgtgctcttttcggcgtgcctggtcaagtacaaggaggacgaagaaaggcaagcttcactggaatcaaagaggaggttaacatgggagaagctagaatcagctgcttctttccagccagtgacgggccatacagccgtcctggtaggccgccaaccctcagcaaatttgattgccacccttatttagcatgtgttcagtggaggtgaaaaattagcatgtgttcagtgaaggtgaaaatggggttcttcactttctggtgatgctcaccaactgaacgacttcagacttcactattttccccttatttcttttttatgtctgtattagtaagcagtgctgtaagttgtaactattttcgtatgtttatgctctgaaggcaaagcatgtatcgagtgcttaaactccttacctgtatctttgcctgtttatttatgagcaatttcctacgcctaaactcactcttcttctggtcatggttgctcaagcaacttctaatacgttgattcagtttggtagtatctcctaatgtggtattcttacaacctaaaagggcatctggtgtgcttgcaaataaaaattgtaagatgatctacgtaatgacccttgttgatttacatgccataaagct

SEQ ID NO: 42208 - DNA, 363 bp, Oryza sativa
cctgcagccctgacttgtcggtggggttcgaaatttcagaattttccgagaattttgaaccaaaatcgctatcactagtcatgcgagcacgaagaattagggaacaattcaatatgaattcgggttaaacccatttatgcccaaaaataccagtccaatccaaacccttttttcttttttttttttgcctcagtccaaaccgctccggtccgttagctcactcaacccatctccacccaaataaagcccacccgtagtgaaaagggtaaaatccagaagaacaccacgcacaagcacaaccttgaaaatctgaagagcacacgaagccctaattaaccaaaacctccgccgccgccgccatgg

SEQ ID NO: 42209 - DNA, 551 bp, Oryza sativa
cttcatacatcgatatttgtatgtctggcatagttcaaatagagatgaattattgatgcagggtagctcctggctatggtggacctagaaaaattcacctgtaggatctgttataatttattcctcaagtactatggtaatggtctagggatcactcccacctattggtggtccatttagtattatttgcactcaaatgaactagaaggggtcaatgggtcagcctgatctggtccacttgcatccctagctaaactatcatattaggtaggcaatttcttataaatgtataggatgatttaactgaacactcagtagctgctactcatccattgcggctttcatttggttactgatgttgccacagccaaatcaattaggcgcaaatctgttccattattacctgcttgatgttctgttacatatgttttgcaggcacacagccataagttggtgttccatgagcttataagagtgatgccattattggcatgtttctatagcatctagcatctcccaatgttatgcatgtactgggctcccttaaaaga

SEQ ID NO: 42210 - DNA, 1501 bp, Oryza sativa
accatccatctgcaaccgtccatctgatcgtccaattgatttttgtatgtaagcacagatacgatttggtaggagtgctagtaatactgatcttgtatgtaagcaccttggcatctcctgattgcatatgtgagaatcatgcctcaaaaaacacagcttacaataattttacatatatcagccaaacttcatccagaattcagcacacattggcgacggcggcggcactgcgtcgagctgaggcgaggggcgacgggagatggatcgcatctgacaggtgggtccaggggcaaaaatgtccatcaacatgtgaaaaataataaaaagggataaaaatagtgaaagtggtaccaaatctaacaattagagctaacaattagcagctctagtgatatattatagagggcatatggattaagtggtaaaaaaattgaggcgcacaaatttgatagtaaatagtctaaattctcccaaatcccaacctaatcctagaacatggtggccgcgcgtggggcaaggtagcaggctgtggcggcgagcaacagccggcgcccgtggctgggcggcggctggctaggctggccagcgaggatcgagagcagcaagcggaaagttttctgtaagctaattttagcctcatttcgcgttttatgtaggtagaacttgattgttaatggcaaactgaatcgatgctgccagccatcttcttttagagcaacaccaattactactagtatagtaattacagcatctgaccatagtgccgtaaagaccgctcaatatatagcagggaaactaactagcttgtgtcgacagaggacagagtagctagcttgtgtcgaacggtaatgtagcttcagtagaagccattctcagttcacctttttatgtggctatgagaatgagtgctgtccctttctcctttaaaccgatctccaaggtgaaagttccattaaaatccagtgtgtttgtgtggtgattgttgaggaagtgtatcctcaccacagatatcaagacaaagggatgacatgttggttcatcatttgtgtcaaattttattgaaattatgtagaattctgccaatttttttttcatatttgtcaaatttcatgtcaattgaattctgtgaaaatcaggttgaaattgggcaagtttcatgtcaatgtactttgatatcaaaataggggggatgcaacatatgtacaaaattaggggcaagtatgcaacaataatcaaggctatacatgtttttttaccatagacttaacactgtcaacaggagttaacaacccagggtcaaatcgaagctttgattaaaaaaacaatggcaaaatcacaaaccctacaaaacatggggaaaatcacagggcctcatcttttagcttatgcttatacttatgagccaaaatttgaattttcaaccttaaatttggagttgattttgaggttttttcattaaagtttatttttcagcctttacttttagattgctaagaacacg

SEQ ID NO: 42211 - DNA, 1233 bp, Oryza sativa
cgctgccccgatgccgccacaccgccgttaacgaacgagcatgagatcgatcgaacgaacgagagcgagaacgagaacgatcgaacgaagacaagcgagaacgagggaacgaacgtgaatgagaacaagcgaacgaacgtgaacgagctagggaacgtgaacgagcgaacgaacgaggacgaacgttaacgtgaaatgcaatatatatatatatatatatatatatatatatatatatatatatatgtatgtatgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacacacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 42212 - DNA, 1501 bp, Oryza sativa
agcgatatatacgacgaagcaaatataaaagagaccgagtcaatggtggcaacgtgatgtgcaacttggaggacgacttgtgttacatagggcttacatttgtttctttcttcatcttccttttcttttcttaaaaaaacaaacatgaggacaaagcctgcattgtcagataggtttcacactcacacctatggctatactttagtttggctatcaactctcaagtcgacgaggcacatgctatctggacttccaacttttgtcgtccgagcagaaaagaaaattattgtttgccggcgagagaagcacacagaccactatattgaatcttttttataattctcatttaatatttcattagttctctttgataattgaaaaatattgaaattgtcaagtgtcaaccattctttgataataatttgagggtgaatagccaatctagtccctcaagttttaccagacgctaaagttagtccttcaggttttattttgtacatataaatcctttaaaagtatttattttggtttaaaattattcttggacccacttaatatgccacatggatatttctagtcaacgtttctattagaaaattttccctttgcccttaatatgcatacattagaaaagagataaacaatatgaataaatagcactgcagatgtacttcctattatttcaacatgtgcacataaaggttgagcttaatggctatcatatatacacttggaagcacgtacttattttcattttacataaactactatgcattatctataaacaaattcattgcatgcaaatttcaatgaaaaaagactatgtttagctatgtggtttctaagtggatttaaaaataaatttgaactaaaatgaaaatttgaaggtatagcatggatagactaaaagattaaggactaaactgagtctgagatgaaacttggagtaccacatttgctattcatccataattttatggtttaaattggcatcgggagaataagagagagagagaaaagggtaatagttagacatgttgagattataaaagagtgtcttgattgcttcaattttgcgttaccttaccatttcttatatagttgtatagagtatattattagaatattgattgaaattttcagcctccaaacaaccccgccaacccccttcctctgtctcctataattaaacccggcggccggcgaccaccaccaccattacgacgcgcgcgacgtcgaccaaagcaagcaaccaattcctcctcctcctcctcctccctcctcctcttcctcctcctccgcgtcgagcgccatggcgagacccgccatcgtggcggcgcccgcgctgctgctgctggcgctgctcatcgcgctggccaccgggggagccgacgcggcgccgggcgaggtgccgctgagctgggagctcggggttgtcggcgccgacgacgcgttcggcttcccgggtgaggaggcggcggacagcgccaccgcggtggtg

SEQ ID NO: 42213 - DNA, 1501 bp, Oryza sativa
tgtgtgtattttgtttataaactacatttgattcctctcaaacttgagaaagttgagataaagaaaaggagaaaacatttcatgtttaaatagctaaaaggagggagcatagacagttaatcctgtacgttccttacctgttggatggtggatccgtggctactgccaaagttgcagtcactcccaatccccattgcacgcctgccctgtagtgcaaatcatatcatattaatttgtttttacaattgcataattgcattgcagcgatatatacgacgaagcaaatataaaagagaccgagtcaatggtggcaacgtgatgtgcaacttggaggacgacttgtgttacatagggcttacatttgtttctttcttcatcttccttttcttttcttaaaaaaacaaacatgaggacaaagcctgcattgtcagataggtttcacactcacacctatggctatactttagtttggctatcaactctcaagtcgacgaggcacatgctatctggacttccaacttttgtcgtccgagcagaaaagaaaattattgtttgccggcgagagaagcacacagaccactatattgaatcttttttataattctcatttaatatttcattagttctctttgataattgaaaaatattgaaattgtcaagtgtcaaccattctttgataataatttgagggtgaatagccaatctagtccctcaagttttaccagacgctaaagttagtccttcaggttttattttgtacatataaatcctttaaaagtatttattttggtttaaaattattcttggacccacttaatatgccacatggatatttctagtcaacgtttctattagaaaattttccctttgcccttaatatgcatacattagaaaagagataaacaatatgaataaatagcactgcagatgtacttcctattatttcaacatgtgcacataaaggttgagcttaatggctatcatatatacacttggaagcacgtacttattttcattttacataaactactatgcattatctataaacaaattcattgcatgcaaatttcaatgaaaaaagactatgtttagctatgtggtttctaagtggatttaaaaataaatttgaactaaaatgaaaatttgaaggtatagcatggatagactaaaagattaaggactaaactgagtctgagatgaaacttggagtaccacatttgctattcatccataattttatggtttaaattggcatcgggagaataagagagagagagaaaagggtaatagttagacatgttgagattataaaagagtgtcttgattgcttcaattttgcgttaccttaccatttcttatatagttgtatagagtatattattagaatattgattgaaattttcagcctccaaacaaccccgccaacccccttcctctgtctcctataattaaacccggcggccggcgaccaccaccaccattacgacgcgcgcgacgtcga

SEQ ID NO: 42214 - DNA, 1501 bp, Oryza sativa
aagagaaaacatacctgaaaatgacttaattactgttagaactgttctaattacagatctacgagacactccgttactccgtagaaacctatgaggttttttgaggaaaaataatgaaatttaggaataaaaaaaggatctgtctattaatacagaaataataaatctaaatttccgtaatgattatccataaatggatgaatgctaaagccatattattgattttttttcttataaatgtatcgccatatctttcataaaaagtattcagcatgtatttacattgtaagtccctaaattactgtcggtgacatgggatcgggagtatcatgactagaggcttgggcaggagcaatcacccacgtggcctgaccccctcggggggggaggggggtcgggcccgagggtggtatgaccgcccctctctttgtctccccgaggggtcggaccgctcccgtttcggccccgagggccgaggcgccccgaccccttgtgggttttgcgccgcgtgtatgagttaggtgggcacagcggggctcacctaaccgcatttattgcggtttggacgagcgcgtcacgctgcatgtaacgcagtgcagcgcactcgtttatccggtctgtgaccggtcacagaccggtcagatcgcgggttaggtggcaacaggcgatctgacacacgcctcgccccgtcccgtcaggatgagagcctccaggcactcgtccctagccggagccagcgtgctagctcctggagatggcacgttggtcccggtcagatatatgccaggcttcatcgcaaccattaaaagcaagacattgtatgaagaagggcgaacatgcagattggtaaactgacgcgtggtggacaagaacggtcatgatcccatgttgcacctgcttccggcggagtggaggtaggtatgggctgtcccatcagaaggatcactcggacagcaaccattgcaaatctccgcccatttatgaaggaaggacgggccaagttttaggaaaaagaggatgggtccccaccgaaaggagagataggtagaagtggtgcatgtggtatccccttgatatataaaaggaggaccttgcccacttagaggggggatccgaaaaaaagggaggaccaaaagacgagagctgggagagaaagaggaagagggtctctagagtttgaactctcttgctctccagctctttgtagcttcttcatacacagatccaccagaacacaggagtagggtattacgcttctcagcggcccgaacctgtatacatcgtccgtgtcttatgcgtttccactttcgcgaacattccacagattgagagcttagaacttcacttagcgtccccggccgaaccggcaaaggggggcctgcgcggtctcccggtgaggagccccacgctccgtcatctggcgcgccaggtagggggcgcgtgtgattttctaagccctcatactctttcgtgcgcgccaagcttttcctgttcagcccaa

SEQ ID NO: 42215 - DNA, 887 bp, Oryza sativa
ctgtcctcatatttttagatagacttgttatttttttgttagaaaaatgagttgccaatagatatgtgcttaaaatgtacgtagtaatttgatgagaaagaaagcatttggttgaattaggagtttacacagaatttccaacgaattatgaaataataatttttcagaatttccaccaattatttaattttaccaaggctatgttctgttaatctcttccaaaaagggtgagggaggatttactagaatcgctccaatcgatttaactgaaaagccctaaatgattccttaggaacgacgggtgatctactgggcactggccgtccattaagtgttttaatctaagtattcagtcattgattaaaattatgtttgtggctatctactatatactcctattctactacagctactcgtactagccaatgtcccgtgtgaatgcatgggcgaatgaccggacaaataactatgcaaacttaattccagttaattagtactcctactcgtactgtagctactggcggatcaaaatagttatgcaaacttaattccagttaattcctccctccgtccctaaatatttgacgctattgatttttttaaatatgtttaaaaccgttcgtattatttaaaaaatttaagtaattattaattatttttctatgatttgatttattgtcaaatatatttttatgtatattgtactgtaccatcttctagatcaactggtcgatcgataccaataatgattatcgttcacttatcgctctccaggattagtgctcaacagaatccgatccaactgccgttaattaaagaaatcgaacctctgcatacaggaagaaggaacactagctttattcttgacgttcctcttctcttttaga

SEQ ID NO: 42216 - DNA, 177 bp, Oryza sativa
cacctaaccgcatttatagcaggttggacgagcgcgccacgccgcatttaatgcagcgcagcgcacgcttatccggtccgtgaccagtcgcggtgtgtgaccggtcacagaccggtcagatcgcgggttaggtggcaacaggcggcctgtcacacgcctcgccccgtcccgtcggaa

SEQ ID NO: 42217 - DNA, 1501 bp, Oryza sativa
cgactcctcgcaaagatcggcaaagtgaagttaagtatagttttgatgtggccaagtgtgataagatttttgattaccttttgcaagaaaaacaaattagattacctaaaggccatgtcataccattgcaagaagagttgaagcgtcgagcatattgtaaatggcatgattctcattctcactctactaatgattgcaatgtgtttcgacgacaggttcaattggccatagatgaaggacgattgaagttcaccgatggttccaagatgaagcttgatcatgatccttttccggtgaatacaattaatttcaatgataagaaggtgttgattcggccggagcaagccgaatctactaaggggaaggaagtggtcattggggaaccaaggtccaagatggtagtgccaaagaaggcggaggttggcgtttggaaggagaataagagtggagcttcaacttctaaggctcctaggaagaccaaactgacctttaatatgcttttggagaaatatgagaggcaaggtggtgagaaaattcgcaacaaagggaagagaccaagatcacctcctagggaacgatttggtcattcaccaagacggtcgcattcaccttcatatcatcatccacaagatatgtcatggggtccctattcgatgccgccgccgggttattcttatccctacttcatgccatggggggcaacgccgccaatgtaccatcatatgcctccaatgcaattcaaccaagggtggggaggaccaaggaggccaattcatgagtgattgtcttctccaaacaatagccggttctatggtaagaatcgggttaatgaagaaaagagggaaggaaaacgcgtcaaggtggaagagaggacttcggaagtaattactatcaaagtggggtcccatgatgtgcctataccttctggagatggagttggaaagtccccaagcaaaaaatccgaagccggtaccagctcctcgcagacgaccggtctgaccaggccctctggccagtctgaccgcggccatgttgccggtctgaccgggccataaggccggtctgatcgtcgacccgatagtggtccgaccgacgcctcaggccggtctgaccgtgtgccacacatcggtctgaccggcgcgtctggccggtctgaccgggctccagcgccggtttgatgagaggattgtaaagggcgatgtgagggcttcatcgtcttcaagcaaagtcaatagaggacattatttacctcctggaacagagccgaatcctaggtggatgcctgaggatttgacggctactcaaaagagaaggttgcaacgtcttcgggcccaagaactaagggagaaaaaggccgaagagcaaagggataaaaggttcaatgagttgctaccaccaccaatatggaggcctaaatccatagagaaggcaaaaccgattgatgtagaggagaaggaagaacaatcggttgataaaagtgaatcatctccaaagaaagaca

SEQ ID NO: 42218 - DNA, 1501 bp, Oryza sativa
gatcaatctaaagtggctatgagagaggtgcatgaaggaatttgtggaactcatcaatcggcccacaagatgaattggttgcttaggagagcggggttctattggctgaagatgattgatgattgcttcaaatattatagaggatgcgaggcttgtcaatggttcggcaatgttcaattggcgcccgccgccgtattgaaccctataatcaaaccatggccgttccgaggatgggctttggatttcattggtcaaatttatccttcgtcatcaaaggggcataggttcgtgttagttgctacggattacttcaccaagtgggccgaagccgtacctttgaagaatatgactcatacggaggtaattgactttattttgaagcaaattattcatagatttggtattccgcaaacattaactatggaccaaggtgcttcttttatgtctaaggaagtgaagagttttatcgaatcttatggcattaaattgttgagttcttctccttactacgctcaggctaatggacaagccgagtcgagtaataagacattgttaatgctagtgaaaaagaagattgaggaacacccgaagaggtggcatgaggtgttttctgaagcattgtgggcgcataggatatctaaacatggtgccactaaagtcactccttttgagttggtttatggtcaagaagccgttttaccggtggaggtaaatcttggttctcttcgttatatcaagcaagatgatttgtcaagtgaagattacaagatgttgatgggagacaaccttgatgaagtcatcgacaagcgcttgaaggcattggaagatatagagaaagagaagaagagggtggccaaggcgtataacaagagggtgaaagcgaaattgtttcaagttggagacttggtttggaagacaattttgcctttgggtactcgatccaaggagttcggtaagtggtctcctagttgggagggtccttatcgagtgtgcggcattgttcgagggaacgcatactttttagagacactacaaggggagcgttttcagcgagcaatcaacgggaaatacttgaagaaatacttctgagcgtttggcaagacgcttaggaggtactatggcctgtaattgggttatcgtcctaagaccaaaaacatgttctatgcttttagattcacgttgttcatcaaaaaggcaggggggcatgtgtttagacccaaatttggcagttaggattaaaataggaaatattgccgaaatttgaaagtccaccggtttcctctgaagtgggccggtctgaccgctgtgtgttgggcggtcagaccaccggttgagggccggtcagaccggcggtgtgtggccggtctgacggcaggtccgagtcctactctgtttcgtcgggtctcgaagtttccttgctcgggaaggcatgtttcgggtttcctttggtttctaccccgagttggacgtggaggagggcctgtagagggcaagaccaatt

SEQ ID NO: 42219 - DNA, 1501 bp, Oryza sativa
ttaaatttacattttaatactcatgttgactaggtctttttagaaaaatatcatatgggtgccccatatcatagacagatgttatgcaatagatgtatattttctttgtctttattgacttacatgcaaatatgtaacaagttatatgcatttgaattagaggtaaggatagcttgatacacatacaatatattcattaataattttttagtatttcataagaaaagagcgagacaatgaacattcaattaaaaagaatggaaaaacatcttacttttaatttgaaattaacttgtcaggcatgtttttaacaaactaatacacatgcccgcgtgtcgtgtgggctaccttcctagtttatacaatatttgtgaggatatggaatatcaacggtttgggatttaaagctaagagatagaatatggcattcttggacattgtatagaaaggataaattgaagaaaatgaaagatttgaaaattggcattagactaaaagagaattttctataaattcttgagaataataaaaaaactaaacaatttcataaattcaactcaagaagtagaaataaaaaagcggcatgatgcaatttgaaatatttaaattttgaggacgttacactacttattagataaggcatggggaaagaacccggaggacagcttccaatcaaccgatggcttcttgcaggataactacaccaacacaggcaccaaaagtaggcaattgatcatcaccaagcggcactaatggcttcacctcattaatctggtcagtaccaccaaataccgcgatagattgtattttggtgacctgtttaggcttagatttcatatcttgttaaatcagaatcttacaactatgatgaacagtacccattaactatctttttttctggagagatatttgtttccaggctattgcagctttattaacgctacatgtcaagcatagtcggcagctaatgtaagaggtaaattttgtctagtaatggctggtagaacatattcggaatacttgaatttgtccttcctaggcttacaaaaaaattggcatgaatattggaaagggtaaacatttctgaaatatgccttttatcatacaaatatactttcaacaatgcaatcttcattggtcagcatttctggaacacaatatgatgaaaaggtacacatgtcaaacaaacgaaagttttcctctattaaaaaagacaatttaaattactaggaaaatctgataattcaaatttacatcttttgaacaccttatttatcaaatgctcatcaaacgatgaaaaaaatgcttcatgttgattttctatttaggggaaattttagagttgtgtttttctggtaggaaatagatggttctccaagttagctcttatttgtccgactgcaggaaacgttctgcaaataagaaacacatgatcaaaaccagaaaagactcaagtcactggtggagaaaccctttgtagttccggttcgtaacccccctt

SEQ ID NO: 42220 - DNA, 643 bp, Oryza sativa
agttggcaactctacctgaagcaccaaagctgagagtattagtatttcccgaagataaatcattgatgtggttatccatagcaagatatatggcaacactgtccgatgtcagattaacaattgcagcttcttcctcacaagtacaatgtgcaatacaacaggtcagtggtacagaagaatttagtcataaaacttctaatgcaactatggaactacggggatgttacttcttctgtatggattgggaatgttttgtgaacctgcaagatttagtaatcaactgctgcaacgaactcgtctattggccactgaaacagctccaatgcttggtatccttgaaaagattaacagtttattcttgcaataatctgactaaatctggtgatgttctagaagcgccattagaaaaaaatcagctactcccatgcttggagtatatagaaataaaagattgtcccaaattggttgaggttctcatccttccttcatctctaagggaaatatatattgagagatgtggtaagctcgagttcatatggggtcaaaaggacactgaaaataagagttggtatgctgaaaacaaagatgatttgaggtcagaatcttatagcatcctagtatcctctgcagatgcacctttggc

SEQ ID NO: 42221 - DNA, 1501 bp, Oryza sativa
caacggtgcgatgctgctaactgattgcatgagttccgctctcacaattcagtgtacctatactccttgaaaaagaagttgaattttgtggctacgtaacacactgatgagatggttagtaatagcctaaatgcagatctcagcagtaaaaaaaaaaagaattcaaacgtatacgcgcagcaaaataagggtgaaatcatcaaaagcaatcaattatggccatcctgaagattttagtttggcagtgcttcagaagtcctaacaggaaggaggccatgtggatagatgatatgtgtaaacaaaaataattccaacatacataaaaatgaaagggagaaactgcagcacaatatacatactagtttttggtcgtttttcctgaccattaaataattccaacattcgaaattagtcaattatagtttcctcgtgatatagtaaaaacttttagagtacaggccaattccaataattacaaacctaaaattaataactataatactaagttaggactggactggtcttgacttgcttgtctatatctttgtgctgtcacagttgggacccttccagataagcacaactgtgcaatgattctttcctcatcaactgcaattattgatccactatggccatgctagttatggacctattcttgctcgttggccatgcttttttttcaattttttttcctgggacggctttgcaaaaatctgtgtatatgttaattcagaattaatttgttattgaagacaaatcttgttaacattcctccagatcaacgtttcagacaaataagtatgaccccaacgttaaaacacgtctctttaaccatataactcaatgtctatgttaagtcatgtttgatagctccacatcctttatctatgccggatttaaagtttgtatgttaaattacactgatttaaaattcgatatctattaacttattaaagaaatagaaaaaggagcctctacgttcactctcatggcctagaaattctcatattaatcggagaaaaagaaaaacagagtccatataggttcctccgttagcgagccaggctgttattcctcaaacatagcggcacaacggagcaattttccgccttaaaatcaatgcacatcgaagaaagaatgcaattcctaccctctgtcatgacggtgtctatgctaccaccgaggaagataagttgcaggcttcctacaactatttcctcaatattttggggacgtatagtccgccttcggcgtccattaacctcgactcgattggtttggcggcccacgatctctctgaattggagggcgacgtcactgaggaagaggtgaaaaaggcgatcatggcgtcaccaagtgacaaggtgccacggctagatggtttcagcgccactttcttcaaggtctgttggggaattatcaagggtgacctggttgcggctcttaacttagcctggagagcgaattcccagcacctgcatctcatcaacacggcctccat

SEQ ID NO: 42222 - DNA, 1280 bp, Oryza sativa
  unsure (1)..(1280): unsure at all n locations
aaaaagcttatttaaccgcttcagtttagttttggttaacatttgatacattgagatgcttaaacaatttttatgcataaagcagtagaattgattaatgaatttttgaaaatttgtttgtgcaagataagcatgtggctatggaattgctgcccataagagaagttcacaggacagcagcgcaataatggtacgattgataattgcactcgtgctgtatgaattttgcacagttttgcttaatgggagtgtcccattcttaaagcttactaaagtcttgtttggcacaactatcgaaggtttttaggagctaggtatttctaagtccacaaattcattaatctgtatctgcgattatgttgacaatatttggatgaatcattttgttcctattttaaataaaactagcatggtggcccgcacggattgcgcgcatcattatattttctctcttataatagcatacatattttctcaatttattattaaatatattaaaatgacaacataattttaaattttgtactaactttaccaaactaccgacgtgtaatattcatacagtattgtatatatgtgatagttattgattatttttaatatcaaattttagttatttctaaattgtattcctatatggactctaggtttttcttcctatttttttaatttcgaattttagttatttgtaaattgtatttctatatggactttaaactgtacttttaatttattatttttatttcaaattttagttaattctaaattcctaatattccttttttaatatatactcttcttttaatattccttttttaattttgaatttctattatttcttagttgtatttctatatagactctgtactcttcttcttaaattcctgtatggactctatactcttcttctaatatttcctttttcaattctgaatttctattatttcttaattgtatttctatatggattctaacataattttatttttctttttttaaaattctgaatttttattgattctaaattgtataccggcatggactctagtctccttttccaatattccttttttcgccgggacaacgaagaatgccgaccgatgtatatcccccctgcaggagggggacaaatgcagtgcgtcaaagcatcgccttcacaaccttaagcnangnnacaaaggctataatgtccctaaagttggcgctgcggcaacacttaacgagctaactagccctgctatttccatgtttcccattcatcacacatgatcacacacagt

SEQ ID NO: 42223 - DNA, 1501 bp, Oryza sativa
aggtccataactagcatggccatagtggatcaataattgcagttgatgaggaaagaatcattgcacagttgtgcttatctggaagggtcccaactgtgacagcacaaagatatagacaagcaagtcaagaccagtccagtcctaacttagtattatagttattaattttaggtttgtaattattggaattggcctgtactctaaaagtttttactatatcacgaggaaactataattgactaatttcgaatgttggaattatttaatggtcaggaaaaacgaccaaaaactagtatgtatattgtgctgcagtttctccctttcatttttatgtatgttggaattatttttgtttacacatatcatctatccacatggcctccttcctgttaggacttctgaagcactgccaaactaaaatcttcaggatggccataattgattgcttttgatgatttcacccttattttgctgcgcgtatacgtttgaattctttttttttttactgctgagatctgcatttaggctattactaaccatctcatcagtgtgttacgtagccacaaaattcaacttctttttcaaggagtataggtacactgaattgtgagagcggaactcatgcaatcagttagcagcatcgcaccgttgtaacttcctacaatcttaccatcgatgaaaaacagagaaaaagggtagagatggcctactgtctttttcataatttaatgacctagatttttcataaaggctaagcaccagtccctactttgtttagcagcttctggacatcaattgcttgtcaggttgggaatgtagcgtaatttacaacgggtgttcattccctttcaaagtaagtggctaataattatattcaggatcatgacaaattgcaacttgctgcacacagcgatggacaatgacagcacattacgcgcaccttttcttctaccagtggaggtccatcttgtactgattgattgggacgctgtccaagataaattgtggacagaccccattgaaccaccagttccctctccatttcattgatatttgtgtgtaagctctacaatgggtgaactggtgaccagcatggtgatcgggccactggtccacatggtgaaggagaaggcttccagctacctcctggagcagtacaaggtgatggaaggcatggaagtgcagcacaagatcctcaagcgcaagctgccggccatcttggacgtcatctctgacgctgagaagcaggcatctgaacacagggaaggagctaaggcctggcttgaggagctcaaggcagtggcctatgaggcgaatgaagtcttcgacgagttcaagtacgaggcgctacggcgtgaagccaagaagaacgggcactacaccaagctcggcatcgatgcggtaaaactctttcctactcacaaccgtgtcgtgttccgatacaagatgggcaggaagctctgccggatcgtgcagaatattgaagtgctagtcgcagaga

SEQ ID NO: 42224 - DNA, 1501 bp, Oryza sativa
gcaaacactatattttactcgattataataataaatgatcccgtatattgattaggaactaactaagaaataactctcacataataaatcttaattactctagatgatatttcgattaaaacagagtaattaatagagtaaaaaaataagtagaggattaccgacaactccggaattcctccaacttccactactctactctctccctaattctagtatacaatatagtacaatagggcctcttacaattcaactcaaaaacttggagtgtgtgtgaatgaaatgagaaggtgatgtccttatcaggtaatgacggttggagaacgcgaaatgtctgaagtacccctcaaccaccatcaggagaagatctggagcgtccgtgccaaacctcagtctggacggctgagattggggttgggccgaaccagcgcgaaccttggtctggcccaacaggcccagattttggcttgttactccttctccttctaccttatctatttccaggaacatgggcctattttctgataattcgatgaagttcaaaacccactcttggatagataaaagtattctctctcttaagtctaggtttcctcccaactttggtggtttatcttctgtatccaaatatacaccaacactcatggaatagattagaattaaaccctaccactatgttggatgtgtcatttattatgttttatgcaggtattggcggcatagaattggcatttaacggccgccaacaaacccccaacacttagctctttacttgttcctgagtaaaggttaaaggttaagatgtaagataaaattctccaagatataatgcaagcacataaattattcaaaacaattctcgtacctgtgagcttcagaagtgtctagcttaccatcttaggtaattgaaagacgaaacagtctcgattctggtccttcttgtattcttttgttgtactctcggggttttcatgaattttcgcaaagctggctatactcctcatattgacttatctcagatcactcaagtattttgcaatttatgtagatccttgccaaggtatattttaccaaactttatccctagcctaaaaggctgtgtatgtggagcttgatagggataaatcgggacatacctgcatcatatatattgcaaagccaaatacttggactcaagaagatagtcaatcatactctcaaatcaaggattgcacaacttgtgtggaatgaatattgtagtggtggatgggaaaaagaaataaagaaaatgtttctccttttgtgtataccttctccaattttctcctttcaatattttggaggttgcatggctacaatatctctcttttttttcttttcaatgttgctccatattttggaagagcaaagttttatttcttcatagccatacatttccctccttttctctatttttttttcaaggagtctctaggtgaagcaggcataaactggatggagagtttatttttggatggtgatg

SEQ ID NO: 42225 - DNA, 507 bp, Oryza sativa
ggaagaacaactttttttgatgctacatagggaattttctcttgcattaattttggttttttatttctttaatctttatacaatcattacgccatattctatattttgttgaacagatctttgtctaagtgacatactgattttcttctgagatacatatttacgcaacattcaaatcaacaagatcaatcttgctgagcaaatttttggtcagcaaacaagtttgtataccaaaacaagcgttttataagttttataagttattgcgctagattacactcacttgataagttcgtgtgtcgctaatgcaatttactctttttttatcaaccacataagtttctttgttatgcatttcaatcatttgtcataggatgataaacagtttgtggctattacttttgttccctccctaaaggtcggtgaactccaagctaataatctgaaggaagcgcatggatacaagttatgaaggtcttgcacttcatattgtattgctggtgtaga

SEQ ID NO: 42226 - DNA, 1501 bp, Oryza sativa
tgccatagacctcacatgttgtgttaaagtccagggccttaacggtgccctgcttggcatccttctcattgttgtccagtctcttcataaggagagacaactgagcggtgagcatttccgtcctctcgatggtgcacatgccgcgttgacgggtttggagtcgttcctcgctccaacccatatttgagacttcttctcaatcaggtcagtgatatctctgaccatctttgagaagggtgctccttcatcagcagcgtccagatgatcccgggacgagggggttaatcctttgaagaaattttgtaggatgagtcactcgtccatcccatgatgaggacgggcggtgacgcattcctgcagcctttcccaagcttcaagaatggttaatccctcgtttgctgaaagctggatattcttccacgaagagcattggtcttgcccatccggaagaattttgaatggaatgccgttgagcgcttattccgggttttcaccgttgcacggttgatgtagaaccactgttctgctctcctgaggagggagaacggcaacagttggagtctgactcttctgacggtatacgtgctatagctttccaggaattgctgcaaatgagcacttgcatcctccttaggctttccacagaacaggcaagcctgcgccatcgttaatttagttggtcttcaaatcaaagtcaccatctcccctgctgacttgggttccaattggcatgttactagcagagggagtagtgaacatgaaaagtgtcttctcagccatatcgtgcaattctggtggcgcggaattggctggtctaattgccgatagagtaaccttgaggatgaacgacacggggtcggcttcacttcaccagtgactctagatatgaaattggtcggcagatcagaaccagtcctgtactaccctgttttcacataaaagagaaaacaaacaaggtttgcctacaaaggacaatgactatatatagaggtaaatataaaattattagctagtagtaaactcttaatcatttatcttcccctgcaacggcgccagaaatgcttgttggtatttcttagcgacactactggaaatataattcccagcaatagcactaaaaatactcatggtatatttatggttacagatctgatccacaagcgcacggatataccattgtagcatttcacacgggagtattccaaggtatggtatttattttatcctaaggaaagatatgataagagagtactatgctaatagtttttatattacttatatacatcaaagtctatgcaggggttaattcagttcaaagggtagggtgacacacaggagaaagaactaagaactactctcactaaaatatagtctaagctaagttgagaaagaataagaaaagtatcattcatgtacttctactatacatacatctttagtctatacttgctattatacagtcatgcaaccaataccccgtacccagtgtccttctggtgtt

SEQ ID NO: 42227 - DNA, 1501 bp, Oryza sativa
gtttaccacgattaaccttaggccaaacgtggtacggcgaaaaaataatacacccatgaaatagttggtcataagtgtgacaatgttttgccaaaacaaaataagtgaataacttgcgatgggggagaagctaggatttggagattagggggacaaccacaaggaatgttcgtgtggtttataatccattttaggccctctttgtttaggcttaggcttattgggttagacttttaagtcagcttgttggcttatatgatttataagccagtgaatttaatgtcctaagtttagtggtggagtcatacatctatctcatataagccaaaaaagcttctccaacctagcttttggcttaatagtgtaagagtggcttatggttttaaaaaagccaaatgaaaaagctgcttgtttgtttaggcttagactttttgacttataagcctaaacaaataggaccttaatgcgatgcactattcatactctgcattgatacctctaaagcagaggatctgaattcaatggtaatggcttctgatgatcgctatatattgaagggtatttaaacacacggttagtgcggtaatcttacggtatacctagctgatttcaacggtaatggcttctgatgatcgctataactgtgcggttttcacgataaccgccaaaccgtgggtgacgataaccacaccctagatcacatcagatttcttacagttataaattctactacctccattcccaaatataccagattttagttagatgtaatatattataatacaacgaatctggagagaagcatccaaccaaaatctcttatctgtgcgtttagttcacactaaaattagaagtttggttgaaattaaaacgatgtgacagaaaagttgaaagtttgtgtgtatgaaagttttgatgtgatgtaaaagttggaactttgaagaaaaagtttgtaactaaacacggacatatatatatatatatatatatatatatatatatatatatatatatagggacagtactaaattatatcgggaacccttgtcgcaaattgcagtgctagctgcactaggagtacaaatccctagtacagcgtagtactccagtcgccggctcgccgcacaccatcgcccatcagaccctgccgccgcggtctcttctcgaggcctcccgttccctcttcccggcgagctagcgcaccgcgcgggagagaaaggagagcaaaaaggatgggcggcggcgagtgcaggagcaacgactacggcgccgccgcctactgggacgcccgctactcctccccttccccctcctccaccgccaccaccggcggcggcggcggcgcgttcttcgactggtaccaggcgtacccggcgctgcggccgctgctccgcgcccgcctccccgcctcctcccgggtcctcatgctcgggtgcggcaactcccgtacgcctctactacctcttttacctgcgtgccttcactcacactagcttgaaac

SEQ ID NO: 42228 - DNA, 1501 bp, Oryza sativa
tctcttctagatctagaagaagctcttctcttaatttcagagccttgaccttaatacaagttacagtttgtttgttccccaaaagtttgggggttcaattgaacccccatgtcccaagttggatccctggcttttcggtcgcgatctagctagggtttattttgtctgggcagcgttgagttgcacggattcgattttgttctgtgaggggtcctgcgattgctgctatagtagggttaaagttctaaaacttggactggttcatgaagagaatatatagaggctttaatcctgtgcttaagtttttctactgcatgttggatccgcccctgagcccagcaatgattatattagttagtagtcactattcaacactttattagattattccagtggatttgaaggatgaattaaattgaacatcaacacataattatgaaatacagtgataatccaaatgtttcgtcatcacaaacaaaaaagaattggggagccactacataacaaaaaaaaaggtatcaaaccacatatacttagcatatatctattccattcattgtcatactggatggtatctagctatgtgccaactgcttagatctgtagtaaaattcggaacatcgccttgctcaccatggatcactactggcaatgcattcaacatttaatcacacatgggcattggttgtgttcctcattcaatttgccaaatgaaattcccaccatagcttacctgaataatctaatatcagaaccaattgggatgtgtagtagtgaaattcaaggcaatcatgattgctggacagctgaagccatccagcataggcctgtttcacttagtatgatagttgtgtcggaattaagtactcagatattggaagcaaataaactgtttttttttctccagagggatgaaaatcaaaacatgttagttcaattttgtgtgtatgcatgtaagtggtaaatacaataatcaatgccaacatgaatgattcgattagttagagtgccacttcttgctggtcggaaattgcttggcatgataattggtatttatcagctaataaatgaagatatagttttcattcaacaatcaatatttcaagtattgttgatcgtctgatccaaagcttatcaatttcgtgttgatgtggctctgtcagatggctttgtgtagtcagatggcttctttacttagaatggtgtagttagcatcactggtagtatatactaattagcagtagtatatacttgtttttatacgttgtattatcaatatatgctacattcctcgacaaagatgtactaccttttttcggtcagtatatactacatcccttaatcaagcagtatatgcttctttttttgctcagttagtatatactagaagctagtagtggtatgtactgttttttagctagaagtggtatatactgtttttaagttagtagtggtatatacctttttttatgttagttgcagtatatatcttttttaaagt

SEQ ID NO: 42229 - DNA, 1438 bp, Oryza sativa
ccgtcctcgtctccgtgcagccgctgccggcttccctcgtcgcctcctcgccggcccggtcgtcgtcgtcatcgtcgtcctctcgtcgtcctcatcgtcgtggcgttcgtccctccgtgcaagcctgcgcgttcgtcgtccgcattccgtcaactgagccgctgcagccccatcatcgtcttcgtcctcggctccgcgtcgtgaagcctcgtgccggccgcgtctcgacttcgtccaaggatcgccaccgaagtcgttccctcgccgttcgcctccgtcgtccccgagccgactccgccgtgctcgttcgttgtcgtcgtgccgcgcctcgtcgcgtggtggtaaggatctctcctctcgctgccccgtcctcatcctttcggtgttgccccgtacccgttgtgtggttgtcgaccccggtacccatgtaccggtgtcggtagtcgttcgcttgtgcgtgtggtgaccgtgttagtgtgcccgctcggtagccgcgtggtttcacgtgtgcagcccgcgtggtgtctagtggagtccgcttgtcggccactcgcctcggttgacacacggggtccgcttccgtcaacccgtggaccgtgtctatgtactcggcctaccgcggtcctttaggttgacatgtggggtccgcatgtcaacagcgcagccttcctgtcttttccaggctagtgcttccacatgttttatagttgcaaagcttaattataataatccgcaaatctccatataacagcattaaacttcggatgatcgtatcttggtcatacgaactctgaatcgacccgttcaagtctcctaatgtttgttataacctaaagaaccctgtgctttctttttatgtattgttattacttctttatagggtttagctttgcttgtgtgcttcgcgtagcttctgtcgttccggaggttctcgaagcgtggttcgcggtcgtcgccgaaggttcagcaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgacattattattgctattgttattattaccttgttcaccctagaataaataaaaccccaactagtgggtactctattcatggttccactagtatgaatttaggtagatgcttcgctgattaattaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgttagtagcacctcggccacataaggaccggt

SEQ ID NO: 42230 - DNA, 425 bp, Oryza sativa
gacccagatgaaaaaagtacggccgcaagctctttatgggcggccaaaattgcaattagccccttgccgccctctgtacgggcggcaagggctaagcgcaattttggccgacggcggcagacggcgtggtcgatccaccgtctgccacgtcaccttgccgcccaccattagggcggcaggggctatttctgcaatttttttggtccatagattatttctgtaaatattaaaaaaaaatctaaaaacgaaaaaagttccgagtgcgagagcgacgacggcggccgaatacgagcagccgcagcggcggtggcacgcgagcagtggcgactgactggctgtggctcggcaatggcgggagcaagcgtcatgacatcgctcccaaatccactccccacgccgcctgcccacccatctcccgcgttcaa

SEQ ID NO: 42231 - DNA, 188 bp, Oryza sativa
ggtccatttaagagaactgcacggaaacatcgatttttccgtgctgtcctcttaaaaggaccgcacgtgaaaatgagctgatttttcaaaagcgacgagttgctgcctgcacggaatctaaaagggtccctgtagtagtgattaatcaagccaactcgccactgtgaacctcatctatttctcatagt

SEQ ID NO: 42232 - DNA, 1501 bp, Oryza sativa
gagtggagagagataaatttcgaaaaaggcactaatgaccagttaaggtccttttgaaatgcagattttttttttcataaatcctacgagaattgaactgtttcctgtaaaattactgtctccgaactgttccaaacggcccctaagatgaacatctctgcagatgattaaaaagaaattataggattataaatcaataatactgctaattacgggtaacaaagcaagtttagaggtgtcatgtcacagctgtttccatcatttctaccctactgcacaagacagtggtcagctgatccagattgtgattattaacgttcttcccctgtcatcacggccgtcttacagcctcagtatcttaagatttctcaagtgtttgtttggcacaactgcggatccaagattttatgaagctaggtattgctagctccacaaatccattgatatggatctgcgatttgatgaatcattttattttctttttagatgaaatataaaattttaatccactataatttaacatacaaacttcaaattgagagtctattaagcatgagtttgttaaaaaaaaaggggactactccagacagaacacagcaaatcaacgcacacaaagcaaagaaattatcccttcgataattccagttattgcccttcgataattccagttttagtggttttatttccgtatgaattgtccaaataagttaccttggttttgaagataaccttatatcatttgaagcatcctcatcaactaaactgcacaggtgagcctctgataacaacaaaacctgtcatgtcccaattaatcctgcacgtaataacatcacaagttatggtagatatatataaaacaaatagtagtaataatctgacagtgtgatgtgatgtattacaacctgatggtgccatacgatgagcagtacaaacagtacaagagaatcttgaatcttccatctagcaccttgcttttacaactttctgacagtcagatatttttctcataggatagtgattattttgcttactatggccgagtttagttacaaaatttttcttcaaatttccaacttttccatcacatcaaaaatttttctatacacacaaacttccaacttttccgtcacatcgttccaatttcaaccaaactttcaattttggcgtaactaaacacaccctaggtactaaacaggtaacaggttccataggttgacaccacttggtatcctccaggctccggttggacccttcagatttgctgttgcaacaaaaatatatactcctctcctggcaatgaagataggaaggcaggatagcactgatccttaaatgaacatattcattgcacagatttaaaattaaaaactgcaaacacttgtataaacctacctctcaacaagaacgcatatgcaatgcataactatgtaggcgaaattgccatgctcatatggcatgggcaagaacagaaacagaaacgattccattcgaaaactgaagc

SEQ ID NO: 42233 - DNA, 265 bp, Oryza sativa
cagttcggtctgaatcatcgtaggccttgggttaaggcaggttcgtgtgggttcacggccttgattagtaatactgtgtagctttaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcagtctttccccccttcagt

SEQ ID NO: 42234 - DNA, 170 bp, Oryza sativa
cctgcccccgcaaatctcgccggcgccattgatggcggccggacctcccgcgccggtttccttcccctccggccgctctttcccccttccaaccctatttaaaccctctccgcgcctccctcacccgtttccgcccttgccgcgccgtctcccagccagaatcgagctcg

SEQ ID NO: 42235 - DNA, 471 bp, Oryza sativa
gaactcaccgggtgaagtctgtcgttcggatgcacgatacctccaacctccaagtacgggagaccgcccgcgttggtcccacctaaaagatggcctgaacaactataccaaccgccattgccgtcgccactctcttcttcctcctccacctgatcggtacataagtgtggtagtcaaaactaaacagtgtaagaacgattggggtatgatgcttcttctctgaggacgtcgtatcggatgggagtactgaggcgactcagaaggcggaggtgtcgtgccggtgccgggacggagagcacagaggcagcataaggtagagagaaggcggcagggcagagggtgtgcaccacgcacgaagccgtcagatctggtgcctcttccctcctccccgggtcgggatttggcctctctagcaagggaggtcgtccccctgtacagtgactcttagtgacaggaaggggtagggagcaa

SEQ ID NO: 42236 - DNA, 1501 bp, Oryza sativa
cataatagggttgcatttgcaaaagcagcatttagcaaacatttgagaatttgataagacagttaagtaattaaacaatattaatccaacgctatacaacataccctgttgtataggcccaaccattctgaacaaccatcccggctgcacagttctatctccaaaccaggaatattccattccaaaccaggagctaatcaaatcattaccagtttaagcatctttttcaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgtataacacaatccactgcagcgcaccttcctggatcataatcacccccttataaacaaggcatggactccccagcaacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgatcgaccatcgtgaactatcattaagccatcatgaaataatagtaaatcattagttatcccataaatgtgctaatgtttctaagtagggctaagcaattatatctaatatctagttgaaccaatataaataaagttcaaccagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaaacagaaaagagcaaaatcaccaaaacagcacataaacaagcatgaacaatacatgtggatatttttaatgtgtagatctcaactttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaaggattattgcgtcagcgggctagggttttggtggaccgggcgcacgggcggcggttcacgcgaacggacggccgagatcgaaccaatccaaaacggacggccgagatcgaacgggtccacgaccggctcacggcggacgaccccga

SEQ ID NO: 42237 - DNA, 1501 bp, Oryza sativa
tcctcctcgcccggttcgtcgtctcgcggcgccgcctccgtcgtgggcatcgttgcggcgtgttccacgccgtccttgtctccgtgcagccgctgccggctgccctcgtcgcctcctcgccggctccggtcgtcgtcgtcgtcgtcctctcgtcgttcccggtttcgctcgttgtggcgttcgtccctccgtcaagccgttcttgtccgtcgtccgcgtccgtcaagtgtgccgctgcagccccatcgtcgtcttcgtcctcgcctccgcgtcgtcaagcctcgtgccggccgcgtctcaccttcgtccaaggatcgccgccgaagtcgttccctcgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgttggtagtcgttcgcttgtgcgtgtggtgaccgtgttagtgtgcccgctcggtagccgcgtggtttccacgtgtgcagcccgtgtggtgtctagtggagtccgtttgttggcccctcgcctcggttgacacacggggtccgcttccgtcgacccgtggaccgtctctgtgtactcggtctaccgtggtcctttaggttgacatgtggggtccgcatgtcaacagcgcagccttcctgtcttttccaggctagcgcttccacatgttttatagttgcaaagcttaattacaataatccgcaaatctccatgtaacagcattaaacttcggatgatcatatcttggtcatacgaactctgaatcgacccgttcaagtctcttaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgtttaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttatggtggaattggacatacccctctcttcctctttcaaagcccctaaaacctgtttttcggtggggtttgggtgcatgctagttgtgggaagtagcaccccggccactataaggattaa

SEQ ID NO: 42238 - DNA, 472 bp, Oryza sativa
aacaagtaataataacaatagcaataataatgtcttaacaaaggtaaataggcatggctaaataaaacagtgataacgcgggaatttaaataaagcgataatgtattaatttaaatcaaaataattttataaactgggattcaatatgctcaaggatgatgtgacttgccttgctcgctttcccaaacatcggcttcaacctccacgaaagcggatcttccgaagctgcagcgtctacacgaccaacggaaaagaaaaggcttttactctaataaactccatataaccagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattaaaaaaaatagatttattgcgtcagc

SEQ ID NO: 42239 - DNA, 1501 bp, Oryza sativa
catcgcgtggaatcatgcacccaagagatcccctcgtttgaggccatcagcaatgtccaaatcttaccaacggggctctcaacaaggctctgctaactcaaccaatcttatctatcttgctgcagctaaaattgatgcagcgtttcttgttgacacccagagccattaatttttcgtatgtactggcctaacggaagtgttatgtactggagagtttccttgtcagtgaacagatcatagattttttttagaaggatattttttacctagcctctacatccaaccggatatatacgtgttatgtactggagagtttccttgtcagtgaacatatcatagattttttttaaagaaggatattttttttacccggcctctacatccaatcggatatatacgaccattgaaataggtaacttagccccgaaaacaaactaatcagataacttagctctgcaaacaatctaatctgaaatttgcttctataaagatttgaactcagaaccttatcatactacgtaggtcactgtaactactagcctacgtaagcatgccggcagagtgtgtgggccaccgagtttccctctcggtatatttgtcgcacgtccacctcggcgaagcggcgcagcagttcgaggatctcctcgtgcgtcgccgccgggatcgtccctcggacagattgatcaagaagaacttgttctcatgaccaataacttcattaatgaatctgacggcaacatctcttcagggagcctgatttccccacatttgcaacagtggcagttcatagccaaccttccagtccattctccaggatcctcgcagcttgattagagaccaggacctgatgacaattgacaacgcaacctgccgcgtcttgtgttcagattccagatgcctctcaagcctatggaactgtaccgcatgttacaaacaaagcttcgatcgaactctgctcacatactagcttatcatgaatgagcttaattagtgactgtttcctaatctctaacctagcataagccttgaaaggcacaccatcacaagcgacagtagaagctcttttttagtctttctccaatccctcatttcatctgaaacacatattgtagccatctctaagcttgtgccctcttttatccttcagcacattggacaggtccaataatgaatatctgcagtatttatgcagtatttactgtttctgacaaacttctactactatgcatgatatgtgctccctccgtctagtgctgtgtttagttcctgaaattggaagaaatttagggaaagttggtagtttggaaagaaagttgggagtttatgtgtgtagaaaagttttggatgtaatgtgatgtgatggaaagttgggagttggggggaagtttggtgtgagttaaaccgggcctagaaatataggggacttttaagtactcgctccgggctgtgtgtttagttccacgttaaaattagaagtttgaagaaattgaaacgatgtgac

SEQ ID NO: 42240 - DNA, 1501 bp, Oryza sativa; identical to SEQ ID NO: 18408

SEQ ID NO: 42241 - DNA, 724 bp, Oryza sativa
agggtcgggttgcagttcggtataaatcatcgtaggcctgggttaaggcaggttggtgtgggttcagggccttgataaataatattgtatagttctagaatcgtgtttaagaaatagctttgggcaactaaatatctttaaatgctgtttactgcaaccctaaccctttatattataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgcgtgtgctgggccttcgctgcccatgtaataaattaactatttacgcttccgcttgttaaactctgaattgtatcaacttttggtgtaccttgcctcctgggacaaggattaatgcacgcacataaggaacgcccgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaatctgacctttaaaatgtggttttttctttctgtttttgtttgtaga

SEQ ID NO: 42242 - DNA, 935 bp, Oryza sativa
tatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgattctgatggagtggaggaataggtgtagccttggtcaagctgcctgtggagtggagccgtctgcgccgtttattttattttccgctgcttagatctttattgattgagaggaactatctacctctgtaacgacattttattcgcttattaattagagtaataattgtactctattatcaatttgttattgtgtgcctcggctgattcctggatgagggttcacacacatgtaagcgtttggaattttggatagaaattccgggcgtgacaagttggtatcagagcctctttgaccctaggttatgccaaatggttacccatagaagccctctaaaaatattggaaaagtagaactgttctcctccctttctcttttaattaaaccaaactaatggcacatgcacttcataatctcttttaatggttctcatttaaaaatttattccagtgttattagtactgtacatccattactgtactaatggcttatttaccagcaaaagttttacaatatggttttatttaatcttgctgcaataaaataaagttagcatgttgatttcataactttcttttatttcttttgaaaccagttattcaaaattacaaaatttgtgacctcgtttccaactgttttaacttatctcgcaaagcttggtttactttatttacttacctttttactctgattttctaactttattcaaatcaatccaaaaacttgtgctattaattggataaaggtcttaactccctcctttcacttgtctttaga

SEQ ID NO: 42243 - DNA, 440 bp, Oryza sativa
cttcctcctctccaccttcaccctcctccccaacctcaccccccaaacttgctctaacccaagcttgtcacaatgttatctagacatgtttgtaggatacccatctcgcgtgcattcccgaagtagtttttttttagtttgctatattttaaaacagggtaattctatagtaataccaggcaacacaaatagctcgggcacagaactcttgttggtgcaacttctagttgcccacaggggcggatccaacgtgggtgcacgggggacttgagtcccccctaaactcataaaacccatggataccccccggagcacccctttaattttttcactataaatgataaactaaaggtccctagatggttggaagttaaagaataaagaaactgtgtaattgagtcccccaattttttttttttttgatccttatccgccccagg

SEQ ID NO: 42244 - DNA, 546 bp, Oryza sativa
atgccactgactttatcacaggtctatgatataccattgattttgttacgttttacaatatatcatcgacttttgcttaacttctacgatttaccatcgccatcgacttttgcttaacttttatgttcactgagttagtctccgttagtactgtacaaatttatcgaaatgaccaaaatacccctgggacagaaactttcaaaaattttgaaatatcggattttaagtttttgccaaattttggatatttacaatcttatgtttataatatgatattttagaatttttattcaaatttcggaagtttttttctaggagtattttggtcatttgggcaaaattgtacggtgctaatggaggataaccggacggcgatggtaaatcgtagaatttaagcaaaaatcggtggcatattgtagaatgtgataaagtcagtggcaactcatagatctgtaataaactcagtggcatataatagattctctctttccgaaattaccagaatttcggaaattttgaaactaaaattacaatccctgctccagg

SEQ ID NO: 42245 - DNA, 313 bp, Oryza sativa
tttgatgaagaatacaatgaaaaggttacacaggagagtacaaagacgaatccttctaaaagaagagttacaagacgttttaaaacatctaacaaggtacttcatttattttactttccaaattcactcaatttagttttcacataaattatttaccatttcaatatggcactatgatataggctaagaaaggaaaatgttctgaaatgaaaactcagagaaataaggtacaattcttacttttctttcatatacaaaacgatttgtcaaactattactgacatgttatatacaattgatgggtattaatagg

SEQ ID NO: 42246 - DNA, 1331 bp, Oryza sativa
catctctcctcattaactttttagatacctcggtttttgttttacatgaaaatgcatttaacactataaaaattagatgagatggaacgttgagtgcccttagtttatctccacatatattgttaattgactttgtttcttttggtggaggtgaacttaatgattcgaaaaggatctcttagcatgaacacctaataaatcttatgcaaaatagggtagaacaaagggtggattattgaccagaattgttgatgccattaattgttcgtggttcaaaagcctctgttgatgtaggtgttagtgtagtgcagattcacctgcagcagaaaactcaacgcaaaaatggattagcactggtgcatgtggaccttaattaagatcgatggcgtatgtatatggttttgggggtggcttaaatcaaagtccaaacatctttttaattagtctcgagaatactgatcaatatatatacagaaaattccttaggttcctcggagttttcaattaaatttttcccctaaattttgtttcgttccttacgtgtctgagttcttgattattttggattccaatttccaatccgtgcattctaaacccttgaagcccagacaccttaaagcaccatatgaccgtcctatatacatctagctagtcgactgcgagttaaccgttagactcttttagaaataataattagcatacttcctctgttttatattataagactttctagcattgtctacattcatatagatgtttgctataaaagtcttataacctgatgaaacggagggagtagcttcaaggtgaaaaagattcgtttatgaaaagaaaaaaacaaatggagcagaccaaaaatttaatatttgtaaatatttttaaatgtttccactgaaatttaaacccaactgaaaaaaactttgccttttcagtttcttggtgaatcttttgtatgtgtttcatcaaattcgtaaaaaaaaactattttctatatttggggtcataattatgtccagtttgattttatcacaattctttttagattatgtttacaaagtagaaagcataagtacgtatgacatataagtcattttgaaaaaatctaacagtcaactaatagaatagatataaaggagataaaaaaaacgcaaggacatgtaaagataagataaaattcatgaatatagaagggattctttgagcaatttgtttctatattctttgtgcaagttccatttaaccatcattttcaccatagcatacatatgtgtctgtgctaatgatttaattattgttttgacgttgtaattaattaattaatatttaatagg

SEQ ID NO: 42247 - DNA, 339 bp, Oryza sativa
attttgcatcgctttgctttgactaaaatactaattagtagtaggcacctaatactctgtaactctgtctcagctaattttttttgctcttcttttctattccgctatacgagtatacgtatggatagcaaggagagagtgacagaagaggggaaaatggaaaggatgaggtctgaggggaagggcggacgaggagggcggatggcggatggcggatggcggatggcgcgggccggaggtgcgagcggagagctttgggcaggggggacggcggcgcaggcggcagggatggcgtgggttggcggcgtaggtggcggggacggcgtcagacggcgggga

SEQ ID NO: 42248 - DNA, 816 bp, Oryza sativa
agctacgaacaatagcagagtttacaacaacactaatcactcttgcaggatcacatcttcacctctagtacagtcttgacatcttcttccttccatctcaacattactctgcaacttctactcctgcctattcactcccaacctccagcataattggagtttgacatattgcttctcgaatatggatcgaagaactgcgaaatccttgcgttcttgtactgtccattcggtttctccctatcagacatgacgccggtgcacaatgtgcacctgcaagactggccaatcaagtgacagctccaagaaacgtttccagcagaaatcgctccaacaccctgcacaaaacacctgaaaattgtcaagggttgctgcttatatctccatagattcttaagctactactgaactgtcatatgcatgattcattctgtgttcgtttcatatcgaaaatgccatgagtctggagagctgtaccgctgcacagtccttcgctgctcctgtgtcagatgcactcccgatgcttcccaagcctatatgatttcaccgttctcatgcttgcaattttctaacactcatggcatctcttgcagaagctctagctaggcttttgtacttcagttggccatggtcatctgtttcttgccaaacgagctacctagctccagaaatatatatagatgtgcgtcttcaatctcaatcttcaatgtcaacacgttcctaattgcaattctgtaccgtgagcacggttcattatgtgattctctcttatatgattgggcgtggctcatgatctgcactctttatttttctcacagc

SEQ ID NO: 42249 - DNA, 821 bp, Oryza sativa
tttttttaaaaaaagaaaatctggtggcgacagatatgtagcaattccttttttttccgtgtgtggtggcacacacgaaagaacacaataacacaaatattatttgttgacacaagccacacactggttctagaaggttttcatttatatagagatcgataagatacatgcaaggaattacacctagccaatcactcaagttaattaccatgcaagtaaactagtcacatgcctaactaccagccatggcaagctagtcttacgccacaacgtgtatatgccatgcaaggttccacttctcaggacatttgagtttttgctacagtgtgggtagcaagcttgttgatcagcaagcctttcctatcgcccatgatgatgtgatgacaataacgttacgtatctgcctatgcgaggagccttgcttgatcttttagcttgcaactttcttttgcaaggcttgtggtgaatagcatttgttgaacatggcttttcagttttcatagccttgtagtttaggtttatcatgttctgtttgatgctgtagttgtggttttcgtatagtttctcttaattaactatgtaccgtaagatttggtatcgttttctccttaaaatgagaaaacttattctttatataaaaaattaagaaaacttattctttatataaacgtcggcaatagtctgactgttcttgaaaaaaaaaagaactcctcaggacctatcctctcggcaggaaacacttcttgcagtttgccatgtactgaccgactggcctcgccaccgtgactcagctgcatatgcaagctaacagaaaataaaaa

SEQ ID NO: 42250 - DNA, 1501 bp, Oryza sativa
atcatcatatcgatgaattttctgccaattgatcaaagcggagccgataatcaggggcggaaatggcacccccttattgccgtcgtcctcgtcgtcttggcctccgcggccgtttcactacctctgtaagcacctctgagacacttggcagatatatcttgagattgtcaaagtcgtcagggacgtcttgttgtcacccgtatatactgtctatacccgaaagaataattagccatgagaaaaattaaaatccaatcccatcatactaggaattaatagcatatgcacgcgaggatgagagccagtataatagtgatctataagcttactataagcttatgtggaggaaagagataaacaaaagagaatggtgttggctctcatgcaagagctaacttaacacaagctccaagacaaatagattaaatgtatgagtgagagatagagatagaagaagaaaattataggtaaccttatagctaatctattatatgtgttgactttagtataggttaggggcgcgggcgccgcctcccgccggctgcgccggcttggctgccctcgggcgtgccgagtggctgctgcgtggggcccggccgtcagccgcccacgcccttaggtgcggctgacgcgtgggacccacggcgctggccggtgcgagcccgggtgcgcccggtccaccgtggaccgtgaggctgccgcgtgggccccactcccgtggacccggtccgcgcgccccctcccctcggctcacgcaataaaccctttttaaattaaaatttaaatgaagaaattcgcaaatattcatttaaagagcatataaacttcaaatagccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattaccgctttgtttaaattcccgcgttatcactgttttatttagccatgcctatttacctttgttatgaccttattattattgttattgttattattaccttgttcaccctagaataaacaaaacaccaactagtggacactctactcatggtaccactagtatgattttaggtagatgcttcgctggttaattatgcaacattaggtggttttacaactctagactttgggaatattcatatcacctggacactatggaatggttggattattgtggaattggattcacacctccccctctattcaaaaccctcaaaatggttttaggctgggctcggggtgcatggttttgacagtagcacctcggccatataaggaccggt

SEQ ID NO: 42251 - DNA, 807 bp, Oryza sativa
gattttacacatgcttctaaaaaaccctacgctatcacatgatttaaaatcttagacctattattttggaccattacattatatcttttcaaaataaaaaacatatataaaatataaaaaaaaatatgaccattgtaactttaatcggtaaaacaattatttacatccgatagaccaatccttaaaaatacaaatccattccacctccctcccgtacataatcactcgtctctccacgatatctgtacgtacatgcaagatatatatcttgcatataacagaattttaaaaaattaccatcgagacaatcgtcaagctactaatgcaaaggttgtttgattattatttgtccagatgataatttgatctaactgggttaatacattttaaattttttacactctatccaaacatccattctattccatactatattttaaacattcatttctatcatatttatataccattttcttttcttttctcaaaatcatttatataccattttctattcttttctaaaaatcctgtgttacaaaggaaaccctaaattctttctaataacaacaaaaattatgatagtttaaataatatgcccgcgcaactgcgcgggctaccttcctagttcagttataaacggcagtgaagacaccatgcacgaaattcagaatctttttcttagagagtgagctttgagctagtcttcttgagctataggaaaagagagtttttcaagtccatcgggtggtacctccaggtatcggtactgcatggtaccaaagtaaatctaaccgttgaatcaatagg

SEQ ID NO: 42252 - DNA, 239 bp, Oryza sativa
tacttttagtacggttatataaaaaacaatgtggctttttttggcagttttaaaattgaaattattggtacggatgataagctgaatagatggtatattttttttattgtacttgaaaatagattgcatatatatattgtcaaatttctaattagatattttttgcctgatttttacagaagttaattaaattattgtgaaatccatttaaatattacacatttggaaagttcctttga

SEQ ID NO: 42253 - DNA, 185 bp, Oryza sativa
tctgaagtttggtgaaaagttgaatcatggaagcgagtcttttacagagtttggaccacataataaggattaatctatggggctttgaatgatcttcagttaagtagtactggtaagtggacaagtctaccaggacctagagctaagtgtcattgttaatggagtttttgcctcgcaaatgcagg

SEQ ID NO: 42254 - DNA, 1501 bp, Oryza sativa
tctttaagtcttcgtcgccaccgtcaggcctgctcgcgccatgccgtgccagatccaccgacgcttgctccaccaccgaagctgtcgaagctcgcggcggccatggatggatggacgaccgccggtggcatcgccgctaccgctcccgcgcgagatctcgcgtgcttgggtctcgctgctgactactctgagcttgccagcttggctctcggaagaaatgcgagaaagaaggagccgccactgccgtgacgcggttctatttttgtaaaattccagtggcacagttacgaatagacgaattgtaatgatatttttctgaatagccaaatttgcaatggcatggatcaaagtaaccctaaattgaaagccatccagattttgcattttgctgcgtttaccagctgaacatgatagcaccatatatttaggggatgataatctagctacacggttacaccctagctaggtaggtaaaattcaactaacatgtccgatatatgaaagctaaattggctatgcacatgagcacatccactctgtggatgtagaggatgggctattatagtttcatgaatagtgatgctattgtcatttgaagatcagtaatgctattgtcgtagggatgagcatccgtaattagtgccctaaagatataggctaactctcttataaaatattatgccttaatatcgtatcaagtttggatattctatggcattctttcgtgtttagctaccactatattgattttgtaacccgttttatttttttagataatggattaaataaaacctggcctctatatcctgagggatgtacacaaccatagtattacatcatcaagcacttaggctacaaacaggttcaaaaggcaacgatgccgtagaaggcgaatggacgacaaagacatccagaacaagtctcacaacaaaagattttatctaacacaattcaatcttcctcttcaattccacctagattttgagtagaattccataatgataactttcaattttaggcacccaatctttaaagctttctcatcaccttctttaagaagcaaagaccactggcgagcccgatgcgttaccctgaaaataacctgcaagagagagttaatacttgagccatttaagactacatcattactagcaagccaaagtgaccaatagatattgaatatcggtttaccgccctattgtttttttatactttctgtgcgccaggaccacacaaaaagatagtaatactcacagcatctatactacgttctttatatatgcagcacaccttgaaccacttaattcctactccggtatatacggagtacatataaataattggtgtcaatgtgtcatgcaccagcgcctgaaatcacggagaatagacatcgatgcttcctgacaaaacttcactccatttgttcactgaaccatacacatatagacacctagttgtataaaaatatatctcacgcgttactaatttatgtgtataaata

SEQ ID NO: 42255 - DNA, 1034 bp, Oryza sativa
ccagctttgtgtgagcgctggccagggccgcgccgcccggctgtccccagccgtccgatcggccttggccgatctgggccgtccacgtggtggacgcgcacccgaggcacgtctggaccatgtccaccgtgcgccctccccctttgactcgctgatgtgtggggcccgcgtgtcggcgccggccgccccttgctgacgtcagcgaggaccatttcctttgtaaaaataaataataattgcgtcataattcgatgataattctagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagaccgcggtcgcgaggaaaagagttcggaagatcaaagtgaagaagcaaggcaagtcacacattccccttgagcatgttgatcccaatttacaaatgttttactgtttgcaaataaatatgcatattttgctaattacatggggtcagggtattacctatctgctcgcttgtgccatgtttacttgatatctgttctttgtcaactttgggtaatgaatcgactagctcatgttacttatgtgacttagctagaactatatgcttagccatgcttaattaccactagctcagttgatgggataattacagtattagacccttttagtatcagattgagccgcgtgctcgagacatctggccatgcttcatggtcgtaattatccaactaaaatgcgactgaatggtgggctgtgggtgcatggttttgctggtcgcacccatggcagttaaggaccggtttgcgggatgccctggaagaacttatcgtacttaccacaagccagcgtgggcaacggctgggcttgtagtgtagctttcctctagccaacgcatccaggcaagggtgggcgtga

SEQ ID NO: 42256 - DNA, 201 bp, Oryza sativa
gagtcttattagcacattctgagctcattcgagctcgtctcgttgacagccctaccgttagcccacatctttggtttttttttcattttaataataaaggttataaagacatagctttaaattgaagggtcaatttgatctatgctactgtaaatttggctattcagaaaaatactattataattcgcctattcataacca

SEQ ID NO: 42257 - DNA, 1501 bp, Oryza sativa
catcatctccttctcgaatgtgtccagatccacaccctccacagtcggcgcctctgtgggcttatcccaagaaatggtggtcgtagtggatggtggcgcggcaggagaatcgaaggtgagctccttgcggatgccgacctcgtcgttgcaaagttcgcaaccaacgacgacgtcgggaatgcggaaggacaccgaggaggttggcgagggaggggtaggtaaacgatgtggtgaggaggacgtgccatcctcctcaccgtccgccgccggtctctagggcctgctctgcctcgagggctatccagtgattgcaagttcggttctatatttcggaccgcaccggcaaatcaatatatcgaccgaaattttcggattttatcaaatgtttgttgaatttggtcaaagtttatttaaatccagtcaaaatatgtagaaagttcaatccgaaaagtgccgaaaatcacgaaattttgtaaattttggtcctaccgaaattgaaaatgcaaaccctggggctatccgccgctacgtgtcggggccaccgagtcaacgctccgttcgaggccgcgccgtcactctgccacgaggctagaccgccgcacatgttggggtcacgcccagaaatttagcccaaattttcagactattttgtgtattaaatctctgtccaggaccagccagggtacacaaaacgacaagtaatatacagttccaaacgtaaataaagcgtaaaatacttacagaaaaggcacttagtcctcacaccgaaacaaaagcagcagcagcgaaaaaggcaatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacgtgcaaggggatacaaggagggtttgtggctatttgcatgaaggcagttgtaaaacactttattgagcaaaacagtaaaactgttgagtaattaaagtaatattgaatctccactgatcaacgctaccccacgttgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgttggctaga

SEQ ID NO: 42258 - DNA, 1501 bp, Oryza sativa
tgaaaccggcaagatcgtaatcgagttggttcgactagatctcccggcaacttagctcctgcaggctccgacttcgtaggctgtagtggttgtgttggctatgagattcgatgccttaggtcctcccagggggtcccttttatatcgcagatcaggtggtctccaagtagaactcggagacatcggaccctacacgatatattgacgaccctgtcttgtccgagtaggactcaaacaccgtggaagatttccttagtgtatgcagataatgtccgtgtatgcgcgggtatgccatgtcgatatgtggcgcatatcgaagggtaaggggtatacctaacctgtaaccctgacacaaaccttaactctttttttatctatcttttttctctatttccaagccctaactttgagttcttctgctttgactgaaatatgagaagtttttttgctcatcattgaggactatgagattggattgaaatgttgatgtatttgatgaattgattgtgaatttgatgaagtaaatgtgaatttcatgaatttgatgtgttatgtaccatttttgtgtcaaactgagttgttgaaggggtctatgtcaagttgtggctaggccggaacgggtatgatgggctgcccgtgccttcgggctggcccggcacggcccgacccttattgtgctgtgcctgggccacaggtgaagcacgtgggctggcacggcatgacccggcgtgtagatcgggccatgccggcccaacaaatcttggcccgggcatgaccagggccgggacttgctgtgccgggtggtccatatggcaaactatagtacggggtgtatgcgcgcccgtaactatgggtgtgtgcgcgagtatatgggctattgcgcttgtattgtgttcccaaggaaaaaataaaaaatctaattaaacgtactcttatacaaatcctttttcttggactaataactctcatacgattcagagttcagatacagtttatgtttacggaaatatctgtcgtgttagatcgcaacatttattacatacatgttctaattataatcacataattaaactggtcgccgagatagaacagcaaagacgatctgccagtctgccaccatgggttcaagaagctgcgtcgccgaagctaatggctcgacgtcgaccatcgtcgcggcggcgaagcccaccggccatcacatcctcaagatcgacggctactcccggactaaggccatggtcgccgccggcgacagcatcgactcctgccgcttccacgtcggcgaccacgcgtggcgcatcaggtactaccccaatggcaccgaccgcagcaaccagaatcccgacgccatatccgtcatgctcgagctgcaggacgccaccgccgccgccggccgcaacggcgccgccgtcaaggcgcagttcgtgttcagcctgctcgacgaggaggcgcacctaccgcagcagcgtgcacagcttcccttcctccgacggattcaaga

SEQ ID NO: 42259 - DNA, 1501 bp, Oryza sativa
ggaccgccggcgccggcgacaatgtccgtctccatgcgagagccaagatcagcttgctcgacctcgccggcgagccggtggcacggtacagccaacccgtcgacaagtgttccacctccaaggcaagcgatccatgggtttgcaagagcttcatcgagagggatgagctggagaagtccggccatgtcgtcggcgaccgcctcgccgtccggtgcgacctcaccttcaacgtgcaggaccgcctggtgagggagctcgtcgccgtgccgccgcccctcctgcgccgccacatcggcgagctcctcggcgacgccaggacgtccgacgtgaggttcaaggtcggcggcgagacgttcccggcgcaccggtgcgtcctcgcggcgcggtcgccggtgttcagggcggagctcctcggccccatgagggagcacgccgcgacgaccatccgcgtcgacgacatggacgcctccgtgttcgccgctctgctgcgcttcgtctacaccgacgagctgccggagctggacggcggcagcgcggcggcgatggcgcagcacctgctggtggcggcggacaggtacgacatggagaggctgaagaaggtgtgcgaggacaggatggtcaggcacctcgacgtcggcacggcggcgacgtcgctggcgttggccgagcagcacgattgccctgagctcaagaaggccatcctgaggttcatggcgtcgccggcgaggttgaaggcggtcatggcgagcgatgggtatgagcacctggtgacaagcttcccctccatagccacggagattcttgcaatgtttgctgcacattgagttcctagctagcgcatagaggatttttggaacggtagagtattattaggcattagatgctttactaagatctgtgccattgtaaaattttaatataaaatcatgctttgtaatcggcgaagtgagcctaactactagttagattttttatgataaaacttatctatctcggaaatgctggcgatcgggcacccaatgcgtgccgattccatcctcccacgcacgtgcccattgctacaaaccgccggcatatcacggaaacgccttatcaggtggatccgtttcatttttttgtttcattaacaatgtttcagctagtgcactcgtgatatttctctatgtgtagattaaatattgcagtggacttttgatactgtttaataatttcatcttgatggatacgtggtttgttgatgtacacggggtttaagtgttgcaatgagtttaaatcgtttgttgcatacgttgaactaaattgtttcatctagtgatctgatcgtgtttcactttttttaagaactgaaacattctttcgctatttgctaaaacattatttttatataggttgaaacatcgtcagattttttttggaaaccgttgtttcatacgttgtagcaaaatatttcatgaggtgatttggttgtgtttcagctttttaaaagattgaaaattattta

SEQ ID NO: 42260 - DNA, 1501 bp, Oryza sativa
ttcagcagctacatgtgatatgccacagcgttatccgtggtttaaggggatctttttgaagttagtagctggttgtttgttcttttaaagtttgttttcactcacataaataacggctgtggctctttttctacccccagaattacatgatctaggtgcgaactgcgagcagggtttgaaatttcatttcgaaatttcggtaatttcgtgccccccaccggcaagctcgtttatcgcccaaaattttcagtcttttacaactttttgtgaatttggtcgtgttttatttaaatccattcaaaattagtcaaaatttcaaataatttaagccaaaaaaattcgaaatttctgtaatttcaatcccccggcagaaagatcaatttcgaaattgaaaaccctagatgcgaaggctcagttctttgaaaattgcacatctgggagtttcatcatactgtagagacttcagcgctgatacaaggatggccgatacaaaacagttttttgttattcatgattgtgagttccacaatgcgatagatggtcaacaccacctaccttgtgtgctaaaattgtatacttgtgaaatgataattacgcaatcttttaaatatgaaaaaaaaataaatatatgtccaaaagttagtaatgtcaaacattacgaattgcgagattgcaatgcactactaaaaaatcgttttttcagacaaccaaaaatagttttttttcaggtgggggaaagatccacctctgtaagcaaagaatctattttcgtagacgaaagacgttctcacccccgttgccattttcgtaggcggccgtttagttccgagggacctatccacctgaaaaaaaaatatccacgtttgtgaaaatggtttttttggtagaggtacgtaccgtagtatgtagggactctttagacagctattgaatatattttagttttgagccgtagtttgtgatagtagatgtttcatttgacgtatccttgaaactaggggattctttgggtagctgttagatattttcgttttgagccatgatgtgttagagctgggtttttttttctggtgggtgtcctaaggatcttttgcccatacatgcaattgcactagtttcttgtatgcagtttaaacctataaacaaaatggttagacatattgtgataatataagtccatatacaaacgtacatggataatttcgatttacatctataggaataaatataactaaatttgttcagaaacgatcttgtcagtttttccttacactgccgaagaaatgatctttagtaccggttaaaaaccttctttaggccctgttttttttcagtttgggattattataatctagattattgagtcagattactataagctagattgttataatctgtagtagaataatcggttagttgtttctttcttagattattagagcctagattattagtttgcaagtctaaagagggagtggggtggcatggtgggtaatttttc

SEQ ID NO: 42261 - DNA, 163 bp, Oryza sativa
ggcgctgggatgcagcgaatgcggtggaggcggtggcgcggcgtgaagtagatggggatggcggcaagaggcggccggttggcggcagttagtggtggggctcgggtttgcggcgggaatggtgcttcgggggtggatttgaggagtgggccggtggccggga

SEQ ID NO: 42262 - DNA, 245 bp, Oryza sativa
agtcacccggggaaaggtgacgcgagagaagaaagagtttccgattggttgagagaaagtgactgaagcagactaaaatgtaaatataactaatatatacttacatattgggttttgtgtgattaattaatgggttgatgtacatgcttgcatgtaagttttaggagtgctaataaatattatacttgtatgttaagtttatgtgtttaataggtattagctttatagaaagaagagattggata

SEQ ID NO: 42263 - DNA, 1501 bp, Oryza sativa
tacccttcgatatgcgccacatatcgacatggcatacccgcgcatacacggacattatctgcatacactaaggaaatcttccacggtgtttgagtcctactcggacaagacagggtcgtcaatatatcgtgtagggtccgatgtctccgagttctacttggagaccacctgatctgcgatataaaagggaccccctgggaggacctaaggcatcgaatctcatagccaacacaaccactacagcctacgaagtcggagcctgcaggagctaagttgccgggagatctagtcgaaccaactcgattacgatcttgccggtttcatcgagttccatcgttccctttgtaacttgtggttttccatcatataatcccatatcaactggattagggctattacctgtcaaggggcctgaaccagtataatcctcgtcttttgtttgctcgatgtcgtattacgtagatccttgtaccaacataccccaataccctctatattcggtctacgggtatcacccgtcgacaatggcgcgccaggtaggggcacttggtactcaaggttctactactatgtcatccagctttgtcgacaacagcgtcaacaccaacctcaaccacgggtttcctgcttcaacaatgttagtgtggactcaagtcggcaaaatcgtcttcccggtctacaccatgatactgatctcagccggtccatcaatgaccggaaatgagaacgcaatggctgcaacccaagatgactccgtatcgaaggatcctcccgccgaagcgaagaacggaacatcgacaacatccaagctcgagaaggattctaatgcggccgaaccttgttgttccgacaagaaccacgagccgacgagaacaacttccgaagcgacaaggtcctggtgtcctatccacaaaaccaggaaacacactttgcaagcctgctgggtttttctcaacgtccgcgccgaaattcgcgcttgcaaagagcgtgaaattcagcgtatttgtccaactcgtgatgtttactgtcctatccacaagacaaagaatcacgacctcttaagctgtaaggtctttctcagcgccacgaagacgtcatctcctaaggaccaacagtcaggcatatcccttagagatgaagacaaggaacaacgaacgctggtctcagatcgattcgtcggcgtaatcgacatcaattcccacgaaccatcagtcctacatctactcgaagactacggctcatcaccaacgagtacgccacgcgaggtattagctatcgacgggaccagcacgtcagcacacgctaatgcggaggcggaaaatcaagtgactacaccggcccagcacatcaggacccttaacacaatactgagagagagaccttacgatcccgttctcaacgatgatctcgcgcggtggtaggaacggctacgggaatcagtaaccaacctcagccacgcgttcgaagaagccgctgctgctacgcatcaagaacaaccacc

SEQ ID NO: 42264 - DNA, 1501 bp, Oryza sativa
ttttagagacgccgccacctgatggtccgtgagcggcccgatgatgtcagtcagaggaagagcctacacttaatcaagtcataaggtgatctcgaaaggaaaatgcgggattcctatcgagtacacttacgttgatagcgtcatcacgttcggccgcccctttttcacaaaggggcacggggatgttacttgccgttgtcggaccactgatcatcacctgcccgacgtggcgctccacggctttgctgttcagacctgtgaatcgagaaccaaatttcgataaatcaagaggaacgcaaacataagcatgtcaggataaatgagagaaagataccccgaggagagacccgggtcgtgtcctccggtccagaatagttaaaggctggatgggcccgagcctggagcggctggatccgcctacaaacgaagtctgcaatgacttcataccccgacaagccccgtactcggagatcgtcaatgatgtcgataaacgactgaagagagggggtcaaagggggctttgcggtccaagacgaaatcttgtttggttgttctgtgggagcaatgaagacagggttcgaatttttgatctcaaaatagaaccacctattccgccatttgctgcgagaagaagggcactggaaggggatataacgcgacttcaggccatcccgaagtcagaacccgacgcaactagataccctgttgaactccatccaacgcagctcgtagtagaagcgaaagagatcaagaaaaggctctaccccaatgtaggcctcgcaaagatgagcaaagatgctaagaaaggcgatagaattgtggttcaaatgaagaagagaaagaccatagaagttcaaaaccaggaggagaaattcggaaggcggagggagaaaaccgcagagaacatagtcttcgatcgcaacaatgcaacctaagacgggctggggattagtacctcctgctgccctctccatggttccacgaccaggaagggcgccatcttcctgaagctccttcagcgacgcattggtggaagatgacttgccaaggtccatcgctaatcgaagattgctggagaaagggcctagattgatgaactggggtttttgcgggagcagagaagacgagaggcgcttggaggctggagaatttttccacaacaggcggacttcaaatgaatccccaaaactcccttaaatagacgcacttccgacggtgcgaattccaaggaaaggagagacatggccgccagaaatttctgggtccgttacgcgcggcggtttttcagacttcagtttaaattcactcgtgaccgttgggcttcacatggtgttctcaatcatgtcctgtctctatggttcccacaccgagaacgacatcagtctcgacatcagaagtcgctattggtcgcacgagttcatttaagcagaagtcgggggctactgtcaggtttacgggttaggtgtaccccttacccttcgatatgcgccacatatcgaca

SEQ ID NO: 42265 - DNA, 1501 bp, Oryza sativa
gcgtgccagtcagtttgatcatgcaactgacaagatatgcaaataatagacaaaacagccgatcggctgacaagccgatggagtagttccagccgatagccgataatagccgatgttgataccagccgatagcgatagggcttaagcaatcggctatatgtccaatgtagataatgatataaaggcaatcggctgatgatgatgtaataaaataacaatataatccagtataaaccaatcggtaaataatgatatgataaataagcatcgatccgaaggttaaaagcatacatcggctggaggtccgatgtcatgaaatccacaagattagattaaacagtgaaacttttgttgtcatcggctaaatcgaacttatatgtatatgtaatccttatgagccgatgcaacgtccagataactcaccggctgaaaccccgatgaaacccttattggcaatcaagaagcaggctagagattgtggttctaagcacgacttagtagatcaaacttaactgatgcagcactaagtatgaaaagaaatataatatctagacaatcaagccgttgactgagttttcagtgtggtagatgtctaagctaatctaatctagcaacgcgatttagccaataccggcagaaaccctaaaacgagaagcagccgatagagctaaattgatatgctaagactagattaacaaagacatatgataaataggtaggcaaatatatcatccaaaccagagcaatccaagaggtcgaatgtactgatgcagccttgaacgacgccgacgtaaacgatacaattgcccgggccggcggaacattggacttaccccttagccggagatcgaacaccgatgcagccccgcgtcaggtgccaagtcccgccggatgatgaaataaagtagaaaaggtaaaaggtggtgatgcgccgaattatattgatcgtgaagatagattacatagacctcgggcgtacatatttatacccatgggttgatacaagtccttgtcggacaagaaagaaactttcctaaagataaaaggaaactaataaactattcttaattaatagataacttgccatgccgcattctctttgaactcggtctctgctggataagcttcctttaggtgatcgatttccttaaccgaatatagcaagaatccgacttgacaactctcattggctaatctcaggacttcgaagtcgatgctgactgccgatgactactccgggtttaccaaatttcactgttaacaatagttatactaaaatgcaaaattggctaaaacggtggttgaaagatactccctccatccttaaatatttgacgttgtcgatttttttaaacatgtttcaccatttgtcttattaaaaaaattaagtaattattaattcttttcctatcgttggattcattgttaaatatacttttatgtatacatatagttttatatatttcacaaaaagtttttgaataagacgaacggtcaaaca

SEQ ID NO: 42266 - DNA, 1501 bp, Oryza sativa
aagctccccgtacccgaatccccacgggggccctgtatagcacatcctacattcctactacctcatggcccatagaaaataaaagcccagctgctataggcccatcactcgttcacatatatacacgccaaaaccctaggtcccaagcgcacggagaagaatcctcgccgcttcgctcccatccacatccatgccctacctcgccgcctaaagtccaagccgaatggccgacacggcgacaccagatcgacggccgacgcctccacgagaccacgacaagggatccaggccgcagtcgtcgccgcatgcttccaggagtcaagggaaccaggtccgcatgttcgaggcaaggttccactgtgaaacttccatacggccgagaagacgagacatctaacatcttggctccatgtccaggacgaaatccaagtgccgagtgccgacgcatcaccaaccaaccagctagatgatttgtacctgtgaatgagtgagttagttacctacatgacgttcctgcctttctgtttgaaatgaactgaaacaacttgctgttctttaacagcacggaagcttgacgttgttttcaggcactgaagttgaaatctgtttgttgttcctattctttgggtcaattttgtgtttcatcagccgatttgatgatggtctcactgctattgtgttgctcgcttgtttcctgagttggggttaattggggattgttgctgctgcaatttgtattccggtgatgttgtcgggtgtgaggacccgcgggtgccccgtacccgcagtggggacggggacgggggagaacctgcacccaagtgcggggatggggagggtgacgggcgattcccttcaatgcgggtgcgggacggggtggtgaaacccggcgggtgcagccccgttgccatctcatgtctccctgcaaagcttgtttcgcagtcaggaggcggcggcggcacagctggtgcctatgcgtgcgacggtgtgtgtgtaacctagctagggtcagcccataatgctccattgggtcgacccatgatggcccatgaaatttcatgggtaagccaatgaggttgtgaccccatgtttcgtgggctaggtcgttgggtacatgggtttacccggcccacgtgcatccctaggttcgatctagctccaaaagtcaacggtgtcaaacaaggataaacagagaagatatattattaggaataaacgattattgtaaaagttgtaagtaattacattatggatatatgaaaaatatcacaaaacagcacgtttcaaagggttattaattcgagcctgattttgagtcaaattaagtggaattgtattaagagttggatttcatcacgaataatgcatgctttctgtgtttgtaatttaccgtgtcgatcttttgcaaagttgcaacgaagatcaacaacgccccgccgcatctcctgctccggcgccggccggccgccgtctcccgacccgtctagtgcacactgccagc

SEQ ID NO: 42267 - DNA, 256 bp, Oryza sativa
ctacagccaactttgacagaaaagttcagtatactgtcgatagcatactgtcgttgtaagcgtcaatagcttactggtttggggctttcccccaatccatctcgacagcatactgtcgttgtaagcttcaaaatgtaatgaaccccctcttctttcttaatgaaattggttgactgtatctttcggccgacccggcaaaagaaaagttcagtatatggtatccctgtttgattcatgtccacttattcagttcagg

SEQ ID NO: 42268 - DNA, 1501 bp, Oryza sativa
aacttgcatgtttgtgaagtgatatatcacatgttaatacattttctcaaattgtttcaaattttttcacaatcatttaaatgacatgcaaagaacaagaggacatcttctcgagagatcaaaatagtttccccatctcatcttccaccatagttatcttgtagagcctattttctttttaaaaaaatattgtacagcttataaaaaaaattatctcaaaaacattatctctcagagaacatgttatcttcgaattttctaatagcaattagagaagaacaaacaagacacgaacattgcaccgacaaaagcttaggcatgaattagtttaacgagggcctcaatgccgttaattttataacagctcggttaagaaatgtttacagataatttcctatccacgatgctcttccgacacgctatatccgaatggacagacttcgcaagataaaataaatggagaatagaattgttatttctgtcgtaaatgtgtaactaggaagaggtgacatggtcacatctagcctgtagaaacaaagtaaggggtcagatcggtccaaatccaccaagtggagttggaaggcaactccaggggatctacgtccgtcgaaaattgttgaaaactttccgcaaacatatttaggaactttccgaaaacaaatttagttttaattcttgaaatcagaaacaaattatttttcatatataaccgattagtttcagccttctttacttcaaatgtatattcagtattgagttggttaattgaatgtagatattttttctattatggtgctttagatatatttttttgtcttgttatttttttaaggaaatgacatatattttgataatatgtttgttctgcgttgaaaatattgatatattttttataaatttgatcaaaattaaaaacgttgactaagaaaaaaaatcaaagtgacttataatatgaattataaaacgaagggagtatatgctttgcttatcaatttttggaggcacctataaattgggcgctcgattattgttgtaaaaccaggcgcagttttgatactgaacaattaaaatgttgaaacacggttggatcgtggactaaaacaatttgttctgacacataaaacatcaaggttcaattattgtaacatcaacaacaagagtcaaagacaaaaattgaaacactttacataaaatgtttcagtgctgacaatggtgaaacacaatcaaatcacaccatgaaacaatttgctacaacgtatgaaacaacgttttgaatgtattaaagcatgaaacaaattcgaatacataaaaaaaacaatgaaacaccatcgaaaacccactgcaatatttcaatctaactgatgaaacatcatggtacatggactgaaacatcaaaatatttaagaggaaaacccagatctacctcttcctctactcgactggccggtttgcaaccacatctgcgtcgacgccgtgccgagctccactgcatccgcgtagc

SEQ ID NO: 42269 - DNA, 1501 bp, Oryza sativa
gagaagggttgtcgccttgtcttgtagggcctacagtactatgtcaaatgggccctggaatatggcggcggcgcgcgcatctggcctattgggcttttgtcaactgggccctgagcccatctgggctggttgtgtaggcctcttgacatactgggcttctcctctgtccactgtcaaatttcgttaagcatccaaaaagtcagatggaacgacaacatgcacaggagattagggaaagaaaatgcatttttatattaggaaaagaaaatgatgtatttttttgctgatcacacggagttactcgcacgcacatcacacatgcatacgcccacgagaatgaaagtgcgccccatgagccatgactagccaggcaattggcataggtttatatttgttttctttcatttcataaattatttgttgaaaattacggcaatatcaaagaacttagtttattacgacgacatcaacacgtgtgctagatattaaagattatatttttctgcttagtaagaaaaattggagcactacaattacgccgattttttatatctaggcagagggacaccatcattaacacaactgggtggcccgcgcaattgcgtggctagcacccatataaatttatatatttttaatatgattttatttaaaatttattaaatagttatctcgttgtcttaagattaaatagttaccaaaccttatcatccatgtgtttttaattttatagtttttaaaagtcacaccagttgctaccccttacttttatcatattattctttatttgcttgctcgatctaccactgtttctattcattctccttggaacctttaaaaattggatctataaacttataggttttagagtttattggcctattgggcttctttttttataatttctagaagtcctgtcaaacgctaccattatactcctctatgaccgtccattgcatcttctctttattttcattgctattttaaaaatcgaacatacttatcgtttaggttcaattttttactttccagaagttccgccaaaacatcagcgactttgtcactgtactcctctacggctcgctcgctgccgcccttctttattgtcattgatattttaaaatcaaacataattatcattggggtttatctttttactttttagaagcccgaatctttaaaaattggaccttatagtttttagagtttattgtctcgttgagtttcatttttttataatttttagaaatcccgtcaaacgctgccactatactcctgtacgacctgtccgccgcatactctttattgtcattaggattgtaaaaatcaaatataactatcgttggaattcattttttactttcttgaagacccaccaaccattggcggctctgccattgtactcctatgcgacccgcctgtggcctctcatttttattgtaatcgagattttaaaaatcaaatgtgattatcattgaagtttattttcttactttctaga

SEQ ID NO: 42270 - DNA, 319 bp, Oryza sativa
acaatcacttctcaaatttctcaaattattagcacttaatccatcctataaatgctacatccattcttttttctattttaatataggaatatatcaaaatggttaccgtgtggttttctaaaactttataatcataaagctaggttatatgtcaagtgccaaaatacctaacatttcgtgcaacttgatgcataaataggtgggatttaatgaaatttactctagtaatcacccttaagagctcgggaagcgtttccgttaatctatgtgtccatttcttgaaaaaaaaagacggggtaaataataatacgagctgaga

SEQ ID NO: 42271 - DNA, 1501 bp, Oryza sativa
acctatcgttctttggtgttaatgcagtattcaaattgcccggtgccatgttatatgcagatgattagtattgcatatagttactaaacaaatttgacagagaattgcatacgtgtttatgttattttatagaactaattaatacaaaacatcataattgtgttctttggtaggtgcaaggttacttttttgtgctgaaaaagaatgtgacaaaacagtatacatagatgcaacataatgtagatgtaactaatacaggatatcgtaattgtgttctttcgtaggtgcaattttagtttcttctgctgaaaatattatgacaaaactgtataaatgcttatgttatttcctagttgcaagatcatgtagccctaattaatagaagatggcatgattgtgttcttatgccaaagatgagtcgctggaattgactaatgtcgcaaggtgccgcagacctattctgctccgtccgccggaattgactaatgtcccaagatcgtgttgctggcggggtgtatgtatatatatatatatatatatatatatatatatgtatgtaagccttaggaatattgcctcacgtgtatagaactaatttttggtgtaattaacaatcttgcctcgtgaaactaatcttgccatatgtaatttaatttattttgactggatatgtaatttaaattttgctttgagacatttgaaatcttgcctcacgtacacaattatagaatctcttggttcacgacaaatatatgggctgcacgtgcctaaaatttgctttgagattgattttaaatcttgccttacgtacatatatttatgggactaatctttgttagtcaattatgaaactataatcttcgttggtttaagtttcacgataaatccatgtattgcacgcgtcggccctaggaggttctcaacttctctctgttacgccacgtggcaatacaagaacgttttgagagagtcacatggcaatttaagagcgtttgtagagagtttaatggacttttagtatataatagaagatagatagatagataaattaccttttagtttcaattgactgatgtgtggtcctctttcctccttgacttcgtggatggatcgagagaccagtatgcaataatagatacacgatcataggaacacctgggccgacatctgtcgatgcaatcaacgactcctctcttgatgcagtatcaaactatcaattattaacgagatatcccagtttctagtttataggacatgcacactaaacacaccagctacatatacggtcgcttggtaccaggctaccagctagacgtaccatatcagcactgtcgtccgtcgactcgtcctcagggagaaaaaaattaagtgtcattaccagacaatcgacttttcctgacgagaaaaatcaatcttagccatcggcccctggcacctgcaatggcataggtgaggaatagttaatctgtcctcaagggatataagcgggcaccgatcaatc

SEQ ID NO: 42272 - DNA, 364 bp, Oryza sativa
ctcaactactaattttaataatacaaagaacatttcagtaattatttaaataataaattaatcattaaatgatcttgttttaatgttgttaaatacttagagtgtccaagtatgttcaagatttttcttgaaattatttgagcattggaaatatttttaacaattcaaagattatttcattggttaatttatttggagaagtaattaaaaatcctctctctttcttgggcctaatccacgaagtttacagcgccgaaagtccgtttcatgtccctacttcttctcctctcgggccagcctttttccccaaagtccacaccacgtcccagtcgctacagtgctgtcttcaacctctggccggaga

SEQ ID NO: 42273 - DNA, 1501 bp, Oryza sativa
ttgtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgtcatcactgttttacttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatattcatatcacctggacaccatggaatggtttggttattgtggaattggcttcacaccgctccttctattcaaaatccccaaaaatggttttaggctgggctcggggtgcatggttttgacagtagcacctcggccatataaggaccggtcttcgggcctctgttgcaaagcactaccgtacttccacatgtctagtgggtaaggcttagtttgtggctcagtctagtcataaacaaaagtacacggatggagatggaagaagtcgggggtcgatggacatctctaggacaaatgaaggctacacgagctgcggcccggtagttgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtgctggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggcgttgggttaaggcaggttcgtgtgggttcacggccttgataaaaaaatattgtatagtactagaatcgtgtttgcaaaatagccctgagcaactaatgtctttaaatgctgtctactgcacccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgc

SEQ ID NO: 42274 - DNA, 1501 bp, Oryza sativa
gttaccatggaacacattggcatcacattttcttggccacggtagtcaagtaaaagtcgaccaacttttccttgggacactaacgaatttggatcactgaaaactgtaacaaagttttcttcaattgccttggatacaatgagatcaagaataatatcatgcacacgacaagtccttatacgatcgtcaaataacattttttctggttggatcaaacttctgttgataagttcatttaaatagaattccccttcctccattatgtttctcccacaatttaccttgatgaacccttctgctctccacctccttaacaactgctgcacatcgatctcacaatcttctgggtacatactgaaatatttgtaagcgaaaactcaaaatcccttatatcgtgggacggagggagtgggaaagggcagggcccaggctccactaagcctgagagaatattgtgctttattcacatttcacgcgcctggtgtgaactaacagcgaggctttctgcgatgctgccggccaatagtgaccctgcttgactaatggcataaaaagcttggtagggaattgatactgaattaccagtcactggataagaaagacatcgttataggcctgtacaagcatttgtctcaagagagcattataaagatcaaatgatgagataaggtagagaagtgagggctgatgagagagtggatgaacaatatctatataaactcaaaaacagtacaaaaacaagcactagattagtagtaagcaaatgaagtaaaaaatattatggtttattagggcaagtgtgctagaggtaatttgttgtgtatgttattaataaagattaggcgagaataaataccggatgttattatgtttagaaaaaatcactggtgttgtgggtggaaacaaatagatttttgggatcacctatacatttgtcgataaattttcttttaaaaatttgacagatataattatagtataatataatttgtctgtgattgtatgtaacatgcaaaaaaatctctctgtaacatgttatttcgatgaaacggaggtcgtgaaaacgaattctcacatatgtgcacatagtgacttttttccttctttacttgaacaaatcttgaaacggtttaaaattatatgcaagttacattgtagttacatacaagttacaatgtaaatgatgatgaagattagcccgtaatcgcatcacttgtacagatggttttgctgtattgggccttgtttagtcaccgtcatttttgcgggcgggccatcttctaattgggcccgtaggctgttcacgacactttcgacgtcgcaccggacggtgacgcattccccgcgctcgccggcgccgctcccgaacacggccgtcctcggcggtggctcgtactactcgcgcgcgcggcgcggccgtcttggtcgaccaggctaattttgcacttcagttggtcctgctgttctgttcttgccgaagagccatctagctccagcaata

SEQ ID NO: 42275 - DNA, 232 bp, Oryza sativa
ttcgcgctacgtacataatattgatggtattgagaaagatatcgaattaatcttgcaaatgacgcatcatccgttttgtccgcgttgaaataaagtgtcaccaaataacacgtaacagaaacacatttcttgatcaaaggagaaaaccacaaaaagtgattgattgattgatcattgcggcccatcagctgaccataaacacatggagcttgcccatcatcaggccatgaca

SEQ ID NO: 42276 - DNA, 1026 bp, Oryza sativa
gccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccactcccgtggaaccggtccgcgcgctcctctctcccggctgacgcaataaatatgtttttaaattaaaatttaaatgaagaaattcgtaaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttgtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgtcatcactgttttacttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatattcatatcacctggacaccatggaatggtttggttattgtggaattggcttcacaccgctccttctattcaaaatccccaaaaatggttttaggctgggctcggggtgcatggttttgacagtagcacctcggccatataaggaccggt

SEQ ID NO: 42277 - DNA, 1501 bp, Oryza sativa
atgctacaccgctcaaaggcttgtgcaaatattactggaagtttgtgtggtcatgaacttcatttggtgagtgtttgagattcttctcaaggttgtttatttttgaagattcaaagaaaccttgcttttttatatttttaattaattgtgaatgtttttcacatttgtaactgacgcgcaacactgaattataaatttaaacctttcctgtacattattcaaggtgcctaatgtttatcaaacaaattctttttttgtcaatcctctccacctatttgtttatatctatgcaaatacatcatgagatgcatggacaatctaacaacaccaaatgaattcaaaagacagagacaaaatcaaaataaaaaatttactaattatttctttattttcttttctttgtttcttttttttttacttcaaaattccaggtatgttacatttgatgcctcagttttggccactcatcaaccccattcgagtacttctgtcttcttgagagacaggccaataatcatcaatggcggccacttactgaatgaagaacatcgtgtggcatatgcatagtatttcactgtgttaatattctgtaagtggtaccaccaatgcaaatacagtttgttgcattattgtatatatataattgattgatcggtgcccgcttatatcccttgaggacagattaactattcctcacctatgccattgcaggtgccaggggccgatggctaagattgatttttctcgtcaggaaaagtcgattgtctggtaatgacacttaatttttttctccctgaggacgagtcgacggacgacagtgctgatatggtacgtctagctggtagcctggtaccaagcgaccgtatatgtagctggtgtgtttagtgtgcatgtcctataaactagaaactgggatatctcgttaataattgatagtttgatactgcatcaagagaggagtcgttgattgcatcgacagatgtcggcccaggtgttcctatgatcgtgtatctattattgcatactggtctctcgatccatccacgaagtcaaggaggaaagaggaccacacatcagtcaattgaaactaaaaggtaatttatctatctatctatcttctattatatactaaaagtccattaaactctctacaaacgctcttaaattgccatgtgactctctcaaaacgttcttgtattgccacgtggcgtaacagagagaagttgagaacctcctagggccgacgcgtgcaatacatggatttatcgtgaaacttaaaccaacgaagattatagtttcataattgactaacaaagattagtcccataaatatatgtacgtaaggcaagatttaaaatcaatctcaaagcaaattttaggcacgtgcagcccatatatttgtcgtgaaccaagagattctataattgtgtacgtgaggcaagatttcaaatgtctcaaagcaaaatttaaattacatatccagtcaaaataaattaaatta

SEQ ID NO: 42278 - DNA, 593 bp, Oryza sativa
ccttttggctcgtggaacacagatataaatacgggcgcttaatctcatgcaactatatagtatttgctttaatgttcctatcaatctcttgcatctgattcttaatttgtaccgagagtacagttcaattaggaggaactaatacaaacagcacatggctcatctactccctattccaagcaagcagctcaatctgcttttgctatgaattcatcagcaatttctccattagttctgccaggatatataatccagtgcatacgtgaagcatcattcgaagaactggaatcacgcggtgttgagggaagacaggcgacttaattagatggggatatcgatcactaagcatgatcgtatgccactgtgaccagaaaagtgtcttaactgctgtgcatgctatcgatgcttcccaagcctacatatttcgccaaatggttcatattcagtctaattaattatatagctcgtgccatgtctagatgggaatctctaggaagagtttagaccttctgagtttgaagcatgatctcagagtgtctaagaactgaatttctgcatacacacacttgattgtgaatttgtagttttgtact

SEQ ID NO: 42279 - DNA, 151 bp, Oryza sativa
atggttagatgtttgtaatattcagagatctgcactttcagcatttttggcataaacaagatagtgttatgccaactgataattgctttcaacttcattgtttctgaacaggattgacctcaggtgcaaactcgtccaagagtgcagaaga

SEQ ID NO: 42280 - DNA, 234 bp, Oryza sativa
aatggtgtgatgacgccagttggtgatgataatattgtgctcgatgatcatacacaatattctgcatgactttatttgtaaacaaagttgtattgtggcagcgaagcaagaagggtaacaaccaggtgagttagtgtgggctttagttgggccctcgatgggctggccaagcttccactgacacttgggccgcatgaaggccgaccaccacaagcacgccgccgcggctggcca

SEQ ID NO: 42281 - DNA, 1501 bp, Oryza sativa
tgtattgatatgaaatgtgtgctacatatgctgctgctgttggtctaactcaaaacttatgtttgtaaatgatgataacatgatgttcattctctggtaatataatgtacagtttcatcattggaaatttggatatgtcatattttatttgaatttgcatgcatgtatcgttattgaaagtgatgaaaaaatttcatatctcactcaaatttctgtacttcacattcccatgcacttctttttttgtttgggttgtttgcatccagcacgcattttttttacagaaattgtcagtttgacatttgtaccatctctatggtagttcaaactactctatatgtttaggagattttgaattgagagaagacaacacatgcatatatgtaataatatattctgacttcatcatgtgctgaaacagaaaacagaacaatgcagcaaggaggagaccaagtcattttttgtgtctgttggtgggtctgtgtggaggtgggcatgccaagccaacataaggtgccaaatagaacaatttcaatgcatatggaagacaggtatgccattaaaagtgttcagaagaatcccaatacttggtccaattacaaagcatgaccggttggtagtctatgattcagaatagttaattgtgtcactagtatgtacagttcattttataattgatgctgatggaccctttcgcaaaggaagaagacttgcaatcctgtgaaacagagtgtggcaggcaatttcaccggtctgaacatatattactcaaaagttggttcagttacagaatatctggagaaataccagaggtaataatgccttttcaccctccaattgacattttaactagtttggacgcacagttccagctgaattgaactgaacagtgaatgcaactgaactgaactctcctcttaccatttccagctggacgcacatttatggtcttcaggcttgcagtgcaatctgtttacatcattattttcaactagtttggtgaggtgagtatattttctgctgaaatcttgatattgtactattatacacctctctatctcaagttattttcttccattttactataggactagaggaggtcagggttattaacataataatagtagtaaaaagggaaaatccatatggcatatggagagttaatatgtgctttacttgggcctcgataggccagccaagctttgactgacaaagggcccaataaacccctttgaccaccaccacgtaagcaggtgacaagcaagccagtgccatggccattcactgacaagagacaactgacaaaaggatttaactttagctagcccaggatcggacagtcaaaatcaagagacggcagtttcaactagagactagactaggtcactagaatgatgtattctcctggatgacatagtcatcccacaagactcgcttacaccaactttgaattactcactttttcctcaccagaatcatgcattaatgcatttcactgccc

SEQ ID NO: 42282 - DNA, 1501 bp, Oryza sativa
ccaaggcccatcttagtcttgactcttgacaagccagtctatgttaattaatttcctgtatgttcaatgcaaatgtacatgttttacatctgctagctattgttcagttcttattttttttctgtcacagttagttattttttcatacacgaattttaaagcaaatcgaatggttcaaaattacatgatagttacatgtaattacaatgaaattacattgagattgtactaaaagtttgacaaatgtaaatatagtacaatctcaatataattacattgtaatttatatatagcaaaatttgttgacagaaaaaatttcattgtaatttcaatataatttttagaaaaaaacgtcgacaaatatataacaaaatcggcattactatctcattgctgaaatagatgagcaatatttatctcttgggccttatttggatgggcctcaattctggcccacccacgtgtattaatctatgtaagcgggctgtcatttcggcctagccaaatgaggctttcaagctgttgctttcggcccagtccactgccgcggtgaccgagagcgctggcggcgagcggcggcgccgccgccgcagccgccgcgcgcatggcggcacggggaggtaggaggcggagcatggagggggaagctagctgcgccccggcgcgacggagatgaggaggcgcaagcacaagcgcacccaccgactaccgccgcggcgagcgctcgaggtatgcacgctcggttcactcgcatctccggttggtttactgttgttaccgccggcgtcccgtcagatgatggagaagatttttcaccgcctgctcgaatgatgctaccatctttcacactagggagtaaaattagcgagggatcaatttgatttttctaccatctgttcatactaagggagtaaaattagctaggggtcaatttaatttccaccatggatgtgctttataggtagttgcatcgtcaacaactttagaagttacttacgtttgctttcacattttctgcaatagtgataagatactaccgtctaatcggttttatgctgtagaaaaggacatcccattatgaaagggaaactgatttcactttcgtgtacgaggaaaacgtgatgccaggcatcggactagatattattccgttcttctccctaaatgattaaacaatgaccagagtttgacaagggtcattgaagaattaaccaaatgacaaagaccagtcacctcatcgcaagagattgttgtagcaaatggtccccatttggccattttcttctccttgagaatataacaaaaccaactgagtgcaggactcgctaaccacttttgacccattaaccctcaaaagtcctgggtatcacaatccattcctatccacaatagttttttcttcttcttttttgagccatcagcggagggccgaagaggcccacttgaacatttcattaattccacaataatctgatcactttcttctgtcccttccaaatat

SEQ ID NO: 42283 - DNA, 599 bp, Oryza sativa
ctttttgcgattcaaaggagaccttagggcatgttgatccaaccctaaaattttacgccctgtcacatcaaacatttaaacacctacatgaagtattaaatataggcttagaaagaactaattgcatagattgggactacttggcgagacgaatcttttaagcataattgctccatgatttgataatgtagtgctacagtaaactatggtaatgacggattaattaggattaataaactggtctcgcagtttactagtggatactataattagttttttattagtatctaaacaccctatatgacaccatatataataattgatgtaacactaaaattttacacgtagacacccctttagcatactacaaatcggtagaacaacacgtgagctgagtagtacgagtaatcgagatcaggttgtgatgtgaccgaccaaacaggacgacgtgtatactgttgcagtagtacattgcattggaggcagattaacttgtccacgtggcgaccggctggcaaaatttgggctttcttggcagaggagaggagcagtagcagctttgcaaattgccattgtctcgtgttgctcctctctgcagc

SEQ ID NO: 42284 - DNA, 1501 bp, Oryza sativa
cattagttccaaggcaatgtttgtgtgcaagcaatgttgcttatcaccattaattacctctattacagaactcttgatttctgggagtaggtcttgtgatgagccatggggtgtgtagacaaggtcaactttcatatgcgggcattttttaagagaaggcttgcctttgacaattgttccctgttctctgaactcaggaactgggacatggcactgcaaactcacttcaataactggtcctagagaaacaccctgtacagatggcattcctagattgctactttcacagctgtggttctgaccatgctgcttgcagcataatgggttagggcgaaaccattgggtagtaatgctgtgaatattatcccagtgttttttgtggcatgattcagcatatggcacccaggtgaaatcttgtgaaggtagctgagtaagttcattcctaacagattcagctgtagacatgaaatggggattaaacagctgcaagcacttgattacaatgccaagtatgtccacactctctgaaacttgtagcagcatacacaggaaaaaatcatcctccagtgcactagcatttttactgtcaaagatcagcctagcctctattctattctctgaaatacagaagggccgtatgacaaacaaccggtacttattttcagacactaatttatactctagtgttttgcctgcaagaagttgcctgataagaggatcaaagaacaagtactgatgtggtgttcctccaaactccacaaatctcaaaaactcattagctccatctgcaaaccactcaaatcttcgaacagcagatctacatgagccatcgatattgctgtaaaataaggaggacactaatgacttggtggcatgggctattcgtctaggaatagaggaattccttacttcttgttctgcctcttcttgttccaggatgcgttgccggcatttgcgcagtgtgtcatcgcactcttgagcagcacgcttcagcttcttctgccaacacagtaatgaagaatcagtgattcgccacttacaggatgtctcaagtgcagcctccaacctgatgtgtgccatctcaagcctctccatgttctcctctgcgcttgattttcgctcattccagttcaccaagccatgtatgatttggttgactgcctcatgaacaaccacagaactaacaatctctgccattaggactcgatcacatatcactatgcccaatgtaataaagggacagatcagtgattcctgatctgtaatgaattgctctgattatagtagaactacttcagcctgctgagtttgaattggtagaaaagaacctgggatggaaggtattgccaaagagcacatgaagtggcactgtggcagtataagaatctacccagcaggctgagaccagattgcctgaatggcgagctcacaattctgtaatatatactgatatttggaagggacagaagaaagtgatcagattattgtggaattaatgaaa

SEQ ID NO: 42285 - DNA, 1501 bp, Oryza sativa
gggacttctcccagtagctagcagaatcgatggatttggataatgtgataggcagggtaagagaaagaatccagtcagcagctgcaacaatcagcatggaatctatcgaaactagaaaaacctgacaagaccgtgagctatgtatcccatcccccatttatacatagaacacactcgggtgtgcttttttttataatgactgtttaattcaccggcatgcattccaagcttataaacgattttttaataaaaatatatattattttttaaaataatattttaatttatttttcgatttcataataagctaatgagaaaaaaatcagcaaatctcacgttttatggttaaagtagtataaaacaccacacattatgaccgatgacacataatctcaactattatggttttaaagtttcacaaagccagactcctatatatatttgataaatatttatttaaaattttaaagcatagaatgtatatgaaacttttagttattgattatcggtttaactcttcgctatttaaaaaaaatattttagatatactaaaattaattgaaaatttgaaattttaataaaagtggagctttataaaacatttacatcataaaacttgtagttatgtgccaaaaattataatacccgtggttttacgaaactttgactataaaacgtggtttatgaaatttactctgagttaattcgcttcattgtactatggatagttatcacaaaatcatttaactatttagccaattaactattaaaagatgcatgttatttatactattagcaaagaatacgtgggcttactacatcaacacaatatttatacttagggggtgtttaattagatccaggggtgtaaagttttagcgtgtcatatcgggtattatatagggtgtcgaatggggtgttcggacactaccaaaaaaaacttattacagaatccgtcagtaaatcacgagacgaatttattaaacctaattaatccgtcattagcaaatgtttattttagcaccacattattaaatcatggagcaattaggcttaaaagattcgtctcacaaattagtcgtaatctgtgcaattagttattttttaagcctaaaatttaataatatatataggtgttcaaatgttcgatgtgatagggtgaaaaattttgaggtgtgatctaaatagggccttaaatatgtgcattcatcgtctaatacaatggatgacttgacggtttgcatgatagatggccagttttagtaaaactagtccattttttttatgttatattggtatacagatgccaatccaactctctatattttacatgcatatttttcttctaccttctaaaacaacaatttgtagggtgtcagagcaattgccttactgacattgaggctgagtttgattcagctacttagtagctattctatttcctcagtttttataagggcatgcttcctaaattcctagacgatgtgtttcgtgcaaaaac

SEQ ID NO: 42286 - DNA, 279 bp, Oryza sativa
gtaattttgcatgaagtttcaagcaaggttttgcatgatatctaagataactattttttccgcaaattgtgcaatgtgcctttttttttccatgggctcacttcacattctattttcagttgccaacagatgttacaaatttacaaaacaggaaataagaaaaagcaaaagataactccattgagaaagcaacatcaatgtgatcatgggagggagtcgtagatgcataactctattcactgggattcaaatattaatgttatcatttatttttgcaga

SEQ ID NO: 42287 - DNA, 227 bp, Oryza sativa
cactattttaaagttccttaaacacactgataatgaactgaaagaggacttcatttgtatatctgctcatcatattcttatggttgattgggatttgtattatcaactcaatgttggagaacctctaaaccttgtcaaggatagcacatttagcttgagtgatgatttgaaacagttaggatttctttcaagcagtctcctccaactattgtgctctttacttgagc

SEQ ID NO: 42288 - DNA, 1501 bp, Oryza sativa
tggaactatggacgaaataatccgtgttaaaaatttacgattttgttatatatttgtcaacaatttttttctaaaaagttaacaaacgtaaatatagtacaatcacaatgtaattacattgtaacttgcatgtaactacaatgcaattttgagccgttcagtttgctttaaaatccatgcagggaggtagaaaatgatgacaaccttggtaccattataccttcattttatgaaaaatagcatgttacctagcgatttttaaaagttacatataagttatactacaattacttacaacatacaatgtattacatcatgattctactatatttatatctttcaaataatttagttaaaatttgactataaatgtatagctagtctaagatatttttcacaaataacccttgtgaaaatatatattacaaatacacccctagtgagaaaaatattcccttaagaatagaaatggagctttctaataggtagaaggtctattttcagaagaagaaaaaaaatcagaggttcattgtttgctaaaaatggttttaaaaataggaaatttgtgaataaaactacacgttaccattgatcatttttttttcgaacggtcaggccgttgccgacattttatataaagaagaaggtgtctcattttaaggagaaaacgagaccaaaccttacaatgcgtagttaattagggaaaactgggcgaaaaccacaacactcaaacctaagctaccaacaccgcgaaaaaagaaaaaatggcggagcccaaaacaaccatcgataaagaacttgttgaaagcgacacaaaggcttcgacttctcggggcaagtgttatcgttgctgagcttgttgcctagcgatacaacagcttcgactccacagctatcacatcatcgttgccaaaggcatcacagaaaacgagcaagacaccgaatgaccactttgaacatcagcccaagccacttgagcactactacttgtacacagctaacaccaacctccctcgaaaactacaacgtgttatcgttgccaagcttcatcgcatcccaataaagcagctccgacttcacctagaagaaaacgaagaaagttggacgcttgccacatccaagagcagcacccaggagacgaaggcctcgccaaatagctaggcttatagagcttcgacatgggggatccacgaatgaccatccttgcatggaaaaggttcttggtagcgagagagacgccataacgacgcctccaaggaggggaacgacgcttaatggcgtcgccgtcgtcaagccaaccaaaggctagccaaggctttcgccagcgtcatccaaaaccacacaacccacccgcataacgtacatcgctggaccgccacatcatccctctagccaccaagcctagcccaccacccacaacataggtaggctcgcgagtccgccgtggcaccaacctgtcagcatcctctactgcactgacaagatctggccaaggcggcca

SEQ ID NO: 42289 - DNA, 329 bp, Oryza sativa
cctgatctgaatgtagactactacaatgtgtatgttttaatttgaacatcctttttccagagaaatagtttctgatgcataggtgatttaggatttgtacaaaaaacggaaattgaaaggtaataactatagctagtcagatactctattttgtagtttgatgtagttattctttgcaaaataatatatgataccatttctgaacttttcaaccttgaaaaatagtaactatagctagtcagatactctagttttagtttgctgtagttattatttgcaaaataatacaggagatcatttctgaacctttttcaacctgacaacctcga

SEQ ID NO: 42290 - DNA, 198 bp, Oryza sativa
atgcattagcagcctaacttgatacagtgcttctggttgaaagtctcgaagcaactctctcttttgactgaattcatttgtcaagtagcagtagagtactagccttgccaatcgatcgagaattcgacatagccactggtgtcagggtctcacggctcaaggaaaaactaatcctgcctggctgacaaatgttacaga

SEQ ID NO: 42291 - DNA, 1156 bp, Oryza sativa
aaatttgagtagcatgttgttacatgctactcgtggaatgaccttctggtaatcagtttatcctttgctctggtctttatgttgtatggtccgattcatgcaacaaacaaatgttgaattaatcttctgttctccacaaggctcatccgccgtttggcatccttgtcagggtggccgctgcaaaatggaggtgcaatcagcttgattatcttctcttgatttactagtatacctttagccctacttttctgggcctaatttcatgttgcttatgagttacatgaaccattagcagtgaaatactcattctcctgtctcgccttaaaactgattgatcattttcatacgtgaacactagcctgccccttgaaacgaatgaaattatcctgtacatgttactttctaactgaactctcctgctacatcaatacatataaggcatttcttgcctaagttttcaaaacaagaaaaagaaaagaaaagaaaatgaatgaacgaatgaatgttacttcactagctagtagcctagtacgaagtactatttatttaactagcgtgcatatactagttactttgatagattgctacaattcgatagagaaaatgtgaaacttcttaattgatttgagagagaaacaataattttgtagtgttctatgtagtgcagcttggtgagcctaacgtattggactggaccagcgctagagctgctacataaatgtcatttcatattggccaagttttatagtcgtatctggctaactaacccgtacgttggtttcgccgtggtgtgcggctaactgttcctactatatgcgccgtgacaagtgactcaaatatgtttcttttattccatttgcaggcccggattgacttggtcagtcaggtacttcgtgcgatagacaatgcacggtcagagaaggcgagagagcaaagtcattgctccaagacttccattgcttgctagtctgaaagcaaagcttgtgtctcattcagaatgaacagcacataggctggcctctccgtgcatctatataaactggccctgatcaatctcatcttccatcagagcaagctcatcacttcctgcaaactaaagctactcttcagtgggattgcatttcgaccgagctagagagatttatagctaagccaa

SEQ ID NO: 42292 - DNA, 1501 bp, Oryza sativa
taaatgggggatgggatacatagctcacggtcttgtcaggtttttctagtttcgatagattccatgctgattgttgcagctgctgactggattctttctcttaccctgcctatcacattatccaaatccatcgattctgctagctactgggagaagtcccacagggttagttgcatcatcacgtcaagcatagcagataaacaatggtatgatattggatttatccctctgatgattttatatctgcaaattaagaggtcgtttgagtaacctcatggctcacctttgtgtgcacctttctaaaatctcccattttccatcgttcttttgatgttgcaattgtctttcgtttcgggttatgcgtacatgtgcacggttggtaagaaacaattcggaatgagcacaaagaaaagggaataaggccatagctagctaaatagaaaaattggcatgattgtatgaattaaagacgtacacacaccatcatgtacgcatatgtaattaagtacacgtatataagtacggctccttaacacagaccgaaatgggggcataaatcaaagacaatgaaattcgatggtgaaagccatatctgattaatgagagaacagattcgccatggccacaagcacgcattagtaacagggaacaatttggttccagaagatcatcatttcgtccaccttttcagaatccatttgccgactcaaattgccaagcttaattaattatgccaaagaatcatcgcactataccattaccatcaatcatgcaagggagagagaagaggtggaatcgagcgcaacaatatagtacgatatgctacatgcggccgcatctgtcaaactgtcaatgtgtcattatattgtgtgtgggcttgaagcaggaaagctaccgaagcactgcacagagtcacacaccgtcgatccagtggagactcagaagagcgagacacacgatccacggcttaaatcttatcttagctaaagctacgctttggtaacagctgaggctactccgaaatctgaagaatctgcactgcagcagtgcattgcatatgcttggccatggagatggccagggccagggccaggcagcccgacagattaacagcacgggggggccgggccatacgtactgcgtactctgaatttcacgaaaaagcaagcaacagacagcacaaaagtcccaaagttagggaagaaaacaaatccatgtgaccatgcggtttccgctctcttttatctccctttcccttggtttaattacccgtaagccatcgcttaaccacacaaacaacaatacttcgtctcacatttctctctttcttttatattgattttcttgctctttccgggcttaattaagcttgcacgcaccaaccgtccctctttcgctcacactcttccttccactctcccaatactcactcactctctctaagtttttgtgtataaatatgtacacgtcgttgtagtggctctgtgctcgctagcttcgt

SEQ ID NO: 42293 - DNA, 950 bp, Oryza sativa
ataaatataggagtcaataaaaagcaattttatttcaaggtggtatcaatatctttcttataatcataaatcgactggatttaaagcaacaatcaaataggtatgagtgtagtgagtgtcaattcgttgcaccacaatacaaggttcgatttagtggagttgctttcggttgatgtgtcatcgctttcgactccttatccactaacttgcatgtgcagagtatgtatgtaaaatcaaaattgacttcatccgttacaacacacgagcactgtgctagtagaagtatagaactcccccatattttgtaagaaaaataacctagtagggccaactcaactttatttggtagtagaaaaaagataattttttggtgagtagtactctcaaatgaggttgagtttcaacttattattatttggtgttaatatacttcatgcctatacttatctctagtaaattttttctagcaaattgtctttcctagctgaatgtaatataagtttataatctttcagatgcatgaattatttaaccaaatacagagtgttcagttatttggaaacgtgaatctttttctctcacataatgtcgatgtttaagcattgaaactattggatccatgccattgtaacttcttcggttataaaaaaaaatgacattactattcacttattaaaaatgccattacaatttgactaaaattagagatataccactacgtaccccttcaatgcacttataaaaaattttgaaccaaattacccctccttcattcacccccttcttccttacactagaacctccgccacccacacactaatgttgaaggtgaaccaccccctcgtgtcctcctctactttgctttctcccctaccaccgccaggggagctccaaaaagggtgacagcaagattcgagcttgaaggggctaccacaaaccgctcctcgaca

SEQ ID NO: 42294 - DNA, 1501 bp, Oryza sativa
cactaatgaacttcattgccagatgaaatagatattgtggaacatccatttagtaaggttcatcagtttaagtttactagctcaatattaatttaactaatccgagccagaggaaggcaacaaaactaagttatgatcacaattcacaaaggcagatatagaaatcctgcacacaacaaaaggttgagcttggaggaaaacaaagctgccatgccaccaaaaggactgcaagtgacctgtcatcatcaagttaatttacaaacaccgtatgcaaattcataaacctcatccttaaataaaacgaacacctacccaaatctgtgtcaaaaaaacaaacacacctacccaaattcagcctaaaaaaatgcagggagtcaggtgccctatttgcatatggtcatatacgctagtgcgccacactgtggcttaggaataatcaatacgtcaagagactgatgcacatggtttgtgataggctacaggagaccaaaaaaaaaactatgtagtttgttaaagcattaagtaaacatcaagtgaatgtgctatatgcctatttccactcaattgttttcagaaaaagctacaggaacaaaaagagataaaaaaaagacaagtgcaaaaccacaacattgacagctttcaatctgctgtattttacttcaaatgacaaactaaaggcatggagttcctcatggcaggcttgttggtactatacttaagaacattgaatgatgagtcatacagtcaaatcctttttagaataacatggccaaaaatcccagctccatttaactgaagctattacagcagtttaaatgtagtcaaatctcccggtttcgaagtctggactacacagagtcaaccacttaaatttatcactactcactagggcacgtgcaaaaacggaatattcaatatatcagttccaagagggcttcccagtcatggattgagtattgtctcaaataagaagaaatgtaaacctgaaagatagatcctgggtaacgataataagcagttaaacgagaagaaacaagttgcgtgagtcatcctttctcacttgcattacaaactgaaatcaaacattttcattgcgcacgatcacatactttcttcttacttccactccccaccaaaaaggataaaagaaaaaaagaagacttaaagttcaaaggactagctctgtaaggtagaagcagctcaatggatcggtctgaatggatcactgcattccagctggctgcgctaacctcttcctagcaagatctgaagatatgcaaagaatagaactcataaccatatataatagctcaacatgaacacccaaataaggcatgcaatactttttggggaagtataaatgtataatagatcaagtcatcaagatatgcctaggcaatttagctaatttcaggaacatttcgtaacatgtactagaaccaaacaaaaaattgggtaagaacaacagagatctatgtgatatgtgacattgaattttgat

SEQ ID NO: 42295 - DNA, 1501 bp, Oryza sativa
acatctattccagcagatgagaagtccacctaatcagatgggcagggttggcttggttcaatttaagaaatctgaatttggcaaatttaagaaattggttcaatttacgagcagcatcatattagaaatactgacatactcgactgcaaaactattttcaagactaaactgaattggagattgatgttcccaagtactgtgataagaattgagatagtgtgaagtgcaggaaaccaaatagcactactacggatccgggcttcagtgacgggtcatctgtgacgggccaacacaactcgtcaaagatgagtcatctctgacgggccgaaaaaatatcctcttcaatatattgctactagggaggacccatcacagatgtatcgtttactaataattagctcttcaacagaacctgttgctcatatatttgacatggttttgtacagtagataataatcaagattcagtaatgagagtatagaagataccttgctgcacaaccatattgtggtgtattataacatttaaatataatatgtgtttggtgataggagagttatttgtacccatcattcacgtggttgaatctgctcttgagttattcttttagtcctgagtttaaacatagtgacaggagtgtaaatgcagtggaggaaatcgtgtatttaatgccattggctcataactatgtttaatagttttcatttggtgccacattaattttatctgggcacttacgatgtgaaaaagagttttacaaattaaattgcttgtgcatctattatgaattatggaatgattactattatggaacgtgtcatggttaattttcggttgtcctaacatgtcttgtcatcctgattgttggaggatacgcctttttttattacttgattttaaatgtcaccgtagcgttagcacgggtccatttggaactatatatattagctgcgcattgtgtactactcatgaatgactaggggaactccatgcatgggttattttggctgtacatgtactgctccaaattgagatattttccaaattgagctattttccagttagtaattattaaattattctcttgattctctgatccctagaatattaattattattttgcaccttgcaattaccaatagggatccagtccagatcgatctcgcccctcatctccatctccacgccgccagatcgccatcgctcggattctggtgcatatcgtcgccaatctgatctccgcaccgcaactccattgcatccctcgccggtctgctccgccaacacgttgttgccacctcctccgcctcaagcgccaccacagccaacccaaattccctccgccaccgagaggaggtacagagcaagttaatttttaataaacattaagttgtccgaaatgtagagcactaaaatgtgcattgttattgtcccttcacattagtgtctcgagcattgatgctgaataaaaggaggatggggccattgggaccatattata

SEQ ID NO: 42296 - DNA, 156 bp, Oryza sativa
attcctgcagcccgttctgcagtgttgcggttaatttgcgtttcctcaagagtagttctcagttgctgcatcacttcggtgcatacagtaagggctgagcctgaaactgtacaatatctgctagcctctgctctgcgatgttgcttgctgatcagg

SEQ ID NO: 42297 - DNA, 1359 bp, Oryza sativa
cctgcagcccagattatcgatacatatgttctcagcagaaatagataccaatacatgctttgttgttggtgaagcgctcaacagtcaacatggaagtttaacagcagaaagtagaaaagataatgtaggggtacaatagaagaaactaagataagaaaaaaagactagaagagtactgataagatatgcatgtaataggcaaaagaaacatgttagtcatccacttacagactttcatgatcagagaaagaagatttccttccattttctaagctcactttttgttgcgatgagctgtgggctagattaccatcagacgccaccactccttgttgctgcattaattcaaaagaatcaatgtgtggtaaagagtatctaattaagaaatagtagtgaaaggatgtgggaaaaagttcttcatcgatccaaaatcagcattacacactagtctgaaaataggtgtctaagtgccaaaagtaagtgtgttgtgtgtttgtttgcatgtgcttggtgcttccatgaaggagcaacgatgaagtcaattaactaaaacagagatgtaggtaagaatcaaagtacgccgggtgaacctgatcaatgaccatctcaattttttccttccaaattaaagcctcctggatattgaatgcagccatctggtacaagttatgcaagactgaatgaggaacattagattatttagaaagtaagatgcaaggccctctctccatgccaaaaaaggggaatacctggccaaaacaaaatggtacttaataaagaaaagtggattatattgttggtatactaaacacactaaaaaaggcaaagcatgtcttctgtttgtttgtgctggaaaaagaaacattagattttccacctcttttatttttcttttccaacgtaaaggaaattcctccctatgtgaatatcatatgagagagacagaccaaatagaagttactatatgacatatgtgcaaatgcagtggaagtaaaaaaacaaaaactatgattattatgcttggtgcaatgagtaagggatgaatgagggaaatattaaccgtgatgcgctggtgcttctcccttttgttgtaaacgcacaaaacataaagcatctgcaagacgaaaaatgaaagcaaagaaaatcaatggaatggaatgcaaaggctacagtgaggattaggaatcaagagcacggaagagaagagatgtacatggccatggtgcatcttgaggccccggtcctcaaccctgcagttgccgtcgatgtgaagggacttaatggggagcttgggcatcttgtgctggggcttgcgtttgtagtaggacagcagccgggtctccagcacgaagtagcgca

SEQ ID NO: 42298 - DNA, 1314 bp, Oryza sativa
attcctgcagccctgatgttacatcagttggtttagcatcgttttttactatgatgtaggcgtgtcaacatagtgtgtgggtagttctaaagctgaaatctgggaagtaatttgaactatcggagtagtagtgagaattcctgggtcaagtattctagatgggagggttggaaagctgaacttattttcgccgggtgaaagctgaacttattgcaatgtagttttctgtttagctggtagtgtaaaatatacgtgttcattctaatactagtgtttactatgtgctcttgtaccagttgactttcaatggacagccatggtggaatggccataggcgcatctgatctgtttatgcgatggtgattgacaggaaggaggcatcatccctcctgatgcagtaacttgcgggcgatacttcgaggcgaacaagtgtaacaagaagaagtgatcagccacatgatgggtcagtgcctcgctttgtatgtgccgtgcatcttctttcaagacagaaagttaagagttgaagagcaagaaattcagagttcgcaagggaagatgagagctctcccaggagagaatcaaaagcttacatggaactaaaggtggtagacttcaagaatattggaagtgatcagaatagagccaaatcttgtaattacagctattcatttgcattactttgactcgcttgtgcattcatcttaggcttagcaggtttgtaaaatttctctcttgaaattgtattagttggtacttgtaaagtgagcatactttacgaacctgtactgtgcaaaattacatggactgaagttgtatgaaagtgtgtgaaacttgaatgttagcttgttttcgaagaacgggaagtagtattcatgctagatcatgagcccagcgaattggaccggaccagtgctaattggtcagataagtcatctctggctggctgcccagcgtacatccataaccgtgctgtgtaacattgcttgctgagatgctgaagtgtgtagtattcatcagtggatggacttggtcaggaactttgtgctacgtcagagtgaatatgcatggtatggtcagaaaaggctggggtacagttgtggcatgactcgaggctttgttcttcacgacttgaaatccaaagtccataatctttgcctctacagtctgaacaaatcttgtcagaatgaacaaactttcacaattctatataaacagaaccccacatctcatcttccatcacaacaatctcacaacccatttgcacacaacccaaatttcaaactaaaacttcttcacctgaaactacatacccaa

SEQ ID NO: 42299 - DNA, 155 bp, Oryza sativa
atgttgcagaaaaattgtgagaaacatcaatcatatgatttttcctttgtttcaaatgggttctaaaatctatatttttgaacatgttaatttattcgaaattttcaagcactcatctctacaagtaaacataacttaaaacaatcacgttctga

SEQ ID NO: 42300 - DNA, 1501 bp, Oryza sativa
catatccaatggcatctcaaattgagagccaccgctccggcgcggagatcatcaatggagatgccatctgcaggaacaagtccattgagctgctggaagaacttggcctccccaagggcctcctgccattggaggacatcgaggagttcggctacaaccgggacactgggttcatgtggctggtgcagaggaagaagaagatcgagcacaccttcaagaagatcaagcagaccgtctcctacgccggtgaggtcacggcgttcgtcgagaaggggaagctgaagaagatcgccggcgtgaagaccaaggagctactgctctggctcagcgtcgtcgaggtctacgtcaccgaggcctcgccggagaaggtcaccttcaagacgggaaccgggctgtctgacaccttcgatgctgccgctttcgcgcttggagagtagctttaaggagtcaatcagctactataagctagtagaaatgatgcaagactgcaagtccttaatcttaattactatgtaaaaatggcttgaagccactatcttacatcaccttgtactgttatatcttttgtactattacaaacatactcctacatgagtatattcctgtagtttattattttttttgaacgagtatattcctgcatttgttcctgttctgagaaacaattgttttgcacaagacaacacaagtcaagttgattaagcaacactggaacagggcacttacaaaattgtaagcttgaatctttaggtctcctttcccaaaaagaaaaagatatgcagagactaacatgcacattatcactaacttggagtgggtttcaacttgcagtttaaactgataaaagttctactggttcgagtttaaggtgccagctgcgccgtgcttataactgggttttgttcgtcttctctgaactttgcgatcaggttctactgtgttcatcaatagatgatgttggtcttttgacagtaatctgatatttcatctcatttaataattttgcacaaatatatataaaaatatagtacatgcttaaagtgcctttaaaaataaaccaagtaaagaaaatgaccattacatatgttttaaaataagacagaggttaaacttatgtacaaatattaacggtgtgatctactccatccgtcccaaaatataataatttttagcacttcagatttatcctaaaatataacaacttcctcaccaacatttccttcccaatcaatcacaaccctctaccattaacttttctcatctacctccacttcttaaccaatcacaacacattcctatttaattctatctactttcttaataaccttgtccaactctaaaattctctatattctgggacggaggaagtattgaaaaaccggctgcccatttttcggttagttataattttgggttgatccattgtcacaatgtgagggcttccttttcattttcgaagtaaaaaaaccgctccccaccagcttacgaaaaaccaaccgaa

SEQ ID NO: 42301 - DNA, 1501 bp, Oryza sativa
actgtttattttttctgaattatacattccaaaatagcactgtgttaaattacatgcctcattttgggtattactgttgagcataatatggttataagttttatacattatgtattttcagatcttgctagggggaggtcgtcgcacccagctggagtacagactgtacagtgacccatccagacccttccgttatgcttctggtatcttacagagttattcctttttattatcatttcagataggcaatcgaagtaagaagagagtatgtgaccgtgcttggttgaggtgtttcatttcagtttgtaatgcaattgagagaggatggttcatgcagtgaacaatttgtttcatttcatttaactgcttaggaccgttaccctcaatcttataggtttacatttcttcttatttgaggcaatgctcaatatggaagcccacttggaaccgatatattgaagcatttgttttttgctttttgctctggtgagtagtgatattgttgagtggttgaccctactacctgttgtagttcagactgaaaatacaaaggttactgctcatgttttttctggagcaccttatttagtaaaaataaattgaataataaattgaagaaattatgaacacaaaaacctgagagatttgactgcattttttgtgctttaaattgctgtaactgttcagtaaaagcaaactgttctaattgtttctgttaatggaactaagggttttaggctgtgttattctaaaaagaatttgactggatgactcatcaaagtatggatttgatgttctttaatagagtagagaccagcctgcctgtcatgagtttgttattcgaggttattctatataattacataggagtaagatcgaatcgcattgactgcagagcactttgccttttattgctgattgaagctgccaatgttatgattttgtttttgtgctctggctttcgttcatatggcactagtgtccagtattgatcataagcccaacgaattggaccggaccactgctaattaattggtcagttaagccatctctggctccttgccaaaaaaaaaaatacagaacaaataaagggtcatccttggctggctgaccagcatacatccataactgtattgtatattgcatgctgggattgaagaagtgtatgcattacaccattagtggacttggtcaggggctttgtgcatagaattaatatgcagttatcaactgcatggtcagaaaaggcgggtgttcaactgagccatgaatcattgagtcatggctcgaagctttgttcttcacgagttggaatccaaagtccataacctttgcctctacagtctgcacatatctttatcagaatgaacaagcagacaagtcttgagaactctatataaacagaaccccatatctcatcttccatcaccaacaatctctcatcaaaccatttgcaacacaataccaaaccaaaacttctttgtgtgagccacatatccaa

SEQ ID NO: 42302 - DNA, 869 bp, Oryza sativa
gagttaagttcagaatcatttattctaactatcattataatttttcatctgatttacaggaagaaacttttgccaccttcatgtagttgttatccatgttttcttcatgcatattttcaccagatactggttataatgggttgcatggctgttcttccgagatttccaacagtgtgcagagctgatataactcaatcatgcatggtattattccatccagaccaatctgaattatatttgttgaatcgacaacccaattgagaccatatgaatccttgcaatgtggctttctattggtaaattagagctaaaaaacaatatcactacgataggaacgtttttttggtcaaactgaactgaaaagaatttgtggaaagtcagaacataattgaactacaaaaataatatcactacaactgttttaaccataattgttgccctatgatggaaagtcagaactattgatatggcatgtcagcaagatttgttttcttttcagcaacagagaaactgtcaaataaaactataaggagtcacggaacattcgctcatttggaataatagatgaatctgttacaaagtaataatatagtctaatatgatacaatcagataagttttgtacaggttgaatctcagttgatgaggagcagttgataataatatgttgttgatgatgtgttgagctataccgtgaaatgagatggcagtgagatgggtggcgagcagggacagcggtcaggccatcaggatcgtgttggcgtccttataaggtcaggccatcagggtcgacggttggtgaggcgttgatccagggtcgtgtcggcgtccggcgttgatcggcgtccggtctccaggtggtgcagcatg

SEQ ID NO: 42303 - DNA, 1501 bp, Oryza sativa
aagtagccccgaatgtttgaacacatgtattaagtattaaatgtagacaaaaaaatcaattgaacagtttaactgtaaattacgagacgaatcgtttgagcctaattacgccataatttaataatgtgatgttacaataaacatttgctaatgataaattaattaaacttaataaattcatctcgcagtttacaggcggaatctgtaatttattttattattagtctatatttattacttgtattcgtatatttaaaaaaagtttggcacacgaacagcctcacaagcgaaacagccaccacgcatgccagccggtgacagtgaatcagtgatgcacatgccctcaggaagattgctgctgaatgcaccatggttctgacataaagagagatgttctctctttttcggggctgcttagggcctcgtttagtcccaacttttttttttaaacttttcaacttttctattatattaaaattttactacgcacaaacttccaacttctccgtcacattgttctaattcaatcaaacttttaattttggcgtaaactaaggccctgtttagttcacaccaaacttcccccaactctcaatttttcatcacatcacatcacatccaaaacttttctacacacataaactctcaactttccccaaacttttctccaatttcaggaactaaacacagcctaaacacaccttagatcccatcccaaaaattttcaccccatcgcatcgaacgttttttaccctgtcacattgaatgtttgaatacctgcatgaagtattaaatactacctccgtcccatattatttgctgctttgagtttttgtttgtagtgtttgatcattcgtcttattcaaaaaaattttggaagtattatttattttgagtgcgacttgctctattatcaaaagcactgtgagtttgacttattatttttgtgcttgcactaatttttcaaataaaatgaatggtcaaatgttgtaagaaaaaagtccaagcaacaagtaatatgggatagaggtagtcttggctaaaaaataattaattgcacagattgcgactaatttgcgagacgaatcttttaagcctaattgctctagatttgacaatgtagtgctacaataaacatttactaataatagattaattagccttaataaattcgtctcggggtttactggcggattctgtaattactccctccatattatatgtatgacgccgttgactttttgacaaacgtttgatctttcgtcttattaaaaaaatttatgtaattataatttattttattgtgacttgatttatcattaaatgttctttaagcatgacataagtatttttatatttgcataaaaattatgaataagacgagtggtcaaatcttggttataaagtcaacggtgtcatacattaaaatacggagggagtagtttttttattagtgcccaaacatctcatgcgacatcctacataatacctgatgtgacaa

SEQ ID NO: 42304 - DNA, 1501 bp, Oryza sativa
cttgatcctgcaaaacaaatccaacggctaagattcgtccatgtcatcacgagttaaaatttaactccattaaaattttaacttctgagtaaatctgcgagttaaattttaactccgatgatgcggctgccgaggatcccatgaggaggcggccggaaattacagatcaggttggcattaattctcacttctcgaagataatacatattgctgcatagcacgaacaacttcttgtccatgtttttctcaacttgtaatctgtaaaatttctcaatcctaataaaatttggtcagcctatatttctttggctgatccggcaaaacaaccattaacaggccattgtatggaatttttcacatggacaaggggccaactggataagttcttcattcagtttagctagtcaactagtacgagaagaaggcacagtaaatattcatataaataaaattacaataccagtcactctactacatgttctttactgacttaactaataaatacgaccaactctaccacgcatattgcagcaaagattaccctccatcaagagtgccatcgacatcactcatcagcattattagatttcccagagttaagtttagaaacacgcttccaagcctgaagctttttcatgctgccaccaggaaatgtggggtcgccaaggcttcgatattgtcttgacatcagccaaagagatatcgcagttgctactgctacaacatagaactcattccgtggatcaatctcgatccttgcattacccaatgccttgatcttcttgactgccagcctacacaagattagaaaaagaaaaaagcaattgcatcgcatggttagctttattaccatgcatgttaagtagtagggaccctaattagtatcacgctaattgtatcaatggtagaataaaagagctaagcattctaaatcgaagacattgagacctcatatccgttcttgtaaaaagaaaatactagtagtagtaattagcatagcggggcaagcacgaagatcagatcggttttaagactagctagcaacaacctaagtgcataaagcagaagcacggttcgttgagcaatatgaagcacaatgtgcataaatattgcataggttacaaggaagtgtgttgttaattacatcctatatatatccttaactcaccttgctgattccataagcttaaaaccattagcattcctttccatggagaagaacctcttctgccctgcccacttcacaccctcggttgcttcagagatgacgaggaattgtcgcggtccctgccagcaagtgcactctggtcaatactgctaagggtaacacgtaatcatagcaaacagagcttgattgttacacaaaattatttacttaaacccaatcatcagaagaaataaaaattgcggagccagcatacgcatcacaggactatcttagcagccagccttactgaattaaatatagagtaaattgtataccgggacagatttagttacc

SEQ ID NO: 42305 - DNA, 1501 bp, Oryza sativa
ttggttgtataaccttaataaagcctggcctagaccaagaaaggcaagcttttttatgtcaattcaaacctacattttctggttccctcatctcttggccttagccaaatagaatcaatttagtcctaaattcaggtatatcagctcctctaaatattaaaaccagtacaaaacgactctctcggtgtcaagctctccaccactagcccgcaattctgcatgggcatcgaactcggctcctcatggaaccctgccacggctccgtccgggcgtccccgccgggcggccgccgggacgaccccacgcccgcgcctaagctgctccgggagatgcagccggcgctcaagcccatcgaacggttccggtggtcgcgtgcgcctattgcggcggtgcacggcggtgcaggccggcggcgtcgagatcgtggccgcctgcgacatgcagtgctgctctccaaggacactacgtttgtgctcaaggtggtagacatggccatcgatcgtcgccgtcgtcggcctccaatggcgggaaagcttggctgtacaagacggccccgagctagccggctagtgcacggatatataacttctcccagttcttcacctgcttaaccatgtgttgcacaccatgtgctcgagcacgctggcgatcgatgctcctgaaccggatggatgtcaagtgaaaaaggattgcttcgtttggtcgcgtctccgtatagaaatggcaattttcggttcactcggtgtatgatgcgattgtgaactctagtgtgacggtccgcaagaggatctcttatataggaggttgaaggtgccactgaaaatcatagtatttatctagttgtttcatatcaaaataattctaacaaaggataaccttgcgaaaaagagttgcgaggtgataagcaatgttgttttttagtgtgcaagagacaaccaacccatattctttgaatataacatagcacgtttttctcggggatgtgtattctttgctttcaatattactagttgtggagattatggataccccatatcaacataacagttataatttagtcggatatacggtaccaaatatagatagaatatctttatgaggactcgggttagtttctaacttgtatgtcaaggaaatacccgagatcttagtcggttacgattgtattttatttgtaatcgcatattccgttagggatatggactgtattttgtaatacggatcccttcccctatataaggaggggtctgggttcctctcgggacgattctctttttcccaaatcatacgatcaataacatactcggcggaatcatccccggacaggagtagggtattacttcttgaataagaaggcctgaacctgtataaaattccttgtctccaaacccatccacttttctagcttgatagccacccccttttagtattgtcgaaatcttgtttcgacagttggcgcgccaggtaggggtagcatcaagttcttcgccgattagtgcga

SEQ ID NO: 42306 - DNA, 1501 bp, Oryza sativa
gagtctcggcggggaagacgaagagacgtttcattttacttcggtgttattagggtatcaggagtactaatgggcttgggcctaaacacagtatttcggcccaattttattttcagcatgacccgttgtgatccctagggatttaggcgctttttgctttggcaatttgtgctcacaatgatgtggcccaatgctgttaaaatccttttaatgcggtttgataattctttggaattaacacgatgcaaacaaaaggtgcccgacaggaaggtgttatactatttttgtaagccttatgaggttgcaaaagctgtttgggttgattcgagatgactaatttattaagggtcattctcttagcatgttatatgcttaatttggttatggtgagagtcatagcttaggctattagactcgttgattaccatgatttttatcatgtttgatggatcattttaagagtttcttactcggattcatatcaaatatgtctatttttggaccttttaagtgtttattactcggcccttttcctattttttatccttgatatgttcaagttgagaagaagtcggctgagtattttattgagtaccatgcatgcttcgttataaaaccactcggttcttgactacatgtttagtttttcaactaatcacatagtcaggggctacacctaagtaggtgcatctactcgatgcaccatgttttatttttgcccttcacagtcttttagcactcggcaagctagagcaagttaaattgaagcactcggattactgttttttgtttcgagaaggctattttgtcaactgcgaaggtctcgggggctactgtggagattatggataccccatatcaacatgacagttataatttagtcggatatacggtaccaaatatagatagaatatctttatgaggactcgggttagtttctaacttatatgtcaaggaaatacccgagatcttagtcggttacgattgtattttatctgtaatcgcatattccgttagggatatggactgtattttgtaatacggatcccttcccctatataaggaggggtccgggttcctctcgggatgattctctttttcccaaatcatacgatcaataacatactcggcggaatcatccccggacaggagtagggtattacttcttgaataagaaggcctggacctgtataaaattccttgtctccaaacccatccacttttctagcttgatagccaccccttttagtattgccgaaatcttgtttcgacactacttctcggagcgccaaaaatatatttggaaattggtttatgggagtgcccagcttaaacaaaatggttttatttgggggccagtagtctatgatcaatttggtattactgaaatgataatattttttataataaaggattggctaatctatacatattatcttcacatctaccagctagctccacatttgatctttgacgctatcataggagaagcagaatatta

SEQ ID NO: 42307 - DNA, 204 bp, Oryza sativa
aaaacgatggaatcttgtcatgatcgcagcaatggacatataaaccgagatataggctgcatatttactgagcaattctggaaccgaagatctcaatgctgaagatatctggcagacaaattctcctcaaacttatgcttgcccgtttctgttgcaacaaaaccaggccgcatcgtggcctccgccacgtccttctcctctagg

SEQ ID NO: 42308 - DNA, 1501 bp, Oryza sativa
gaatgaaacaacgtgtataagtggtctagctggcttaattgttgagcatgtaatgaagcaagtagggagcctagtaaaacttacacttgcatgacttgggagcctagtgggcctttctagcctggcccatgtgcttgccaaaaccgccggttttgaggtgtccggttcgccggtttgaaaaccgcccggtttatctgatttttactggttcaattgtatatctagtccttgcagcaaaccgaaccggttgaggagctggtttcggtttttcttggtccaaccgccgggtcaggcccctttttttttactaggatggtcagtgtatttgctacatgataaaatttttaaacacgtggaggctgctgcaattttttgtggcacatggacacgatatgccgtgccacgaaaggacgcagttcacgcaagcatgaaaagattcctaccagtaagaagcaatatgtttctagtactgttggacggtggcaccagttgtatatgtacaacaaccaaacccagtgtgtatgtacagctattgccgccgtccaacagtacttccaaacatgaggttcgaaacttgtacaggcatccaggatgtttctgtgaggtgaatgtcgaattgtcgatggtgctttctctagtaggatgtaccgctgcaataattagggatgaaaatgggagcttctagcttgcaacggtagtctcgcatactaaaattccatgatgaagtgtcctgcaatggtgatgatgatagtagaaaatagggaggcatatgtgtagcacaaatagcaacaattaatgaaccaaataaatagtcaagcagaggtgacgacaatagagatctgaaacgaacctgaatcttgtacgttaacaccggccaccacagaaactataaccataatgaatgaacctgactttagcatcatgtgccttgacgctagagagaatccactcagtacaactgagttttccctacttctacaatctactactgattttatcaagttgaataatatgctatcgtgttttcttgaacctatactacatgccatcgtcatctacaagccgttagttgaacatctgttagagctttagttgaacatctgttagagctgaaaaaaggcctatttaccctaactcatgttttattgtgtgtcagatactacttccttttacttctccgcgctcgctacctttgttttcaaacttacaactgcgttgaaattccactgcctttttctttcgaacttactgctgcgctgaaattccactgctattttatttcaaacttgctactgcgctgaaaacctgaaattcaccacattttgaccccccataatacgcttaacaattccggcattattactacctgcatttttttttcgcagcagcatttcgttcaactgcatcaaaatgtacatggacggatatttgtataacactcagaaaaaaaaaatccattcccatgccactttactcgcgcctcgtgagatgactaatacag

SEQ ID NO: 42309 - DNA, 1501 bp, Oryza sativa
ctgccctctttttgtgcgatgattgcagcaaaactttgagaagagtactgtcgttatttggtacctgccgtcacgtcaggcacttaaaatctttaccatcccaagtattatctccgttttttaatagatgacgccgttgattttttctcacatgtttgaccattcgtcttattcaaaaattttatgcaaatgtatatgatataaattatacttgaagtactatgagtgataaaacaactcataacaaaataaattataattaataagacgaatggttaaacatatgagaaaaagtcaacggtgtcatctattaaaaaacggaggaagtattcttttctaaactgtggcgtcttgtatattttgtgctaataaattgtcacgtgtagttccatgtgacaagtcgagataacacttgtgcttagttcacgctaaaattataagtttggttgaaattggaacgatgtgacggaaaaattgaaagtttgtgtgtagaaaagttttgatatgataaaaaaattaaaagtttgaagaaaaacattggaattaaactagcccctaatcactgggcaatgcccaagacaacactcattggaaatctggcatagcatatccgtatgtcaccgtctcgttggcgacgtaatccaggcgacttactgtataacccctacacatccctatccccatccaacgtgtacctgacgcctgacaccgtaatcctcatcctcgccctcacccagtaacggccggggccccacctcccggtgtgccttttcgtgctctgtggggcccactcgcattgccgactcatacgaaaaccgtttgctctcgcgccaccctatgggcaaccagccgctgactgttagtggattctagtagtagttgtttatctttgttctgttgtttcttatgaggcgagatcgatgaaagacaggttccatttagctgtgaatggtctggtccatgattgcattgaactatgcaggcagatattttccagctcacggcaagtgcgttcaaccaagttagctattccatcataaaaatgttaattacctccatcccaaaacactagttgttttgagtttttgtttgatccttcttcattttagaaaattataaaattattatttgttttatgtatgacactttattatcagaagtactttaaatatgattttatcattttctatatttgcactaacttttaaataagatgaactgtcaaacgttataagtaataagtcaaaacgacatctaatttgggatgtaggtagtatttttagagcaaattacgcttttggccacatatttgctctaagctttttcttgaaagtatgattccaagaaacaattcttatgttacattgttgagattaattgttctatactactttctctatctaaaatgaatccaattctacggatgaatttggatcaatatttatctaaattcatctataaaatttatttattttgtttgagacagtcggcatttgaatca

SEQ ID NO: 42310 - DNA, 1042 bp, Oryza sativa
aaaacgatggaatcttgtcatgatcgcagcaatggacatataaaccgagatataggctgcatatttactgagcaattctggaaccgaagatctcaatgctgaagatatctggcagacaaattctcctcaaacttatgcttgcccgtttctgttgcaacaaaaccaggccgcatcgtggcctccgccacgtccttctcctctaggcctccctgacgtcacggtcgccgtctttatctctgcaacgacctcgcatggatcggagtcggactctgggctaacatatcagcgaattttaattcccatgtgttggatggaatgctgaaattttgttgggatttcgcaagcgacagagatgtgtttcatgtgtttcaagtggcctgtcaaattgagctaccagcagcctgcaggcaggcaggcaggtaggtttgttccgacaagtgaattactgaacatcaatcaacatttgcaaatctacagactgcagcttacaattcacagttcagtccagctccagcagcaatagaattgactgcaacagctgagaacttgaaccctcagatcgatcgtgcacacgtgcaaattaacttttgaattcgagtctttgagattttcgtctcaatctgttgaaatcttcaggataccttcaacgatacacaacggcactttggatgatactcactgatacaataacaatagttgatgatacatgtttatacttgcttatattgattaatgcacgacgtgacgacaacactcaaggataatgactgagtttttattataaagaacacgggtttcttcatcacactatgggatacactaaatctcagtatcatgggggatctcgcaacatctgcagcctggacagatcttcatcacaatgaacaaacaaattaacatgatacttgggaactctatataaacagaaccctacatctcatcttccaccacagcaatctctcaacccatttgcacaaacaaacacaacacatttccaaaccaaaaacttctcttctaattttctccgaaactactgctccaa

SEQ ID NO: 42311 - DNA, 674 bp, Oryza sativa
aaatcattttctaaaaagaataatcgaattatttaaatttcgaaaagaaattggcaaccactaaaatacgttcaagaaaaattcgaatgtggcccggagaatttttgttaaattctccttggtctaaaaagagccctcaaattttacttaaattttcagagcaccggaaatatttattaagcaacaccaactatgatcaaagtttattaaaaagaaaagcctaaaaataatcctccttcctcctttgggccaagtctggcccaaagtcctctctctctctcggcccgcggccaaagtcctctcttcctccctctctttcactccctctccttctctccctccttctcttgggcctccccttccccctcggcccagctcccttttcctcccctcccgcctgggccacgtcctagcccaagccgccccacccaagccgagcggcgccctcccgcccgtgccgcgcacgtgcgtgcgctgatgacgcctcccgcgtgggtcccgcctgtcaggcgcgtccccgacctccagccgccggcctcctcctctctctcccgtgaaccctagcgccattcctccccaaaatccacgcgattcaaaccgggaattccaaaattgattagggggaattaatcccctttccttcctcttcaattccccctaatttcccccttgat

SEQ ID NO: 42312 - DNA, 385 bp, Oryza sativa
cttgatgcttaccgaagggttcacggatcgtggcttagctgttctacaaaaggggaaaacaatcctacatgtgctacttctccgcaactgctttcggaccaggaggagtgcatccatcaacacgacccctatgactggggcgtatcctatatgttatatgtctacagccctacacagtcagattaaacgggggactctatacttgcattacactgggtggatttatcagaagccatgcgaactcatgcctactttcaaagtcgtgcattgctctatcgggtatgaagcatatccccgagtggaaacgattaatccaccattacctactgaactataaagactggatattattccactctccactataagtacacgtggctacagg

SEQ ID NO: 42313 - DNA, 1501 bp, Oryza sativa
aaaggctgccgagaacatctacatcaaggtatatccaccctactcgcttccctaatcttccttccccctcgtgattgttgctgttcttgctgcgatagatgggctacagatgcaactagagatgtattgcttgagctcttcataattcatcaacacttcatgactgttgaaactgaattgcatctatacgttataagtactactcctaacctgtagaattatcaatctatggcaatcaacctcaatgaattatcatctgacctgcaagcagaatgagaaaccaatataatatcatatagctgtaagacatgatcttttgaacaagagacttgcattatgtagtgttttatttatccatcacttgagcagttttcacaattcctatatatcgaatggtaaactctacttcaacgtactttcagaaaatatgaaatatataaatgttaacagtaagatgaaatcaaaagtactaatctccaatagtccatatatatctggatcatatccacctgaaataaaagattaccacttttttatgtactgcaatttgcaattagcaattaaacatgtgcatgctgcaaaaatattctacaaaaacaggactagccatctttccttttccttttaacaaacagtaatagcaaactatcagtaaacagagaacatctacatcaaggtatatccaccctactcgcttccctaatcttccttccccctcgtgattgttgctgttcttgctgcggtagatgggctacagatgcaactagagatgtattggtgtgctgtgtagaggttttggatgtgctccaaattgaaatgaggctgtttttcctgtgcgaattgctgagtttgcttcaactttcatccttcccatggtcacttttggtgagttcctatgagtcctatggtcacctttttttagaaagtaataagtgaaatcctattatgaatgtcaaatctgatgactccttttatcttattcatgtaaaaaggattggttgccaccatatgtggtgctcaggaatgtcaaaactgtagtggcatgtttcttcctaacatgtgaagtggtttttttggctatctagcaaacttttggctgggctttctcatgttatactatgctaagcagttgcattgcagtttaagatgcctcagtttatacccaatttttggaaatttgtgagcatgatgtcagtcttttccttttaaattaagggataataggaagaaaccagggctggcagttctttttgtttaccaatttttccactgtacaagtgcaaaagcatttcaatatcttttcagagttcacgaaagaactgggctatttatttggtagcaggatcggaagtagggttgtttttttcacctataactgttactttagtaaggaaatttgagggtgcctctccctcatgcgtgaaaaccattatttccacagtgaaaaggggtaaatatatatatattgttttgcctgatctctgagcatgcttagtttctt

SEQ ID NO: 42314 - DNA, 1501 bp, Oryza sativa
agctaagggtcctgtgaaagaatttaattattgtagagtacacaagagccactcctacataggatcatctagaactatcgcccactcgtagaagcaaaagccgaacaaaatgaaaagaaaagaaagaagaagaaataaagaaataaacaaaagaaataaagaaagaaagagggtcgatgaaattgcaggcagttaattacactaggtctcgtgttcgaacatggttgaaaacttctcctcccgcacacgtaaaatgaagtgattcattagtatatgattaattaagtattagctagtttttttaaaaaagattaatataatttttaaaaacaacctcttatattttttataaaaaaatacattgtttagcgggttcagaaaatgtatgtgtgaaaaatgaggaggtagaaattgaaaatttgcgctgccgaatgcacctttctttactccaagttaaaacgtttttgaaaaacctgctctatcaatatatatgaggcaaaacttttgccctcccttttttttaaaaaaaactttttccaaaccgtaccattcatccatgcattgttcatgccatttgcttaggccttgtttagtttcaaactttttcttcaaactttcaattttttcatcacatcaaaactttcctacatatgtaaactttcaactttttcattacattattctaatttcaatcaaattttcaattttagcatgaactaaacacacccttagttaagattacttggtacaattactacggaatacggatggaggagttgattgatacgaggccaagaatggaggttcttttggacaaaaaaattcactctgtactgcgacgtacacacgtggcaagtgcatttcctcccgattcaccttcagattttgttctcgtcgattaatttccctggtaaatacgaaatgttcatggtccgtgatgaaatgatgatacggtcgagcacataatgcgccctgaaactgtaattgcagtacagaaaatgggtaacatattcttgaataattttggcacaaccaaaaaaaaaagccgtcttttgttcattcttgaaccgtaggaattgttacaattttcatgttcatgaactttttttgcagaaacaaaagaaacccctttttgttaattcctcaaccgtaggaattgttgttaccatgttcatgaaaattcttggcagaaaacaaatcctcctcctttaaattcttcaatagctgtacagtatctagcacattgagatgtacgacagcgtaatgccggattcaacaagcaagtcagcagcagcatcactgcgtcactgatcactgtactggagagagagatggccagagagaaagatggtagccatggaggagaggaggagacaggctgggccgccatgttcctcgcgaccttaatttactcctccaatggccgccgctgctgcgaaacgcggagaattctcttccaatttaaagcgccccatctgtccatcttctccaccaccactag

SEQ ID NO: 42315 - DNA, 296 bp, Oryza sativa
cactgcagcgccacgtccaccaccgttggcatatatatatgacaagagagaagtgtcacaaggaaaggtgacggggtgcggtccgcggggcagctagggaattagtgacatcatggccacatgtgatcagctctcctatacttgggcatatcgaaggaagcttaagaggttgcggaccttctatttaccctagaaccattgatgatcacttgccctaagatgtcgctgccctccaccggaacaacctgagcccgagatccatgtcagcgccgcatgagccagatctcccttgcagt

SEQ ID NO: 42316 - DNA, 1501 bp, Oryza sativa
gactttgtttaaatagtttgaatttgaatttcaaattatgacagcttcaaacaatatttacaagtactagatgatttcaactgaaaaagtcatcaacaacaaagttgtagtactcatcaatatctataacttttgttttggctatttttctatacgactttgtttaaacagtttaaatttgaatttcaaattatgacagcttcaaacaacatttacaagtactagatgattttaactgaaaaagtcatcaacaacaatgttgtataactcatcaggatctataacttttatttgggtcatttcttcattcgtcgaagtgatttgtaacattgttcacaaaatgtacatatctcttatacgtttataaaaaataagagagatatgtagattttgtgaacaatgttacaaattacttcgtcggatgaagaaatgatcaaaataaaagttatatatattgatgagttatacaactttgttattgatgactttttgagttgaaatcatttagtatttgtaaattttgtttgaagttgtcataatttgaaattcaaattcaaaccgttgaaacaaagtcatatagaaaaatgaccaaaataaaagttatagatattgatgagttatacaattttgttgttgatgaacttttcatttgagatcatttagtttttgaaaatattgtttgaagttgtcataatttgaaattcaaattttatataggccaatgaaactcagatggagaaataaccaaaataaaattggtagatctcagtaagttatacaactttgtttcaaacaactttttcacataagttcatttattatgataaaattcgatttgaagtttcaaaattttgaaatttccacgttaaatgaccattttgtccaagtaacttgtataataggtttccagataccagggttattctggtaaaatcgcatcaacatagcttcttatacatatatccaaaccctagccatccattcttcaccttctctttccccaccctcacaccgccggctaccacgccgtcgtcatcgtcctcctcccttcgcccaccatccacagccccctcggatctcgccgccccttccgcctccccctccgctcctctcgccgctcctccgtcccccccctcttcggcaatctcgccggcgtcccaactctagcgggagcggcggtggcagcaaggaggcgcggcggcaacgacctgcggcggtggatttggcggcgccgtcctagggaaggccggatccgccgccctaggaaggagctcggctctcggcggcgggcggcgggcacagtgacagcctgctccggcggatctggtggcgccgtcgcagaggcggaggacagcggcgcgccagagacggagggcccgtcgggcaggccggcagcgaggcggtggcggagccgcggaggcgggccggcgtgaatggggtcggtggaggtgacggtgacctggtacggcggcggaagggagtcaatgcgagggggttcagg

SEQ ID NO: 42317 - DNA, 547 bp, Oryza sativa
attgttgccggagcagcggctaccttacctcgccggcgtcatcgccgcccttgagcacctagagtagaagctacctcacgcgccatacctcgccggcgtcgtcgctcctgagcacccagagtagcagctacctcaccgccatatcctcatggtaccttgggtaaggtaccgaggtggtacctagtacattggtatcggctggtacctggtaccctggtatcgactgatacctgataccctgggtatcgagctggtacctaggtatcaggccacctggtaccctaggtatcgagctggtacctaggtatcaggccttggtacctgggtatcagtgtgataccccaagagagagaaggaggaggagtcgcgggtcggggaggtcgagcagcggggcggcgacggaggaagaggaagaggaagtgacagatctggtgcctaccttgtgccattccgtcgttcattgacgtgcctcgctccaaaccgccaaacccgtggctccattgacgccgcctagagcagctcctcatcgctcatgttgtgccaaagc

SEQ ID NO: 42318 - DNA, 164 bp, Oryza sativa
gtttggaattttggataaaaattccgggcgtgacaaagaatcatccaatttggagttcatatgattgagataaactagtttatttttgcagacggctccttaaaatgctcgtatggaaaaattgattttttcatgtgggctcttaagtaagccgcatgcaaaaa

SEQ ID NO: 42319 - DNA, 663 bp, Oryza sativa
atatatatatatatatatatatatatatatatatatatatatatatatatatatatatatatatatatatatatatgtgtgtgtgtgtgtgtgtctagatttatttacatatatatgaatgtgataatgctagaaaatcttataatataaaacggagaaaatactaataacttgcaaagtgcatgatgcattgcacttatctctgagatctggcgcaacagaattagtacaaaagctaatatttcaccagttcatttatacactctcaccaccaatcaggcaatcaccatcgctgaggctggattaaaggtcaaaatcaaattagtctgtttttctttaatttgtcataatgatctacacacaaaagtttaggtgttaaaagcctaaagtacattatacatatctgaattgtgtttttttttcaacactgtgatcatcaattataatataaaattgttcgttgcctttgaactatcaaaaagatcggtataagcgaaatgattgggctaacctattcccctgttgagatttgagacttactctctccctaaaaaaacttaatctaaataggattgtgatctcttctaatacaatgaatttagacaatatccagattcgtagattcgttatattacgagggatcacatctattttttttaaaga

SEQ ID NO: 42320 - DNA, 210 bp, Oryza sativa
tatgtaattttagtacttacatatgtaattttgagacttacattgtaaatacactaaaattacatatgtaattagggacttacaatgtaaatacatgtcgactattttttttgatggaaaatatggcgccataaatatagcatctcctctcttgcttctgatcaccattatttttcaggtctcgaatacccagacttcgagagatggcaa

SEQ ID NO: 42321 - DNA, 334 bp, Oryza sativa
cacgatcctagcgcgcggcacgcctcacctcccgccgctaattccttctaggtattaataacattactaatccatgtttagcatttttataataaaatgatatataaacaattgagttaaaagttttaaaaagttaaattgaaagttttaaatttgagttgaaattaaaaaaatcaaactcaaagttttaaaatttgggttggaggttttaaactttgaggtgaaagtttttgaattttgagttaaaatttcttaaattttaaattaaaagttttagaatgagttgaaagtttttaattctaatgtcacctgagtgccacgtgcacaccacaga

SEQ ID NO: 42322 - DNA, 1501 bp, Oryza sativa
aaagtaggtaaatatctgcaattttgcagacagataagaggaggataaactgaataaagtgcattggcattcattgtgtttgtacatgttggtgtgtgccgtggagatctgatggcgtttgccggcctgccaagaaaaagtcaatcatattttttgtcaaaagatgaagaaaaagaaatctcaaacagtaacccctttctgcccacttgtagttgcctctttgcatgtaaaaaataaataaattgaagaaagaaagcgatcaagaaagaatggctctttatttccttgaggtcaggggcaggggcagtagtacccctgtacttttgtctgttcatggtgacattgtgcaaaagtcaatggaattgatacttttatgtgttgggttgggcaccatttaaattatatcattgttgctcttgtagtactaattgtataaaccagttaattaggtcaacattgtttaattagtttaggtatgataacggtaggatcttgtaatggagagaatgagctatgtacatggatgtgatgagggctaaatgcatcaggaatctgcctctatagaattggtcaagtatagtactatgtatgccttaaagattgctctttgagagcgatgctccggtgctatttattggtaacattatactaccgatattattaggggtaaattagtaatttactaatataataattaggagttactttctcatttatgttttttctggctaaatcgatctatgatcattctttgtgctagcatcgctcatatttcataaaaaaagccaaaaaagtgagaaaaaatggtttagttactgctaaataaaaattatacctctctgcaccctctttttttttgacaataacgtccctccatatttctactaccgctaattgtggtgatagtataaataaatttgaacccttcgatcaaatgaaaacaatggtttagattgctttctactatcaatagaaaacaccatagcggggcaacttttatgctacccaattagaagctttggcatagcttattcaactaaatgttgacaaaggaatattcagttgaatctgaacaagaaatggagaattgcattatccccttaactgagctatgtacatggttgttatgatggttacatacacgatgaatgcagcctagctagttccggcagttgtacaccttatactgagagtgttttgcttattctaatcaatccattcgtttgctatattagtaagactgcactatttacagttaatgaaattaattaaggcctaaaaaggagaatgggtgtaaaaaaacattttttttaagtgagacaagaattagtaaaaaaaagtcaatggaattgatacttttatgtgtgttggccggttgggcaccatttagattagatcgttgttgtcttgtactccttccgtttcgtattataagtcgttttgactttggtcgaattcaaactgcttcaaatttgatcaaatttgtagaaaaaagtataac

SEQ ID NO: 42323 - DNA, 485 bp, Oryza sativa
cttgaaatgcacgaacttggaaagtaagatcaggttctctggcatgctggttatcctgcatgatactgactagagagttagttcctgactgtgccacagtggtttattaatgctgaattgctgatagcataggtctggttcttgcatgatcagcaaaagtcatcagttttttatgatcgagagaaaaaaaagagagttatttcctcacagttgccattacgaacttcaaaattaactcaagcccaggcaactacaatcgccactaagcttgcattaacaaccaactgcacaacctatgtgctaaaacacaatttgatcctccaaactttttaggcggtttgggcaagagaggatgaccaagttttgttaagatttacttccccaactgacacaaaataaacaaagcttaacgaaatgggaatgggcaacagagccagcgcgtgcgtaccatccatgattgcctagtaaaccttcacctccggaga

SEQ ID NO: 42324 - DNA, 411 bp, Oryza sativa
caaccactaggaaaatggagccaacatggtaaaacacaatcatgacaggcacaatccaaaatagagagaaaaaacgtggttcaccagaaattactattacctccgttgttccgccctaaaatataacaacatttagctatgtgtttaaatttatagctaaaaatacttatattttaggacggagggagcagtaagcagccgatcaaacatagtactagtagaaagcatactctttctcggtgttttgaaatttgaactggtactcgagaaaagcaaacctgaaccgtgtgcctcatgcctcatgcctgcactgggctatcgataaatgggccgtaagacaagtctatgggccactgtttaggcccatatcttcgttggagaaagcccacaagcggcaggagttggggaaac

SEQ ID NO: 42325 - DNA, 438 bp, Oryza sativa
aagattaatttagtagcgtctcaggtaatatttacatgttcagaccaaaagatccaaatccaatcatacagcgcattttcctacaaatggcgttcgctagatagttcactcctatgttatcgacaaattttgaagaagtgtcatcaaaatccatcgaattccatcaaaaacctgttactgatggcattattcagaagatttttcctcctgttctttttgcgtttcaatactctgctcgaaaaaaatttgtcctcctattttttgcatttcaactgatatccccatcatcctgatgtgataatcagagcaatgtacaaaattctctcaaacattaatgaggttcagaaaatttctccttttgcatttcaaaatcagtaaacagcaatgattcattcactatgcatcctgggaagaaaagaaaagaggaggcagcggcca

SEQ ID NO: 42326 - DNA, 1501 bp, Oryza sativa
gtctgcttccttaaccggtactacagttgtaacagacaataactttcttacgttcgggttcttcatcttgtacttgatttcttggctgctgtgctggaacatccaaaggtacaatgccgatactggcctctgtcttgtcaactgatggctggggctgaaattgagcattgacaccttgtggtaatgcactcgctggagttggagctgttgcaatgcgggctataggactgcttcgggatgcatggatgacaattcgctgaggagcaagcttctgattgcaaggagttgcgtggactgacgtgctggcagctatgtttctcggttttgggcacttgtcggcgaaatgacccattccttgacaattgaagcaacagatatcttcccggactcggcattttcttttctatcatcaggttggtttttaactcgaggttagaacatagttcctctgaaatgagaccctaggtctcctttgacagtaaacaattatacacataattccatatcagcatcttccaaaataaccctcatagaacttgtttttattacacatttctcccttattacatgaatacaaggcactgccttaaacaaaaagggaaggtgcttaacatcggtaccttgcatcctcaacatgaatcttccataaacataacaaactcattgtttataatcatgaatatatttatttattacatgattgctgcaaactcccgattacagtgataagtagcgaactgaaaatcacaaacatggatacatagctggcattgttctagtgactgcatccttgattggttctgtgatgatgtgataggactgcatattgctatcattcacaagagaagtttccttctgattgctgattgaggcgaataacggtcttctgcttggtatcgcactcctgagattgattgcccttcgctcggcctggagtaggtcggggagagacacaacttcttccatcgacgacaattctttgctgaggccgtcggtgcagagaatggttggtgttgaaggtattattgctatgatttactgcagagtcaggtgcagcaggaggagcattggtgctggggatgatatcgtcgatgttgatgttggagctgactagctgatgagacaatcgtagggttgttcgttggatttctgcggtcttggtcaacaacacactgagttggcaatccttgggcacatggttggtaccttcgcacagaaaacatgtgaccttgcgggtgggacatttacctggtggatggtcttcctcacaataagggcagagtgtgaaacacaggctagcaacgtgtccaatttctccacaacgggggcatgcttttgattccatctcttcctcgccgagatgtcggagagactcatcttcataatccgaggagacttgatctgacccttcactatcagatactctgccaccatggcttaggaggtgctgggtcaactgtcgtgcacctcggaaggtatttcctctttgacgtctaggaat

SEQ ID NO: 42327 - DNA, 1501 bp, Oryza sativa
gcgcctgtacgcccagcggcgacctcgcgtccgcatcttggcggcgccgtcgctccgccacaacgcccggccggagaggacaagaaacaaagaagaaaagcaaaatgaaagaaaggaaaagcggcagcatcggcgccatggaaaccggtcatgcatccgctccacacgccgatgcactgcagcaccggctgcccatgacgctagccgctcggcctggacgcgccgccgccgcacggttgcgccatgacgagcgaattgccggagcaacaagaaacaaagaagagaagaaatggaaaaaagaaaagggggaagaagacgccgacgaacgttggtcgccggcgtaccgacaccgatccgaccagccgtcacgcctccctggctgcatcgccgtctgcgccatgctcgctggcctcgtgttaacagtgaaatttggtaatcggcaaagatgtcatcggcttagaatcattatcggctgcagcatctcggaatcagccgatgtgagttatcaagtcaccaatagtcggattcctgctatattcggttaaggaaatcaatctactaaaggaagcttattcctaagtgaccgagtttaaagaggatgcggcatggcagtttatctattaattaggaatagtttgttagttttcttttatctttagaaaagtttgtttagtgtccgataaggactctatattttccttttatctttaggtagtttctttcttgtccgacaaggacttgtatcaacccatgggtataaatatgtacacccggggtctatgtaatcgatctctacgatcaatacaattcggcgcatcgccaccatttttatttctacttttgtttttacgttccggcaggacttggcacccgacgcggggctgcatcgtcttcgatctccggcgaagggataagtccaatgttccgtcggcccaggcaattgtatcgtctacatcggcgtcgttcaaggctgcatcagtacattcgacctcttggattgctctggtttagatgatatacttgcctacctatttatcatatgtctctgttaatctagtcttagcatatcaatttagctctatcggctgcttctcgttttagggtttctgccggtatcggctaaatcgcgttgctagattagattagcctaggcatctaccaccctgaaaatcagtcatcggcttgattgtctagatattatgtttctttttatacttagtgctgcatcagttaattttgatctactaagtcgtgcttagaaccataatctctagcctgcttattgattgccaataagggttttatcggggtttcagccggtgagttatctggacgttgcatcggctcatgaggattgcatatacatataagttggatttagccgatgacaacaaaggtttcattgtttaatctaatcttgtggatttcatgacatcggacctctagccgatgtgtgctttaaccttcgtatcgatgcttatttatcatatcattgctagcc

SEQ ID NO: 42328 - DNA, 1501 bp, Oryza sativa
gtccaatgtagataatgatataaaggcaatcggctgatgatgatgtaataaaataacaatataatccaatataaactaatcggctagcaatgatatgataaataagcatcgatacgaaggttaaagcacacatcggctagaggtccgatgtcatgaaatccacaagattagattaaacaatgaaacctttgttgtcatcggctaaatccaacttatatgtatatgcaatcctcatgagccgatgcaacgtccagataactcaccggctgaaaccccgataaaacccttattggcaatcaataagcaggctagagattatggttctaagcacgacttagtagatcaaaattaactgatgcagcactaagtataaaaagaaacataatatctagacaatcaagccgatgactgattttcagggtggtagatgcctaggctaatctaatctagcaacgcgatttagccgataccggcagaaaccctaaaacgagaagcagccgatagagctaaattgatatgctaagactagattaacagagacatatgataaataggtaggcaagtatatcatctaaaccagagcaatccaagaggtcgaatgtactgatgcagccttgaacgacgccgatgtagacgatacaattgcctgggccgacggaacattggacttatcccttcgccggagatcgaagacgatgcagccccgcgtcgggtgccaagtcctgccggaacgtaaaaacaaaagtagaaataaaaatggtggcgatgcgccgaattgtattgatcgtagagatcgattacatagaccccgggtgtacatatttatacccatgggttgatacaagtccttgtcggacaagaaagaaactacctaaagataaaaggaaaatatagagtccttatcggacactaaacaaacttttctaaagataaaagaaaactaacaaactattcctaattaatagataaactgccatgccgcatcctctttaaactcggtcacttaggaataagcttcctttagtagattgatttccttaaccgaatatagcaggaatccgactattggtgacttgataactcacatcggctgattccgagatgctgcagccgataatgattctaagccgatgacatctttgccgattaccaaatttcactgttaacacgaggccagcgagcatggcgcagacggcgatgcagccagggaggcgtgacggctggtcggatcggtgtcggtacgccggcgaccaacgttcgtcggcgtcttcttcccccttttcttttttccatttcttctcttctttgtttcttgttgctccggcaattcgctcgtcatggcgcaaccgtgcggcggcggcgcgtccaggccgagcggctagcgtcatgggcagccggtgctgcagtgcatcggcgtgtggagcggatgcatgaccggtttccatggcgccgatgctgccgcttttcctttctttcattttgcttttcttctttgtttctt

SEQ ID NO: 42329 - DNA, 519 bp, Oryza sativa
ttattttagttacaacttttagaaatcgaatttgaacttgcatatttctaaagtgatatattacatattaatctatcttgtaattttttatgaaattttttcataatcatttagttgacatacaagaaacgagtggatgtccatccgagatattagaatccatcacagtggagtaactaatggttgtgcatccctcggttacttaattgttgtgctacaggggatggaatgtttgtagtcgttaattccacaatcgttgcatcaacattttttttagactaagggcattaagcccccatttccattactagaaatgacagattacaaaagcaagtcttacaaactgaaacaataataataaaaaaaaggaggccaacacactggctgttttttccagactagaactgtccagaagacatagaagaacacatccccatcctcaaacttgcataagagcaagtttagggcctgtttggcacagctccagctccagctctgtcgacggaggatactcgtaga

SEQ ID NO: 42330 - DNA, 1501 bp, Oryza sativa; identical to SEQ ID NO: 41174

SEQ ID NO: 42331 - DNA, 1501 bp, Oryza sativa; identical to SEQ ID NO: 41175

SEQ ID NO: 42332 - DNA, 1501 bp, Oryza sativa
actacattcttgatgtacattgttcccaccgggaaatgaaattatatgctgagtttcatgagttactacttactggcggctaccagtcatttctaccgtgatataaatcagggtctcatttggaatgcggaaattttcctgctgactcctgagaaacttttatgtttacacggaagacacgatcatggctacaccaaatggcgattagtcctcaccactttgtcttacactgacactgttattgtctacttggatgccacaaaatgctttgatccgctaattgccagtgtccaaagcaaaaggtgctgatttcttctagctccagcgcctttctgtaatctagctgaactcggtgtatgtccttgtaaccctctttctgacgatcttgacatcaagaccggcaacctgccaccaaaaactttttgaggaatcatttcaataattcaaaaacagggaacattaagaatcatttagtggtttgcagtggggaagggaagaaggaaagtctaaggactctaccactaagagaactggcagtggaatttactggatatgaatgataaatcctacgaacacagacaagctcatgcatgccaacacaactacacacaagtaccccgtatgcaagtttgcaactagttcctgcagaggcatctatcgtagcatatgatgcgtctttgcccaaagaaagaaaaacatttttcgtacgcctgatggtttaattcaaagggagagcaaatagaagtcagtataatagtgcacaacttgacagcatttttcctgcttaaaaatgtaatcaatttcaacgccgtaccgcgcgcggtaccggtggctaattaaatctgctgactcttttagtcagctttttccaaatgattagacatctaagtaggcgctgagttaataatcaatctgatcagttgtttatccacctcctagctatcttccatgtgctgacagtgctggccccctcatggcctcatgtggctcagagtttctttcctaccaagaatttgcaaattccacatagatgctgataagccatggcatgcatgcacagttcattccaaattatatttttgtccatagattatcagactaatatctaagtagatccattttatgccggcaagtacggattactgaacatgcaaggtacatgcatgaaatgtattattttccaggtcatgattatcaggagaaaatgctaagccgtgctgatgatgatgcccagcttgcaggtttacagcgtatcaatcacctgattgaacgcgcaattccatctccagggttcggcttacattttccttgcatgcatgtgagcctagcttgcactgctgactgagatatcgccggcatgttctctgcaattccctgctctgatctgaccataattctcattcctgctcttatataaccccctccacgttcactgcaaaaccatcagaaaattcagaacctcggtaacctcctgatcagtgttcgattctctgctctatcg

SEQ ID NO: 42333 - DNA, 1501 bp, Oryza sativa
cgaagtcaaaaccactgagtgacctagtttgtactggttttgtaagttgggggatgcgctatatccggttttacggttggaggacgattttgtaactcgatgacaagttgagcgaccttcagtgtacttttcccaactccgaacccctgaggcccgagccatgttcttactgggcccgaacgggattgctgccaatctgcggcccgttgaagttgggcctgagcgggactgtcaccaacgtacggcccagttcggtcagaacggaatttcagtgttcgaacgagccgtattagttgggacgggaagacactgcgacccatgtgaattgggcttcacgtgacggccgatgtaatcatctgggcctttcggctgcctaacccggcgaggacggagatattttaccctttttattattttttttaaaactttttaatttcaaaaataaatcatcagaaacttattttaagatctaaatctcttagccatggtaattcacatgatatgacaaaacaacactgtcacatcacccataacgaacgtgacagttttatcctgccacaccgattaaggagacttggcaagacaaatgttgccatgtgtcaatgtcgttagctaattaaacgatatatatttaagtttttgaaatggataattttaaaattaaaagttaaaaagttaggaaaaagtaaatagaaaatctgcggcctattcagattatagccaaaataaatcttaccaaattttggcaagatagcaatattaccaaaattttggtaggatttcttatgtatttactaaattcggcaacaaactaaacgtaccatttttttagcaactttatcaaaaaatagtatagttaaaaatgacatcaatctggttactgtatgtgaacgctgccggcgacttctgcaaatccggtgagttgataattgataattcaccatcttctcgccatatccgtgtgacagcgcacttggattcttcctgcgcccggcttgccgctctccctcatgtgagcaagtaccatagctgccgcttgcttgcctctcatatctcaccaaatccttccatggcgtgtcaactctgtcaactaaacaattcacaagatagccggtttaagaagcgtaaatagttccagctaatcattccccttgcccttgggtgagctgagcatgcagcagcagagaacatgcggaagtggcagcgtgatcagcttaattacggatcgaatataagacgcgtagctgcagatcgatctggtggagagaaatgagagaatcttcttcttcgtttgcatgttagtgtgcctgcaaagaagctacgaagaaacaaggagatcaccgatctgacgacgcaattaattggagctgagtgtgtgcagtgtacgtacatgcgccattcgcgctgcagcgcaggcaaaaattccatgccggtgatcccgctcctatttaagatcactcgcatttcttcatagttactactaccactgtcactaactaca

SEQ ID NO: 42334 - DNA, 243 bp, Oryza sativa
gtaacctgtatggatcgagacttgcttaaactagctagtaaatctaatgcccatgtatatgcttggtgctaacttggctagggatttctattactgaatgtaagaggcatacaacggatgggtgtattggcattgatggcaacccgatgcctaagcatatcacatgtattagtgaataggcgtcacgttctattactgcccggcctactatgggatcacgttgaaccttgccgtttgcttaga

SEQ ID NO: 42335 - DNA, 1501 bp, Oryza sativa
tttggaaaaggtatttttccgggcacgacaagctaatatcagagacatctcgactgtaggataagccaagtggataaaacctaaggacatattttataaacaagactatttgcaaaagttcctttttcctcctttccctaatgctatttgcaaaatgtttactctcttcttcctccttcggattttcaactagtactagatggtcagctttgcgaagaagaagatgtcgctagtggtctgccgaagttctagaaggctgcaggatccactagcgaagcaaaggaagcagtgaagccagatgtgaagcaggagtgaagatcttggagaacccgtcgcagaacctataccaccctttagggttttgttagtcgtgtgtttccttgattgtgtgtgtagcacatggtttgcatcagtggggtgtgatgtaaccatgctaggttgtttgcgttatcaacctgcagaataagcctaacatatatcataacaggaaaagattagatctgttaaggtcctatccttagtttctgatctctttctttcctccaattttctctttccccctctctaaaccttgtaacagatggctgacaatgagaaaggaagtaggtcagaaatcaaaacaagggtgccccaagctccgagtgaatgaagcaccagacaccagttgtgtgacagtggtctaacacctgattaactagaacgaattgcttatagagctaccacagcagcatcagatgccaattctagacccgagtcagatgcaacctcaagtgcaggtggaggcagtccaatcactcacaccacaagttagcgcaccgccagcatcccaacaagcccatcgtgccatgccacatgtggactcaaaagaagcaagaatcatttgttttatctatgttgaacaagggcactatgcaaggaactgtccttagcagaaaaaaaaagcaccaatgcgaaccgaagatgaggtccgtaagatgaccattaccggcacagaatggcctccaccaggaatgacaaaacgtcaaagaagaaatttcttccgaggtgcaccatagttgacggaacatcttttagctaatggaggtagagtgtctgatagcgaagattcagatcaagtctcctcacgggttgaagatgagaagtctctccaaggtttcaaccagaataaaaaggaacatatggcatgctctcgttgtggagaaatcggtcactttgccagctcatgtgtcaccacttgcgttcattgtgaggaagaccatccacccgacgagtgtccaacaagcaggattacttatttcttgtgcgaatgagctgatcatgtacgaaaagattgtcaattcagttttctgctgatgaagaagatggccaaccaacccgccagttacaacagacagaagcatcaaggcaacccaaatcctcgacaagactacagtttcagcctaactccaatgccaggacagaggaatcaaaatgggaaaagaaaatgccgagtctggaaaga

SEQ ID NO: 42336 - DNA, 153 bp, Oryza sativa
gactcggatcagagatcagatcagattggtgacctgcctgcctggacagtgaacatgcatatgcatgagtcgcaatgcctttttctcctggccatcttaattccgagtttttggtcgtctctccatcatcattccatctgttcgatctgcagc

SEQ ID NO: 42337 - DNA, 1501 bp, Oryza sativa
cccacttttccctctctctctccctcggattcgttcggaaagtttccccctaacttcgccggcgcatcaatggcggccggatcttccgcggccgattccccctcatccggccgctctctccccctcccaacactatataaacgctccccgtgcctcccttcaccgtttccgccactcgccgctctctctccctgtcggaatcgagctcgcgccgtcgttctctctctccgccgtcgccgccgagctccggtccgccgccgtcgtcgccccggaccctctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgccgttcccgtcgtcgccgtcgacccggggtgagccgtggaccgccgtttcacttcccccttccctcccctctctcgggcgccgctccgccgcgccggtggtcgccggcagcgaccatcggggcgcgggtgcgccgcctcccgtcggctgtgccggcgtggccgccttcgggcgcgccccgcggctgccatgtggggcccggccgtcagccgcccgcgccctcgggtgcggctgacacgtgggaaccacggcgccggccggcgtaagccgcgtgcacccggtccaccgtggaccgtgaggctgccgcgtgggccccactcccgtggaccctgtccgtgcgcccctcccctcggctgacgcaataaatccgattttaaattaaaatttaaatgaagaaattcgcaaatatccatttaaagagcatataaacttcaaatggccataacatggccattcgaactcggaattggaccgttcaagtctctaatttctccttaagaagtcaagaacccatttttgtgctttgtttctgcttgttatatggagtttagtagagtaaaagccgtttcttttccattggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattattgttattgttattatttccttgttcaccctagaataaacaaaaccccaactagtggacactctactcatgctatcactagtatgattttaggtagatgcttcgcttttaattaggtaacattaggcggttttacaactctagactttgggaatattcatatcacctggacactatggaatggtttggttattgtggaattggcttcacaccgctccttctattcaaaatccccaaaaatggttttaggctgggctcggggtgcatggttttgatagtagcac

SEQ ID NO: 42338 - DNA, 244 bp, Oryza sativa
cagtgagaggagttctggcgctcccgggaaagagaagtctcacacacatattaaattaaattatggttcaagttaagttctctctctcacacactcatggcagtcctaccaatggcgacaccgatgtagggcacgcctctcggccctacctcaacggctgtcctaccgtagcacacctgcctcactcaggggtgaaccatctatgcagggatactgcctctgctcggctatctactccactagg

SEQ ID NO: 42339 - DNA, 1457 bp, Oryza sativa
cttggccaagaacttgaactgcctctccgccaaacccccggagcgacgctggtgctggtgtaagagcttgggtgggcaactgtcacgcccagaaattcccgaatagaattccaagcagaatgtgcattaaaatccccgtccagaaccggccggggtacacaaacgacaatatcgacattcagatccatgtcttacaaacatcacaaaagtcttacataaatgcagcggaaagaaagaaagacaacaggagctaagccttgactagaactgcagcgggaacaccactccacaggcatcctttctacacactttgtcctcactccttaggcacatgatctattccttcacacaagaaacatgtgaccttccttaaagggcatgcatctgagtaatgggtatattcaccacagcggcatgtggggaggcataaactagcagtgtgtccgactatcccacatctagcacatgctttgaacttcaactctctttccttgaaactgttaagggtcgtatcatcatcgtcatcagtagaaaaccgttctcctgattcatcatcttcgggtctgggcggaccgtactttatgagatgtcgggttagctggcgtgctccacggaaggtatttcttcctctctgacgcttgggtatccttgctgcgtcttcaggagtaaattctgaactggtgatgatcatggtcctgccatgatcaagtgaattattgagggaattaaaaatttcctttaaaaatcattggccaagaatattttgtaatattctgtgccctaatgcactctccggaattttccgtgaattttcggagctcgagaaatagttttaatagcacaaagatcattgcatcaatgatctaaagttgtaaaaccacctaatgttacctaattaaacaacgtagcatctacctaaaatcatactagtgatactatgagtagagtatccactagttggggttttgtttcgatctagggtgaacaaggtattaataacaataacaataataataaggtcatcacaaaggtaaataggcatggctaaataaaacagtgataacgtgggaatttaaataaagcggtaatgcaataatcttaaattaaaataatttcataaactgggattcaatatgttcaagaatgatgttacttgccttgctcgctttcccaaacgtcggcttcaacttccacgaaaagcggatctttcgaagctgcagcgtctacacgaccaacggaaaagaaaaggcttttactctaataaactccatataacaagatgaaacaaagcataaaaatgggttcttgacttcttaaggaaaaattagagacttgaacggtccaattccgaattcaaatggccaagttatggccatttgaagtttatatgctctttaaatgaatatttgcgaatttcttcatttaaattttaatttaaaaatggatttattgcgtca

SEQ ID NO: 42340 - DNA, 1501 bp, Oryza sativa
aactcagcatataatttcatttcccggtgggaacaatgtacatcaagaatgtagttttaacatcatctacgtacagaacgaatgatagatcggtcacaaacctcgagtgagattactagttcgacctgccttgccatgaatggacctgcgtagtactactactactatacacattacataggctactagtcttcactagctctctcctggtgcatgctctttccccactatgtaagcttcttcaatctgcagccttattatactgatcttgctctgcatgccgttgtagtgtgcctgttagtaggaaaactggaggttggaggagaatgactggccgaacttccaccacgccggcacgatgttctggaagacgagggtctggccgccggtggaggtgacgccgaaggtgagcgtctggccgacgaggccggcgtgcgactgccagttcgcgccccagttcctgctcaggggcatcctgtcggtgttcggccccttcacccacaccgactggatcgacccgctcccggccacgttcgagatcagcaccagctcgaagtagttgaaccctcccatggtgaaccgaacccctccctgcttcacgcacggcaccctacatacgtccacaaagaatcacagatcgtacgtagtaatgatgattaattagtgaatagttaatggcattggtttgacttaattatcatggacatggagagtcaaaccgtccaatattattgtagtatacgtacctctggtacagcaccggcacgataccggccttgtagatgccgatctggagccaggcgggctcggccatgtcgaagtgcgtgcgaggcgggttgcaccagccgccgtcgttgctggagagggcgtagttgggcgggcacaggttggtcccggtgatggtcaccgtcctcccctgcaggcaccaccgcggctcggcctggtggtcgcacgcgatctggtagcactgcccgcacgacgcgccgtcgttgaacagcgccgagctcagcgccgccgtgttcgtcccgtaccccgaccagtacaggttcccgtacccacacgccccacctgtgcgtggtcacctcacctggcctctgttagctaacgacgactctgaaactgtacctacttactggtgcgccaatgcgtatacgtacccatcgtcccggaggcgtcgctgccgccgtagaacgtggccgtgccactggaccagcctgccgtcgtcggcgcgatgagcgacgccgcggcgatgacaacgacgagcggcagaatgctcggtgtcttcttcttcttccacatcgccatgaatcttgcaggtggactagctcgccgagttgctgcaatgtagttagtgacagtggtagtagtaactatgaagaaatgcgagtgatcttaaataggagcgggatcaccggcatggaatttttgcctgcgctgcagcgcgaatggcgcatgtacgtacactgcacacactcagctccaattaattgcgtcgtcagat

SEQ ID NO: 42341 - DNA, 1101 bp, Oryza sativa
tctcctcctcgtgcgttctcctcgccgtactcccaagccaatcagcaccgcaaaccagcgccgcctctaccggtatccacacgtacatggacggaacgccacgcgcagatgtgctagcacccgcgcacggctagggttttgctcggggagagaagtgactatcgcgcccggaaaaataccttttccaaaacgcaagtgtattaatccccgtcccatgaaaagccggggtacaccacacaaacaggatacaaaaggcacatctttattatatcgataatatttacattattacaaaggcacttcaggcctgacaaacaaaaataagcagcagcggacaagcgggcctacggctccatcttcacaggtgctcaactggggtataagccaggactccacctaggacttcttctccaaagcttctattactgaagggggggaaagatatagcaagaatgagtacaaccatagtactcagcaagccacaccgggagatgcatgattaatgcaagggggtacaaggggataataataggggttaggttttgcagtaaacagcatttaaaagtcacatagttgcccaaagctattttgtaaacacgatcctagagctacacaatattattaatcaaggccgtgaacccacgcgaacatgccttaacccaaggcctacgatgattcagaccgaactggcaaccagacccaggtcccaactcgtcccaagccaacccatgccaaccattccacattttagttgttaagcaagttttaaaaattaaaccaccaacttgggtacattgctaggcttacccatatccgagggcgcggctattcaatagattatactctgatcagaggtgtacatctttacctacaagacacatctttactccgtattccacggccgtggaacccgtcataaaggatgtgacttaacccctttacctatcctagccatgacaaaagcaccgacccaaccccgactacggccggaacccccgagacaggtaggcaggattgagcccctagcagcagaacactggccctgtgccatgacatctcgactaccacgccgtagcccgtgtagccttcatttgccctaga

SEQ ID NO: 42342 - DNA, 223 bp, Oryza sativa
attcctgcgccccatttgaacgtgacgataggtcggggatttgagatccggaatggcacggagactgactgcaagcgaagaaacaattttcgcaattaaggtttttagaaattacattttcccgctaggcgccacgacggaacgggcgctacaactgcgcccgtcccggcttggtagtgccaccctccgttctctcttttcgctcgccctctccctccctagc

SEQ ID NO: 42343 - DNA, 163 bp, Oryza sativa
atgaatttttgccaaaaatacaaactgactagtggcaactgcacttttagcttcatttcttcacaactaaaataatatattatatttgactatttgggctaatctatttgaggaattattcttgttttttctggtaattccatcaagccttttccattctagg

SEQ ID NO: 42344 - DNA, 948 bp, Oryza sativa
tatcagttcacccagttaattaatttcaagtttctgtaaaaaaaaactgtatggttaaacttgtaaattcagctgctatacttttaatagatctcctcttagttgtactctctcttaataattcgctggaaacggctggaaactaacctgttcggtctaaaaataacttgcacaaaataaactaatggagtctgttgcgtattcttaaatttttttaaaaaaatcaaatgaggtcaggacaaagtcgatagtgcctggagctaatcgttctgttccaggaatatgtgctcaacttccatatgaaaacgaactaaaatcgagatcgagaggaattgctgttatgcacatctgtccggaaaaacttgtactataatcgtctgagagaacataaacggtttgtcgttgcatgattatagttaattagagtagattcttcagttgatgataataaaaaacgacatggttacctactactacttgataatacttgtcattttggatgagactaatatcaaactttatttttttttaactaattctaaaatatgtcttttttttcacgaatgcgcaaaataattatatgtcaatatatcagaaaaaaaagtgtttatttacacagtgcaatcaaccagaccggcttatgccaagcgaagggagaaaagacaaaataaaaaaaaccaaggaaaaaggaagatactactacgatagtaaacacaactctaatcaacggaaagggggtagagccacactacctgtcacaccccaatctggcaccgccgtacaacggcacctgataggagcgtgtcgtaggaaaaacggcgcgaaccgctccctacgaaaccgcgatctcagtaccagtcccaggacatagcgctggtacccacggtgacaaatatgaatcattacaatccttaaaataaatagaggacttatttaccttaacttagg

SEQ ID NO: 42345 - DNA, 271 bp, Oryza sativa
tcttaaaagcctaaaagagaagatctaattttaatttgttaaatctcaacataaaagtgggctagataaaattttgttaaatacttctcttgtttctatagttcctagatttttctgggatctatttgagccaaggaagtatttttaatcaatggaatatcatttcatgaataatttaaattgaaaaaggttttaaaagtccccttttggctttgggccgaaagtcggcccaagtttctccctccctctcctcggcctgcttgcgtccggc

SEQ ID NO: 42346 - DNA, 510 bp, Oryza sativa
aggtggcttgccttgctcgagatctggagcttgatcctcgaaatcctcgcactgcgggtcttcgggctccgaaactacacgcaaacgggacaactcaacaaacggcgaaaataaagccctattgatgacctctaagcgtgccattagatagatctcgggatttgaggaattttgggagttgaacggagtcaatcggatttacggttgggaagatattgaatttctaagattattggatttttggtctaaaggaaaaggatttaattaaatcctttttggaaaagaaaagaaaagaaaagaaaggagggagagaaaacagacttttcttgggcggctagggcgcggcccgagagaaagagcggctcggccgagcttaacgggccggccggcccaagaaggcggcccagagcggcccaagatgcgcgcgcgcggaggaaggagagagagagccggtgggccgggctcacctcgcgcggtcccgggtgggacccgcttgtcagcggctcggct

SEQ ID NO: 42347 - DNA, 744 bp, Oryza sativa
caataaatgagtttttaattaaaatttaaatgaagcaattcgcaaatatccatttaaagagcatataaacttcaaatggccataacttggccatttgaactcggaattggaccgttcaagtctctaacttttccttaagaagtcaagaacccatttttgtgctttgtttctgctgttatgtggagtttattagagtaaaagccttttcttttccgttggtcgtgtagacgctacagcttcggaagatccactcttcgtggaagttgaagccgacgtttgggaaagcgagcaaggcaagtcacatcatctttgagcatattgaatcccagtttataaaattatgttgatttaaattattgcattatcgctttatttaaatccccgcgttatcactgttttatttagccatgcctatttacctttgttatgaccatattattattgttattgttattattaccttgttcaccctagaataaacaaaaccccaactagtggacactctactcatggtaccactagtatgattttaggtagatgcttcgcttttaattaggtaacattaggtggttttacaactcaagactttgggatattctcatcacctggacactttggaattgttggtctattgtggaattggattcacacctccccctctattcaaaatccccaaaaatggttttaggctgggctcggggtgcatggttttgatggtagcacctcggccatataaggaccggt

SEQ ID NO: 42348 - DNA, 330 bp, Oryza sativa
gtagctgatgggatcagctaggcccgggtggccgtttgaaaagttgttggcccgggtggccgttgaaaagctgttggccgggtgccaaccttgtttcaattctaaagactgatacattgcacatactccgaccggacgagacgcactgtctcatccgtgtcgtttgagaagcactcacttagttgtttcagaaaagagttcgaataaaatcaattgcaaaaacaccagcctttctttgaagcctgcattaaacacttatttcccctggcttgctgagtactcccgtactcacccttgctctatataaataatctccccccccccctcagt

SEQ ID NO: 42349 - DNA, 1501 bp, Oryza sativa
gcatgattagtgattgagctcactgtgctggagctaaaaaaaaaatcagtttcctagcatatacatataccttcacaatcctttgggtcacattcacaccaacaaaaaaatcagattatatagacgatgaaaatgatggagcaccaaaaggttgcagcgtcggttatattcagaagatagattctaaaatagaatcctttgggtcacaccaaccaacagaaaacaaagaacccatgagaccatacaggaaaaccaccaagaatccaagacaaatcattttccatccaatttcaaaagcaaacattccatataccatactttagaatcaaagaatgatgcaaccaacatttcttaaaagcctacatgcccaggctactagtctaacactcaactacacgattaaacaaatgaacactgatgagagaagctgaaagggatatggttttaccgaccctgacgcgggcgttgtcgacgagggtgatgagcgggacgaggcggaggtagttgtcgatctcgttctgcgccttgcggaactggtacacgatgttccagcccatggcgaggaggtagaggtaggagcggtcctggcaggagtggacgagcaggtaggcgcggcggagcgcgtcctcgagctgctccagcggctcccgcgtctccgggtacttcttgagctccgacacccgcagctgctccagcaggccgccgatgagcttcagatgctgcgcgaaccggcggcagttgcgcttgtgcagccgcgccgtcgacgccgccttcacgatcatggagatgagccgcaccgcgtcgagccccgtcagctgcacgacggtcgccacatccccgaggttctcccacgacgccattgccgtcgtctactcggcttcttcttcttcttcttcttcccacaattcactcgattagttggcgtgaagcgagaagatcggcgacacccaaccaatcctaccacccatggcgatgatttccacccatggtgattccgtgaaacagcagctcaacggagcagatctgcgagactgacgcagcagctgagatttccgttcccccctcttctcctcctctcctgcgaggaacaaatcaacaagagaattcttatcgccccaaagcaactcccaagcagaaacagcaaaatgcaactgaaaattctacaaacttcactgctttcgcatcctcttcctgggctccctcctccgcctccgctcgtcggagagggcgaaattcgaggcgccccgccgtcagcctctcgagccgcgagaagtggagtggaggcgcaggcaatggcagcgaccagcaagtggaggagaggatgaggcagaggcggatgcgttgcgcttgggcttgcgcggcggcagcgcaggcgcagtaggcggcagtaggcgctctcggtcgcttcggtgttacgagacgagtcgttttggactcactcgcgctgcattcgactccactccactctccaccgctcgatgtgcgttttccccgtactgtc

SEQ ID NO: 42350 - DNA, 263 bp, Oryza sativa
agttccctgtgttagtttgcttgcttaagtttgcttgtgtgtgtgtgggtttagcgtgttgcttacatcattggtggtatgtaactacatgagtttacttcttttgcttgtcagagagtaagttagctggtgagatagtgttaattcaatttaaatgtaatcatacacagttaagagcaatatagaattgaaattaattaaagttctccgttctaatggtatctctctgtcgttctttccttttgcccatgcttttcttcaga

SEQ ID NO: 42351 - DNA, 1501 bp, Oryza sativa
atccatcctagtgtacaatgaatctcaacaaaagcttattcggatttcttgtattagaatggattacagcatattctaggctaagttattttaggatggagggagtaacaatttaagagtaatcaatggtcaaagctttaactgaaatattaaaattgtaaccccgattaacaaattgtattaagatggatcacatcacattctaggttaaattattttaagatgaagggagtaacaatttaagagtaactaatggtcaaagcttcaaccgaaaaattaaaattgtaacccttattaacaaataatcctttctaccacctataaaagatatcctttcaaccaccgagagaattaaatgatgcttcaggagaggataactttgcaatgacaacgttgattttatcatgattccagaaactagtcgaagcagacatatctcatcatatccatgtaatgatcaataatacttctccccgtcccaaaatacttcctattctaaatagtttagcataaattaagatttaagaaaaaaactataatgtctcttatttaataatgtacggttagaagtgaaataataattgaggggtataatcagaagaaatttgaactgacaacaagtattttaggacaaaatgtgaatttagtaaagacaactatttcgaaagcaatgtagtataaagttaagagtacatcattcatgttatcattatttagtaattactccattactccctctgtttcatattataagtagttcgactattttcctagtaaaagttatttagattcgaccaagtttatagaaaaaattaaaaaaaatctacaatataaatatattttgatgatatgtttgttttatgttgaaaatattactatattttctaccaacttgtttcagacttaaagaattttgacgaggacaaaaatcaaacgacttataatattaaacggagagaatactccctccgtaaaaaaaaacccaacctaggacagatgcgacattttatagtacaatgcagggtgtatttagttcacgccaaaaatagaagttttattgaaattgaaacgatgcgactgaaaagttagaagtttgtatgtgtatgaaagttttgatgtgatggaaaaattggaagtttgaagaaaaagttgggaactaaactcggccgcatattcattgtactataaaacatcacatctcatctaggttagtttttatgggatcgagggagtaagcaataaggtccgtatccttttcaatttaagacctactaccataagacgtactctcttcgttccataaaaaaccgatatagtactagatgttaacacattgtagtactacgaatatggatatgcctatatctagtactaggttaagttttttgaaacggagaaagtatatgttaagggcccctttgaatcgcaggagtgaaaaaaacagaggaataaaaaaacacatgattctgataggaatgcaagtgtaaaacagatgattgta

SEQ ID NO: 42352 - DNA, 1501 bp, Oryza sativa
cgtggtggtatcgaggcgcatggtgacatcttgtggagctgtgtcttgtgggaacagtggtacatctctgatcagagtaaaactatccgaatagccgtgtccgcggttatgggtgggtctaacaatgtttttcatgattagtctcacactactcattattaatgataatactgtgataattaaattgactcctggtttggaatgatatattcctggtatggaggtttaatttgtacaaccagggttggttgttcagatggggttgggcctatgcaacacgggggtgttgtatagtgtttatttaatattgcttaattacttaactgttttactattctctcaaatgtttattaaatcttgtttatgcaattgagctgtattatgccatcctttgttatcctgtgcacttgcatatttgctgtgtggcttgttgagtatgtcatatgctcaatcttgcaatattcattcatcagaggagtacttcggtgaaggtgatgatctggaggattaggctttgttctggtcaagttgcttgtggagtggagtcgccatagctgttccatcttttgtttttatttccgctgcgtagaattttattcttttgagaggaactatccacctctgtaataattatttatttcgcgagtattaattagatgtttgatagtactctattatcaatttgttattgtgtgcctcggctgattcctagacgaggatttaacgcacgtgtaagcatttggaattttggatagaaattccgggcgcgacaagttggtatcagagctaccttgaccttacgataagccaaatggtaaaccttaagtagccttcaaaatattttgaaaaataggactgctcttctctattctcttacaaattaattaagttggcagcacatgcaaggttatgtaccaaatttactaaatcctactttaccaaaacagaaacatgttcttttatttaaaaaaaaactttactgttcagggtattaaatagtttaattttctgaatttcattggttagtcggcactgtacatctattatggtatcgattcaatcaagatagcaccagcactactcatccctgttaatggtgacactataccgtgcttatggtagatcctaagtattttagttttgttttattcatttgtctaaagcaatttgtctctgtccaaagttgatttcattttccaaacaaaaactttgtttagttccgtttccacgagtactgtacaggaagaaaatatatttgcttctttttgtttacttccgaagtctgtgctcctgtataaataaaaattttcgaaaaaaaattcagaaaaacaaattggtttctgaaaatttatgtttcggtcagaaaagaaaaattcgaaatttaattagttctgtttcctccttttcttttctttttctttttgggtcaaattaattaagtctagtatgtgcagctaacttaaatatatgcataaattcctcctttctatgttcctttaga

SEQ ID NO: 42353 - DNA, 1501 bp, Oryza sativa
ccctccaggaccgtgtagccagcccatccaacgggagggcctacttacacataccactccatctacacttctgttctcgcttcttgtaaaagggttaacctgggagtgcatggttggatggacaagtccctataatttggttccacccttactaaactagccaggtgaaactaaacatgcgcacacagctcatatgagccacacaggccaaatcctaattgggccaggatgtcacaattacgtccaatttcaaaaacttattttataaataaaaaactaattacataaatggacttttagctcatcgtcatgctcaatggctctaagccataatttcattggcgctgccttctcagattttgaggtgaccaattttaccatgtcatatgagatttagcacaaacatttgtgcatactctacttgatagcatggtgacgaggggattctactctcaccatgagtttctaggttcaaatcaacaatcttgcatacacttaacaattttgacttttcccatgtaaacatagaccattgcctagacgaacagcttattcgactagagataggtgatgggccggatccgtatattatgtaaaagattaggctttgcaagttgtgttgtcttgtactccaaggcatattccataagttttagtcatacacacttatctaaatgtataaggaatgtttacacccaaatttggcacctatggacgaaataggggaatattgccaaagtttggaaagtgacgggtttccttcacaagaccggtcagaccgcaggtatgtgggcggtctgaccgcggcctgaactccggtctgaccgcaggtatgtggctagtcagaccgtcagggtccgagcccgagtctgttttcgtcgggtcttgggtttccttatttgggaaggcatgtttcgggtttttctttagtttctatcccgagttggacatggaggagggcctgtagagggtaagaccaacccctattcaagggacaatgccggttcaattgtaacccccgaacacacaatctacttgtatcgtttttttcttttatctttacttttagccatgttttttactttaccctagttttagtccatctttgttgatttgcgcaatgaatcgtccgccgccgctgcgagagtgcaacacctctttgtaggtttgtcccgaaaaccttccatttgcccacgagacgggtcgttatcctcatatagatctaaatcggcctaaaggctgattttgatctctaaatcagctccgctagcctgtttagctttttttctacaaaaaaccatcttgacttggccttttggctaggtcgaggtggttggcgactccatatcaccgcaaggcgtttaggtgatgcgatcgtgtttgtcgacttgtcacaaaaagttgccagcaaggaaatttatactgtatttggttgggtttttctccttgtaacccgacctccgaacctatataaggagggcagggagcctctcaatggaat

SEQ ID NO: 42354 - DNA, 1501 bp, Oryza sativa
gcggcggcggacgattcattgcgcaaatcaacaaagatggactaaaactagggtaaagtaaaaaacatggctaaaagtaaagataaaagaaaaaaacgatacaagtagattgtgtgttcgggggttacaattgaaccggcattgtcccttgaataggggttggtcttaccctctacaggccctcctccatgtccaactcgggatagaaactaaagaaaaacccgaaacatgccttcccaaataaggaaacccaagacccgacgaaaacagactcgggctcggaccctgacggtctgactagccacatacctgcggtcagaccggagttcaggccgcggtcagaccgcccacatacctgcggtctgaccggtcttgtgaaggaaacccgtcactttccaaactttggcaatattcccctatttcgtccataggtgccaaatttgggtgtaaacattccttatacatttagataagtgtgtatgactaaaacttatggaatatgccttggagtacaagacaacacaacttgcaaagcctaatcttttacataatatacggatccggcccatcacctatctctagtcgaataagctgttcgtctaggcaatggtctatgtttacatgggaaaagtcaaaattgttaagtgtatgcaagattgttgatttgaacctagaaactcatggtgagagtagaatcccctcgtcaccatgctatcaagtagagtatgcacaaatgtttgtgctaaatctcatatgacatggtaaaattggtcacctcaaaatctgagaaggcagcgccaatgaaattatggcttagagccattgagcatgacgatgagctaaaagtccatttatgtaattagttttttatttataaaataagtttttgaaattggacgtaattgtgacatcctggcccaattaggatttggcctgtgtggctcatatgagctgtgtgcgcatgtttagtttcacctggctagtttagtaagggtggaaccaaattatagggacttgtccatccaaccatgcactcccaggttaacccttttacaagaagcgagaacagaagtgtagatggagtggtatgtgtaagtaggccctcccgttggatgggctggctacacggtcctggagggagggatgttatagtaatgtcaaaaatcgtgggtatgatttgttggatttttagctacccacttgccgaataatttggttttgctcacggattgaaatttcggaccccttggcatgcacctatctcgctcgaaatttactggtttttttaatttgtttatattgataaaaagttattcaaattcattcaaaatttgtttaattctaaatattttgatccaaaatctctgaaatatcgatgccccatagaaatgtatgaaataaaattggaaaaaaccctcgttttgccaacacgcatccctcattttttcaactatcatgtcttgagccttcaacattacatgatattgttgaaataactatc

SEQ ID NO: 42355 - DNA, 1437 bp, Oryza sativa
atgtgatcagaaaaggcatatatggacagttctatttgatcaataagagcagagggacattcttactaaatcccggacgagcaatatttttagtaaagttcaatcaatatgttttttcatatgcatttagccaagacctgaaaagcataatcatgtacccttgagactacagagaatgccattggcaatcaagttgtatagattaacagagcagacaatgtaagtaaccatgaataattgcataagtgtgatttaacttgaatagaaacatgtatctttaacggcacagtacctattgtcagaggcaggaatgaaatgaaaaaatgaccgacgcttagatcttactggaaatcagtaagatatcgtccaaacgtagacaacaaatctatcccatccagttactggaaccaaaacacatttttattcaatagtcgctaccatttcccatgtatatacagtctaaaccaatgatcttaagaatatatattggtcccgaatacataaatgcatgagtgatccaaatatatttacactttcaagggacaataaacaatgtgcatttcagtgctctaaatttcagacaacccaatggttattaaaaacaaatgtgccatttatctatttccagttcagcacagaaatataaaggcctttcccttcaatttcactatagagcaattatattgcacacagtcctatgtgatcatagaagcataggcatatatacttaaatatagcaatacatagtactaatttatgaatatacatagttagatatggcagggactaatcagcgatcgtccgatacacatgtagacaaatcacccttagaatagtgaacatatagtccttttggaagaaacacagggtgtgagaatgttttttcttattccagccacatcaattccccaccatactgaaatcagcagtatggtacatattcatgaatttgaaagtgcttatcagaggaaaatacaactgttcacagttggctttggatgtagatatacagaaaatgtcatccatgattcccaatttccagcacaaattacatatgatatatattgagcataaatcatgcttttacataagatcaacatcagggatacttatcgggagagaggagacatattagggatggggtaggggtggcgaagggtgtcctgtacctttcggcgcaggaggaacggtggcgtgagtatggataggcagcggtggctcttgaggcggcagcggcgtcgcgttgtcgttgtcggttgtggatggcgacctcctcagtctccactgcctctgcacggggttctcaaatcttaaagcttgggagcttttagagtcctagattcagagtcatggcaggatttacaactggcgttaccttttgttgacctgttgaccagcagtgatctggggaagatgcaaaaatgaaagctgttgaaa

SEQ ID NO: 42356 - DNA, 1239 bp, Oryza sativa
catctttctcgtttctcgtttctcgtttctcgtttcttaggtggctagctagttgtcttcaacctcgagtgatttggtgttcgttcatgcatggttacgtacgttactccagccatgcatgaggttggagtgacggggtgttagccactcttcgtctagaggaaacattgcccccaaacccgagattcttataagggactacctccgtttcagattataaaactacctccatatgtgtatatctagattaattaacatatatatgaattcgggcaatactagaaagtcttaaaatataatacggaggaagtagaataaagactccaacttatatggagtacttaacttagaagttggatttgaagtggggttgtgaaacagttagcctaaccctaattctatatcgctaatttattttgtcagactactccactcagtttcactcatttattttaaaatgaagttgaaattgtttggttgggttccagcttcagaaaagatggagtagaagctataccaaacataacctaaggctcagttcttttcttcaactccagacttcaacttcttcattttccgttaacgcttttcaaactattaaataattttttttaaaaaaatctatatggaagttgtttaaaaaattcaaataaattaatttttcaagtttatacttattaatatttaattaatcatgtgctaaagagctttctcgttttacgtgcactaaaattctatctctggggaagatataaagaaacttacctgtttcatttttaaaattcgatagacatagatttcttcaacgatctagatgaaaatacaccctaaacagatctgttttaactgtggaaattgaattatgaactggccactaaaacgtgaccatgcatgctgtcaggccttggaatgggtggcgcgacgggcaccgtggcctgggcctctagccccgaagggctgttttggtttaaaaccagaacttgtgttaccaaatcattgatgtttttgaatagtacttttgaaatgattcttcactgacatatcgaccaatgtcgtcaaaatattagcaatgtcaaaaattgtctaggttttgacattataaatattttaatataatagcaaatcaaactggaagccactacgaatcgggcacccgatctgggagaaaaaaaatcgggcgcccgtccgagccgtccgatccagcaccctaatctcgtccgtctgcgtgcattaaacagg

SEQ ID NO: 42357 - DNA, 1501 bp, Oryza sativa
atattggaatggagggctctgctcctttgttaaaaatttatggacaggttggatgtgccatgtttgctcaaattcataaagtttagttattggctgtatgattagtttagtgcatggttcttgatacttcccgtagagatgatcattgggcgatggacagagtgtttgtacttcagaactggttgactgaagtagatgttgtaatgccagatatgtgcaagaagtaacatgtgaattctaactagcaaaattgaaagccgcgattgctctgggatctcaaatctgtgctattatgagttgcaatgtgcctaatctgcatgattaggtcactgtagttgaagcatgagttatgtttgtaactaagtattgatgccaatgcttgagcctaactatacggctgcatataatgtccccctctatttaaaattcacaaccatttttgacatgctgtattttttccctgcagggttaggttcatggcgtgacaacatggatagtatggaagcaacagatatataacatgcttatatatttagctaggactgtgaactgtgtaatgttgtgatatgggttatgtatggtgtctgtaaggtggatgatggcatgtgtcaaagcaatatgtctgtgggtttcggttagttgatggtgtatgtacctgacctattttgtgttggcttgctgaacttagtcggtccgttgctgattatctcctaattgttttgtcctgtgcactttatatggcaccgattgcaattcatttatttatatacatggcatgcacaaattggggatacagcacctttatttatttacaatggtcattcatatttgtaaatgcctacatttgagaaatcatcctttgttaaaactacctctactcctagataactttgatgatttgagaaatcatccttacttcctaaaactacccctactcctgtataatttggatgatttgagaaatcttccttctttcttaaaactacacctacacctagataacttggatgatttgagaaatcatccttatttccgaacaactaccaatcctcctccgagataaccttatttcctaaaacatcaatgttcatgaacgtgtaggatctaccttgcccatatgtgctccaccaaatcattttttagacggttgtgcattgttcgactttgaacttggctgtcacgctcaagtaatctagcaatatgttgtggtgtcccaaaagtgtgttctggaggttcgatctcgtagtcaccctcaaactccaagtcttcagtatcccaaacgtgtccttcgtcctcgacgatcatgttgcgcatgattacacaagccgtcattatatcgctaatgtcagctatcagccacaaatgcgtgggagtttccaccactctgaagcatgccttcaaaatcccaaaagcacactcaacatcctttcttgcggattcttgacgttgtgcgaacaatttatctttcggcaattggggatgacgaattgacttcatgagc

SEQ ID NO: 42358 - DNA, 495 bp, Oryza sativa
tgaaaccgagtggctagaagtggggaacgaataatccgaataagggaactcgatctattgggagcgctagtagggaatcgattggatacggtttttgaccaaaaatcccaaaattacagcatatggaatgaaatacagaagctcttactgctagagcattgtttcctcctttcgcgcttacatatctcggcatcggcgatgccgccgtggtggtcgtgctgcagtgctggagcaaggcgaggagtggatggggttacttgtggtcaaagcgaggtatggctcaagcaaaaccttatcctactgagtcctccgccactgaacgcaacattacgaattacttttctaaacaacaaaactggatattttacagcccgaacatttcaatcctgacaaataaccacctaagcactgttttgagcggttttgatccgagccagcacatgtggcaatccaatcgaaaaaaaactaactaggcccacatgtcatccaccatgc

SEQ ID NO: 42359 - DNA, 664 bp, Oryza sativa
catctggtaagaacgggtgccatcctagcagaaatccagactcctgttagtgcactcgacgaccgattcgctagctggctgaagtcttcgttcttctcagagacatgtacgctagaaccctgtagccgatgatcatcgcgaccagagctacaacttctgtcacgccgttgtcaagaggtatggcattgatcagaatgtccgggacaggatgatattgcaccttcagcagtagcctgtacgtgtggtagttgaatgacaggtagcggagccaggatatgaatggtggaactctctgcatatcatgatggagaagagggcaatgcgtaagacggagtaaagacttgttcattcagtatgttcttcagcattgcatcagtaacacagggaagtgcttgctctcacctttacaaagaaccctcctgctagcatgaatgtcatgactgtaactgaagctagagttgttgccttcttgatatccaagaggctagctccaattgccaatcctaatccctgcatgattacttttttcttgagtaacagatttctaatcactgctaatatccttttgaaatatctaagatatatgatggatcaaccaaaatgttccctaacttatgaataaacacaggtgatgactacaacttcatgggaaaattccttggat

SEQ ID NO: 42360 - DNA, 239 bp, Oryza sativa
tatatccacggcgaggagggagattgctgagttggttcttccttccttcaaggagaaggctggcggcacaggagaggagaggacggcgacgcagcgctgtgagctcggctcacgctttcgacgtggacgaacaagggcggcggctagagcgcgagggagcggggtggccggggtggtgaaccaagtgtagcggcacagagcggcatgggcatgggggaaaaagcacagggctgaggcga

SEQ ID NO: 42361 - DNA, 1501 bp, Oryza sativa
gggccatccaacccatgaaaaaaccatccaagaaacacaacttaagtcaaggataaagggctcacattccaaaggatatccaccggacatacccacaagatgtcactcactcctattggacatgcccacttctctctttgtttaggacttgagaaaactcatcacacatggctagacaagcccaccaaatgcacctatatgcatatgaactaatatggcacaaggtcatccacatgctcgcttcatagacccctcttgatagtacgacgcctatctagcaaatccggtctacaccaaacaccaagaccggaaaaagactaagaaaacattcttagttctattatacctttgccttgcgccatccaacttggggtcaatgcttgagccaagatcaacactcgtgaccatttgcttgaaccatgtttatcccgaggtcttgagcatcctttgtcaagactttcttctcatcacaatcttgacttcactattgtcaacatggcgatgtccttgtcttggtgaccatcaacccatgttgtcatccattagcctcattacggtggaacctattccttttcacatctcaaaggagaacattagtctcaacaaatcggttgtaatccttcacttgatgaccaaccggttgcatatgaaagatatggatatgtttgttgagtattcatttacacctcaagtgtcatatacccgtatgcaagctcaagtgcaaagatccgatataaataataggtaaacaacatggatctagaacatgcacaataaatgtataggatttgctccccctaagtatatgcatacaaagaaatatacaagagagacaagtgtatgcataagtaaagaagaatcaacgggggtttatcctatacacatagagaatgcatatgtagtaatgatgtagaccaatataaaacatataccttcatgatctccatgttcttaatgtaaattagactaaataagatatgactcgagtaaacattagtctcacacttatataacaataacatgaaaatcatacatataaacctatcaaaaaggagataagaagtggtacatatcgttttatctccatgcatttcatccttgtcatgattaaggtccatcaccaaagaatgcatatctaccacatctcatcatcgggaaataacctagttaacaacttatgaaaaagagaggttaatcccataaacatcgatttatcatctatcaccaaagcaacaattacacaaattgtttaatccaagatctttcaatcttttctctcttttgtgatagacaataacccgatataaacaatacaaagagatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagaccaaattagaa

SEQ ID NO: 42362 - DNA, 1501 bp, Oryza sativa
tctttgtttaggcttataagccaacttataagtcgaaaagtctaaacctaaacaaacaagcagcttttccgtttggctttttggaagccataagccactctaacactattaagccaaaagctaggttggagaagttttttttggcttatgtaaggtagatgtataactaaaccactaaacttaggacattaaatccaccggcttataaattatataagccaataagctgacttaaaaggatcggtgccgccgctgccgcccgcgcgcacgtacgcctaaaccgaacgcacacgcacgcgcgctggatcgatctgcaagggacgcgcgcgcgcctgaggcctccgcgagcgagagagcgaggaaggcgaggtggccggggacgtccctgtcgcgggctaagctagccgcaggcgggggctcgcgcgggtgccctgcgcgatacgtcgtcgtgaggccggcatgtgtggaagctggctgcctgagcgcgcccagccacacccgcgctttcccgctccattaatgccccgcgtcccgcatcgcgcttcgctggcgcgccccctgcccctccgctgcctcccccccacgtcgccctcgccacaatccacctcacacgcgtgacctccatcgctcgcttgccaaatgccttagctgcgtgtgttgccttcccatcactctgtgtctgtgtatataacggctcgtctcgtgtaaaagctactgctctaaatgtgcttgctaggaacgtgacggtgttagctaggtagtttgttcgtgttcgttcatggagtcgataatggagaagccgatgatggacacgggaggggggatgattgagcggaccaagtcggaccagctggcgccgccgccgccgccgtcgtcggcgcagtcgctgagcaggacggcgtcggcggagacggtgctgagcacggccgacgtgacgacgacgacgagcctgtcgcgcaagtccagcttcgggaagcgctcggcgtccggcggcgccggcgccggtgggaacagccacggctacagcagcagcaacaacaacaacagccacatccgcaagtcccgcagcgcgcagctgaagctcgaaatggaggaccttgtgttcagcggggcgcccttaggcgcgccttcagcgccaggcttgggtttttctttacctttaccggggttaccccttctccccaggacaccatgtgctccgccgagctccatccctttagcgacgacgacaacagtatgcgtcccatcactcctactgatcctaactgcatgcacatatgggtatcggacctttcgtagttatatttggcatttttattaccacttataaaaattggatttaaatttgtattttcgtggagtgatatattttatattaatttatgttactaatttttttaatttttttatagatatttagataatatagacgaaacgagggatatccgatctccttgagagatgaaatcacttccctaatatatatattctcattctctgt

SEQ ID NO: 42363 - DNA, 425 bp, Oryza sativa
tttaccgtgccgactgccgacatcccgacagtgccgcccagaacaaaccacagaaaatcgcaggaaatacttatactgtgagaacaagaacaagtaacaacagcacggttcagattccttgtgggggaaatctgtatgcgttggcgaaggctagacaaggtatatcaccgagggagcgcaaccaaattaattaagcaaggtagcttcattcccgcggccggccccctgcagacgccgtccaatgaagcaatccttcctcctgcatcgcactccaaacaaccctgaatccacacactatatatgtgcacgaacaccggcttcctctcaaatcaactcgaccacacctgcaactgatcaatcgacacctgatagtgatcatagcctgagcacctgatcaccggtcagtgatcgaccacctgcagcca

SEQ ID NO: 42364 - DNA, 1501 bp, Oryza sativa
gaattatagaattaagcaaagtatttaataaaattttatctggccccattttatattggaatttattaattaaaactagatcttctcttctaggcttttaaaataaattctaataattccaatttagacaacaatttatatatttgggatttttagggtgtgacaggactttagccgatccttgctctgtttccggaacgatttccatcatgaattccggttgagttttatctccacctctgatgctgaaattaccaaatttggtcattaacaatttgcttgttgagaatgagggtacaattgtattgtcgacgggctataccctcctacggtatttgttcaggtattggctaactcaggattccatgtgtagtgttcgagagggagacgatcagacagagatagagatagagatggtgagaccgagatagaaacgacgagttgggtaattccctatgattgttccctaccaatacgtgccatctgtggggacagatctccgcacggccggagagcccatttgacactagggttatacccgcctacggtatttgtagagtaagagaatcgttggcgtcagggtatgcgagagattgagttaaaagagacgagagagaaggattttttatagaggttcatgcccccttgtcaacgagtaatagccctactcctactggccgaagctgatgttgtctttatatatcaatatctcacgagtacaatatttgggatgacctaatctactctctgtgcgtctagcgacatgaagctctcacatgtggtcgacgactagcatagtctactctctcgaatatgaactcagcaagattggagttgtcttgtcgtattggtttgtattccatgtcccctctcctcttggtgtgttgtatttatatccttgggtggtcttttgtaggggtggaaatgagccaggtcgagtttgactcggcttgcaacggctcacaacaagttaggcttggcttggctcggtttggttggggaaacgagctaaaacatgagctcggctcggctcatttccaggttcgagcaagatcgagctggcttgcgagccttcccattgaagcacctctttatatataatttgtaatcattaaggaaaacaataacaaatcatcgacatgcaaaattaaaataattttatattattcaattcatcaaaatctagatgataaattgcatattgacaaataataacttcactagaaaataaaatcatacatataagtacatgatggcctaggctcacgagccaaacaagcggctcgcgagccagcttggtcttagctcatttcaagaacgagctaaaaagaaggcttgagattggctcgtttagcaatcgagacgagccgagctaagtgagctcgagccaagcccgagctaagctcgcgagacagagctttttttccacccctagtcttttgtacaagtagaaccagaggggcaaattctacgtctattgaggtttcctctggtggcacga

SEQ ID NO: 42365 - DNA, 1501 bp, Oryza sativa
agaagccctctaaaaatattggaaaagtagaactgttctcctctctttcttttataattaaaccaaactaatggcacatgcagtttataattcctttaattgttctcatttaaaaatttatttattattcctgtgttattagtaccgtacatctattactatactaatggctcatttaccagcaaaagttttacaacattggtttatttaatcttgctgcaatgaaataaatttagcatgttgattttataactttgttttattttatttctttgaaacctgttgttcaaaagtgcaaaatttgtgatcttgtttccaactgtttcaacttatcttgcaagcttggtttgctttatttacttaccttttactttgattttctaactctattcaaattaatccaaaaacttgtactattaattggataaatgtcttaactccctcctttcacttgtctttagatgccgcgctgcaagcctgagtacttgtttggtgttgagggatttgtcaaggagttgcgtacgatgtcctttgccataggatttgggactgcccctttgtatgcccagattcctcgtgatcgtgatgaagagaagtgccgagtcaaagtcaccttgaacagtaatagtgaagatatactatccgtgatgttcgaagctggaggaggaaactacattcatgcatgtcaggaggtggcaaggatcgccataggagagctccgcgatcgctacagtgatcagttggccgacactgagtatcgctaccatcctcgccaaccccagggaagtgaccgtggcagctaccttgagactgaggggattgagaatgatgctaccacaaggcatctggtcgagatgctgtgggctatggataagacccgcgcggagattgtgttagcagctcaagatcgtgaagaccggaatcgtggaaagatttgcaaactagaagacaaggtggatcgtttggagaaggaactagccgcattgaagggagaagcaccaccgcagaaggccagggttcgtcttaccgccaggaagagagctttattcgtccctcgctaccaattggcgccaaaggttcgtgtggtagaaaaagaagctaccccaaccctagcggatcctccgatcgtcaacgtaagtgatgatgaaggagaggaatcaaagcgcacccactcaaaggttgaatggggagctactcaagatgatggagacgagccgaacgagccttcaatcaactccgatgcccggaagacctagaatgccttgtcaagccgttgtcctagatcgttgtgttagtttgcttgttttaagtgtggttgtgtgtgtgggtcttgcatgtggtttacatcagtggtgggatgtaagcgcatgcgtttgtttgctttcgagtgtttggtagttggtgagtttagtggtgtgagagtcttcagttttgtaataatgaaactcagttaagatcaataaaagttaagttagtagaaaaattaattctctgtcctaag

SEQ ID NO: 42366 - DNA, 299 bp, Oryza sativa
tatggttccagccgagccgagccgagccgacgagaagctctagaagagtggcgttggggacgtggacggcgagagcaggtgacgcgttcccgcgcgacgcgggccgaggtggcgagctgcatgcgcctcatgcacgcacaccaacgcaccaaccagcgagttcactctcccatactactagtaccactctactagactccgttcgctgacacgccccgtccactcttgtccacgctgcgccgcgcagtgtcgcgcacaccccaaaaccccaaccaaccaaacaacccgacccgcggcca

SEQ ID NO: 42367 - DNA, 1501 bp, Oryza sativa
ccatacagttccgtctcacctacccggctcgttttcttcctatcgtccgctcaaaatcaccgggccccgagcctccccaccgccgtctcaccatcacgcaagttggaccgcgcctctgccctcgcgcttgcacgcccgcgggccgcgggggagcgtggtctaacgcaactgcttcgcgcgcgaggccggcccggtacgcgggcggaagggttgatttgctttgccatcatcacgcgagaccacgaccgctgattttctcgttctccgccagtcgtcgcacgcgccgcgcgagctgagctcctcctcccccaccccacccccacccaacccaaccacccccccgtgcctgcacggcccccggcggtcaccatccaccaggcgccgcgccgcctcgcgctctcctcgccccgccatgtgctggcgagtggcgcggcaacgaacaaaagggacccagatggatcgtaccgtccggtaggaatcgcgtcctgttcagcccgacactcaagcgtactaattccgcttgtacaggactacaggcaggtgtaactacagaagcgcaaacaagatgcaggcatgcggctgtctaaaattcggattgtgggcgtgcttgcatcgcatgatgagctgacaggtgacaccatcaaccgatttggtactagtaccatgtttcatcaggatgctggcccacggattatccggtcctcaccaaaccaccaaacgacgagccagatgctggatgagagcaaagattatcctacaggagtgtaggcaaatggccaaatgcctgacacaaacaagaacacaccacacgagtgaatgacaccatggaccattcatcaatcaactagtactgctaagaacaggtacaatgccggctgtaaccatatatcgaaaagaaaaaagaagaaagcgagctacatatttgtagccggctgcaacacggatttttctaaaatgttatctgtgtatgagaggtgagaccgtgtattaatggtgtagtatattttcatagttaactactatatgaatgagctattagattagctataaatgttttggagccagcagttggctatactgttgaccttgctctaatatagcacaactgtaaacaaccactccctataccaaacgggtaggagtagtacaacctccaaatccaggtcaaaccaggcgattcgatttctattcccgttctcccctccaaggctgactagcgctgcaatctctgcaccctcggctcggctcgcaccatttccagtatacaggtccacgcctccacgtgacaggtgctcgaagaagaagggctctgcttttgcttgctttgctccccgacccggccggcacggcgtgcgccgccaagccgccgccgcccgccatgggcgccatgggcgcggcggcgttcgacttcgagtacaagaggtaaatcgccgagaccgagctgcttacagcgaagccatgcagattgcaggcaggcaggcagagcagcaggagtcaaagg

SEQ ID NO: 42368 - DNA, 1501 bp, Oryza sativa
ggtcttaaagcatgaaaaaaagaagagataaaatttcttattcaatgcaggcttttcacttctgtttcaagcaagccacatgatggtggcactctacctcacagaaaagagaatgaattggctcaatcccaaaagatagaggttggccaaacagcattcattaaatcataaattatgtagtcttacccttagatctgtgctctagatagaacctacgttgcaaaagcaaaacaccaagttgtcagcttctttttattatgggaagttgtcaacttatcatatattgcataggtttgaaacataaacttagagattaagataagctgaccagatccaataacccaagaaatcaagatgttacccaagatttatgctagctcaccaacaaaaaaaaatttactataaaccaaattttcactaaatgtgcatgaattgacaatgtagattggctaaggaaatacctctctcccaataatagcaatggcaggaaccgttagaagccatggcccatctctgagcagtgaaatttccaaaggtttggtgcacagcaacactaatgttgcagctaccataagctgcagcagggaatggcagtaacaaagttagctcacatttgaacataaacaatccaacaggaaaaacgaaaacacagctgttcaagtaacaaaatgggtgggaagggcaatttaagaagtgagcagcagaaagagaaaagcacccttgtcagccacaggatcaagaaatgcaccaaaaggtgttcctaactgcatctgtacagaaaattgtgtgaggaaacaattaaagggctaaaaaaatgctggtaagcaccttgtctggcatgttattaaatcggtatttgtgacacacctttctcgcaatataaccatctagccaatcagtgactgcagcagcaaggaagatgccagttgtcgcagttgctgcccaaggcccctccatgtagaaagctggtcgcaatacaaatattaagctgttagttaaaatgtaaataaatcagagcgacaaattggcattagtctgtcaaaaataaacaaacaggcaccagaaccagatgcatatcaaccagtatttatcagtgtaaactgatagaaatatataggcaaaggttcaataaagactgtgaagacaatatccaaatagaagaaagagcataactgctaaaggatgtaaaggtgattcgataagttcaactacattgatgttaccttacctgctggttattgtcaggtaaacatactatttgacctcaggaaacaaacaagtacattttcttactttctacagatgataagtttgtacaaatccatctaactgttgcagaaattccatgaatcattgataacaaaaaagcatcactagtcatttcgataaagctaatggatgtaaactgtgaatgaatgcaaaagctcctcatgtttgtaaaagggatgtacattggagctagatatttaaaccttctatatatatagtgattatcccagaa

SEQ ID NO: 42369 - DNA, 1501 bp, Oryza sativa
atgcactgaccaatctgatgctctgatcatagtcatttctgatcgcataaccatgagcttgctttgctcccagtagtgttgagaaagaaggaactgaaggcatgacgattgaaagtgtggctgaattgggtagtactttagaggcaatcatttcttgcaacaaccgaagaacatctgactggcgcccattttgaactaagcccgcaatcactgaattccacatgctgatgccccgagcacttgcttgccggaaaagctgcattccctcttcaacatgcccgttattcatgtaccctgtgatcattgcactgtaactgattgaatccttcctagtcattccatccaacaactgtcgtgcatattgtaacctcccacatttggcataaaacccaattattgagttccatactgccatgtccatgtccagcccactctccgcagcaaatcggtgaacaccaatcccgaaatcaacaaccttgagctgcgcgcaagcatgcagaacacttgtcaccgtgacaccgttcggcccaacaccatcaccatcactgcaacgaacccgcacgaactcctggaacagatccaagcactctctataccagcctgcacgggcacacgcggatataagcgagttccaggacacgacgtcccttctcggcatttcatcgaacacagcgcgagcggagcgcatgtccccggcgttcgcatatgcggtgatgagcgcattggacacgaacaggtctgacccgaagccccgcaggaacgcgacggcgtggagctccccggtgacgagtggggagagcgccgggccggacgcggcgagggacctgaggagcgtggagagggtgatctcgtcgggggagacggcggaggaggcgaacaggcggacggccgcggaagggtccggcgagtggagggagagcgagatgaggatggcgttccaggcgaagaggctgggctgcgggatagagtcgaacaccctgcgggcgtcgcgcaggcggtcggcgcgggagtagagggagatgagcttggaggcgaggaagttggagggcgtcacggaggcggcgacgaggcgcgcgtggatctgccgggcagcggcgaggtggccggattccgcgcagagctggatgaggtgaccgtacgccctaggatccggcggcacggcggtgagccacgccggcagcttcatccgctgctcgtgaaatgctcagctccgatcacccgccggcgcgggcatgagagttttgggcttttggctgtgacccctactagttcagggcctcgcgtgatctagaccgttgagatcagatcaaacggccacgaggcccacgagagcaagtggcacatatgacggcaatagctgttttcttcacctaattttctttgaaaaaggaggtgtagcaatccaggtgtaatatcaaacagatttggttaaatggctcaaatgcacaacaagaacaccacttgtccaaagaataatgttcgcttctgacatatcatatgg

SEQ ID NO: 42370 - DNA, 367 bp, Oryza sativa
gcacctcatccgtccgtttccgcctctcgccgcccttcctcctcgccgaaatcaagctcgcgtcgtcgttctctctctccgccgtcgccgccgagctccggtcagccgccgtcgtcgccccggaccacctcccacataggcgccgcctccttcggcttcgccgtatcctcgccgacctcatccacccctccatttcgctcgccgaccgccggaacaccgtcgaccccgtcgacccgagccgcgccgccgccttcctccgctccggccgccttttttcgtcgtcgccgtcgacctagggtgagccgtggaccgccgcctcttttcccccttcccttcccctctctcggccgccgctccgccgtgccta

SEQ ID NO: 42371 - DNA, 1501 bp, Oryza sativa
catggtaccactagtatgattttaggtagatgtttcgctaattaattaggcaacattatgtggttttataactctagactttgggaatattctcatcacctggacactatggaatggttggattattgtggaattggattcacacctccccctctattcaaaaccctcaaaatggttttaggctaggctcggggtgcatggttttgatagtagcacctcggccatataaggaccggtcttcgggcctctgttggaaagcactaccgtccttccacatgtctagtgggtaaggcttagtttgtggctcagtctggttataaacaaaagtacacggatggagatggatgaagtcggtggtcgatggacatctctaggacaaatgaaggctacacgagctgcggcccggtagtcgagatgacatggcacagggccggtgtcctgctgctaggggctcagtcctgcctacttgtcccgggggttccggccgtaggtggggttgggtcggtactcttctctatggctaggatgggttggaaactatgtcacgtcttccgtccgtataccgtggtggtatgtggcacgtggttacacgtgaggaagatgtgtattgtgggtaaagatgtacacctctgatcagagtataatctattcgaatagccgcgccctcggttatgggcaagccgagcaatgtacccaagttagttttttaattcttaaaacctgcttaataactaaaatgtggaatggttggcctgggttggcttgggacgagctgggacctagggtcgggttgccagttcggtctgaatcatcgtaggccttgggttaaggcaggttcgtgtgggttcacggccttgtttaataatattgtatagctctagaatcgtgtttacaaaatagctttgagcaactaagtgtcttttaatgctgtttactgcaaaccctaaccctttatattataacgcccttatactcccttgcatttatcctgcacttgtgggtgtgtcttgttgagtacggtggttgtactcagtcttgctcaatttttcccaaacccagaagttgatttcctggaagatgaaggctttggtgtctagctcgtgtctgccgtcaagcgcctgtggtcgtcgccctagtcttccgctgtttcccgtttgtctttgtgtgtgctgggccttcgccgcccatgtaataaattatctatttacgcttctgcttgataaactctgaaatgtatcaacttttggtgtaccttgcctcctgggacaaggaataatacacgcacgtaaggagcgcccgttgggttaattccggtcgtgacaagttggtatcagagcccccttgaccctaggacgagccgtagatcccaagccttagcaatattttcaaaataaaaatcctttcttatttgtgaaaatcctttagtctctctttgtcctgctgcttcatttatcgtcaaaatctgatctttaaaatgttgcttttctcgtttgtttgtaga

SEQ ID NO: 42372 - DNA, 1501 bp, Oryza sativa
ccgtgaaaaattttataaatgcttctaagctgtcacatgatgcttatataaatgctcctataatgccacgtggcgctccaataaattaggaaaaatctgaaaaaaaaacccagcttttgatttcactaaaattaatattaataggcccatcactccaagccgttggatacttggattagattgatttttctatttcttacaaagaggcatcccctcttcccgtgcatatgcatgtacataactcctctccgtttttcttttaaggaagttttttttttttgctatcggatgaaattacatgttctattgtgtcattattatgactaaaatcacaaattagaatttaatacacctcttaactataatttagcttgtaaaaattatgaaaagaaagtgaccattattatattgtttcatgctatataataacttcactggcatgtaactaaaatagttctacaatgtcagaaaaatgtagtttacaccggtataattttacttgtagaaatatattccctaaagaaacatgtagatatatattaggcacatttcgacaacttgcgccatatctatctattatatgctaaaagtcaactaaaattcccacaaaatactctgaaaccaccacgcgggactcctacgaacacacctaagccaccatgtgacactaccactggtggagaaatggtctttcctcccggtttgtaaccccctatactcacggttggtgttactaattgagactaaaaatgctagagctagaaccggcggttggcagtttttttaatttttttttcatatggatttcactaatcattacatcccctaacagataaatccccaaatcaaattcatcataaattctaaaaaaaattacatcacaaattttgaaaaaccatcacaaataaattagaacgatagtattaagtaaattaaaacaatatgaattcatccgattataaattcataaagataaaagactgaacctccacaaagaactctactaaggccaggtttaattcccaaaaaaatttgttttggggtgtcacatcggatatatggacacacatttgaagtattaaacgttgtctaataacaaaacaaattatagattccgctaggaaactgcgagacgaatttattaatcctaattaatccattattagcaaatgtttactgtagtaccacattgtcaaaaaatggcacaattaggcttaaaagatttatctcgcaatttacacgcaaactgtgtaattgatttttttcccacatttaatcacataacaaattatcaaaaacaatcatcacaattcctcaaaaaaagaaaatcaattccgaaggccgccgtgcgcgcctccccagcccggccagccggccgccaccgctgccgacctcgaccggccgccgctgacccagagaggccgtggtaggaggaggaggcggggagggggaggagaggggaagtgggaggaaggggagaggagagggggatcggacaaag

SEQ ID NO: 42373 - DNA, 547 bp, Oryza sativa
cggagcgaggcggccgcgcggccgtgcggcagcggcggagcgaggcggccgtgcggcggcggccggtggggccacgcccggcggcggctggcaggcggccggcggcagcggcagcccatttgcatatttgtgtggataattttgtgattcattgcacgtttgtatggatctgtgatgtatttgatatgtttgtaatttttgtaggatttgtgatgtatttgatttgtgtgtataagtaactttaagatttgtgatgtagatttgagatgttactttgatttggggatttgggtttgatttgggatatatatcccactcgattcgggagaaaataaaaaagaaaaaaaagaaaaggggaccatctcactgccgcttccctctttttagtcccggttggtgttagcaaccgagactaaagatcccctctctttagtcccggttgataccaaccgggactaaagatcgatctttagtcctaggtatttgaaccgggactaaagatagcgatatttagtcccggattggtagtcccggtttaaaaaacagg

SEQ ID NO: 42374 - DNA, 1501 bp, Oryza sativa
tggcatagtagggtttcatttgcataaacaacatttaataaacatttcagaatttaataaaacagttaagtaataattaaacaatattaatccaacgctatacaacatacccttttgcataggcccagccattctgaacaaccatcccggctgcacagttctatctccaaaccaggaatataccattccaaaccaggagctaatcaaattattaccagttatagcatcttttattatggtgagaagtgtaaaactaatcacgaaagacattgttagacccacccatgaccacgggcacggctatttgaatagttttactctggccagaggtgtaccactgtacccataagacacagccccacgacatgtcaccatgcgcctcaataccaccatggtacctcagaaaggagctgtgacagtaccccttgcacaacacaatccaccacagcgcaccattcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaatcgtcatgagcacgacaatcaaaaccatgtgctcacaacccaccattatcaagttttagttggcaaattaattaattaaccaatcatgattagccatcgtgagctataattaaaccatcattaaataatagtgagtcataagttatcccaatagtgtgctaatgtttctaagcatggctaagcaattatatctaatatctagctgaaccaatatataaagcccaactagtgaagttataataacccaaggtatcaaggaataaaataatcaagaacaaaagggctataacaaacaataggttaattccacccaatgacatttgaaaataaatgcaatagttgaatagaaacaatagctttaaacgggatcaacatgctcaaagggttgtttgggatctgtgtgacttgccttgctggccttggaactcttcaaattcttctcctgcgaaaacagactctctgaaaacgtcggaatctaaacagaaaggggcaaaatcaccaaacagcacataaacaagcatgaacagtatatgtggatatttttaacatgtagatctcaattttagaaaattttagagacttgaaccaactaaatccgagctaagatgaattagttatgaatttttaaagattaaatcggattaaaacacttatatggattttaattgaattatgacgcaataatgaattatttttgaaaaggaaaagggaattattgcgtcagtagctagggttcgcggtgaaccgggagcacggcggcggctcacggaaacgaacggccgagatcgattcatccaaaacggacggccaagatccatcggtccatgaccgggccacggggaacgatgacga

SEQ ID NO: 42375 - DNA, 288 bp, Oryza sativa
tgttcatcagaggttgggcctagtgaacgaagatcgtgatcaagaagacgatgaggacagaaaaactcaatggtgtccttatggtatttttacaaagaatcagaagagaagggtcaaaaggttgaggaatagagaatgttttcgtggggtagagccaagagatcaaccatcggctgaagaaagcaaagcccaggcaagaatggcgtgttaaaaggcaggatccaacagccgatgaggctaaagccaatgaagcaaagaggctggccaaaggaaagagtgtcgtgactg

SEQ ID NO: 42376 - DNA, 1501 bp, Oryza sativa
  unsure (1)..(1501): unsure at all n locations
agtggtacgtagtagacagatagctgcggctttttcatgctataagctcagtacggtgcacagtgtttcctaggcatctgaggcttcggattctggagcgatgatactgcaggccgcaggatcttcgaccaccatagctacacaaagagctttccgggtcaaaaattatgctttgaaaaaagcaggcagttaaagtatcaaagcgatggaagcggaacaataaaaagaacttgcctgccccaagaatttccaaccagattccactggaaatgctatgtaactagtaactgctaggtacactactgtactattcttcttctactgctggtccaggtcttttcttttcttttttttttttttgcccggcatcattacgacgaccctactacgcaacggtgactatcattcctgatctaagagtggagcctttgcaacaggccgatgaacgatgatgatgacgcttcttcagcaagtgaatgcagggacacataggacatagcccatgccacgctcaccggctcaccgctcagccaatgcacaaaggactgaaggacacggcctattttgtctcccaccgctggtcattaccgtgacctgggaggcttgggaggtgtatcacgtgcacagagatataacatatataataccaccgaaactattcaaaacattttgaaattctggattagatcaaggcacagaaatggacaaccgcgcaacaatgtagatacaaacagtgaaggtaaagccaaaagaaaattaaagaggaaacagttccacctgatttgtcttgctggccttgggactctntggatgagtaacaacctctgtcataggctcaagtgctcaacgcctatgcatgatgtgatcccaattatggagcgctccacctgtatacgttcaaatgcgaatgaatagattgtaccacctattgtattataagagcgtcgtggtgattatactcacttagcttcacttgaactccaaggctccacccggcaaaaaactccaaggctccaggatgagctggagctcacattggaattcacatcaatgttgccactagtaatactatcccctgcttcatttggtcggtcagtgcatgtggagatcgctgcaaccttcagcctgtgaagttttagcatgtgagtgctggcacagaacgaaataagagtcgtggctttctggtagtaagatcagagcaagttgggcacagtccggagagctgcttgtgtgcttttcctttttggagttcatgacctgggaagtgaagaggtagaatgatccaagcatgtgaaccgtgatccacaagcacgagggtactaaaagacagatcttgttgtgctagctctatgcagttgtaattctaatgcaggataggattgggcacatgcatgcaaagcagacaaggatttggtttggacggagaaaaaaatgttgaaaaaaaatcacaggttcaatcccattaaccacagattccagtttcaaaatgcaaaaaagcatg

SEQ ID NO: 42377 - DNA, 216 bp, Oryza sativa
ccgggggagagatgggccgagctggattcggcccatcgaacccgggggaggcaaactagacttttgcggaggaaattgatttggagggatttggattcggaattgaactcgacgatagatcggggattgagatcttgagatggcacggacactagacaacaagcaaagaaacaaatttcgcaattagggtttttaagagataattttcccgctagg

SEQ ID NO: 42378 - DNA, 1501 bp, Oryza sativa
tcttgccgttgtgctctagagaaggcacctatcgagaaagacaacaacatccatactactcaattgttcatcgacaaaaattatacatgaagagattcagatgacatgcaggaaggaagaacaggtgtactgtaccgtgccctgttcgtaaaccttctctttgtaccaagctggtttgtcctgcagatcaatgccgactagctcgatcttgtcctgcaagccctggccaaattgacagccaaaaaaaagtacaaaaaaaattcaggtttttagcaggaggagtaaaaggagtatgaaactctgcagccaaaggtcagagaagttcagaaacaaacaccttgaagttcctgataatccaagcgcgctgagcaaacgggcagaagtagcaaatgtaaagccttcacaagagtcacaaaagaagatttacttcgacgcagaagttaaaagaaaaaaaaagggatttagaggcatggtaattaattatctgtcacgtaagttaacctcacctggtggtgccgtcgaagaggcgagggggctcagaggcggagccgagcgcagcgggaagcgcttctttcccggagctgcatcacacgcgaagccgtaattaatcacagagatcgtcattagggtaaaaactttgccattttccgtagctaatcagtagttggttcacagcactactactaatcaaatgatggcttacctacgcggtgctgcagctgcggccatggcgatgagctgggagagggaggagtgatccaattatgtggcctgtgaatgtgatatgctgagtgattcgtggttgatctgggtgagtatttttatacttgcaggagatgggagacgagttgattagttaacacattgtgttattgggtcgcagttgtttggacaaatggtttggaaacgtctgtgtccgtggcggcgagggcacttggcaaaccaagttcattagctccaatcattgactggactaatggtgtgttgagatgcgtaatggcagggtgacacaactgattgggtcatctttatgttttaagtggtaggttttgtggctgaagaatgtaacctgccttttggcccttttctaatttctatagcttttgtttggtggtctcctgtgacataactgattatgtcatcttgagtagcttagtcactgatagcgttatactccgtccgtccaaaattataggacgctctttttttttaagagaatcaaattcggaatattttgactaataatcatactaactatatctatactaagtattatatatattatatcactagatttaagtattatgtacgttatattactagatttattgtgaagtactttcatgtgatgctaattttatatttgttgggatcatataatagaataaaatattggttaaaatatgttattaaagaccatgtaaaaaatataggctttataatttgggacatagtgagtagtgttttatgcgatctaattataaacgaaaatttcgccagg

SEQ ID NO: 42379 - DNA, 196 bp, Oryza sativa
ggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgcca

SEQ ID NO: 42380 - DNA, 224 bp, Oryza sativa
cccgggggaggcaaactagacttttgcggagggatttgatttggaaggatttttattcggaattgaactcgacgatagatcggggattgagatcttgagatggcacggacactagacaacaagcaaagaaacaaatttcgcaattagggtttttaggagataattttcccgctaggcgccacgacggaacgggcgctacatactgatcttgagaagacagcagc

SEQ ID NO: 42381 - DNA, 1501 bp, Oryza sativa
cgccggcggcgccgtgatcgtccggaaggtggccgaggacatcgccgtccggaggcagccgtcgcgcgggctacggagcccggagagcgtggagcgtgtcctcgccgagcgcgtcctcccgctcgtcgggcacccgttcgaccgccgcgccgtggccgtggcgagcaagcagatatgcgcgtacgtgtccgccgcgtgcgccgacccccgcgtcgcccacggcggcgtgcgggtgctcgtcctgctcgacaccttcgcgtgcgggacgttgttccaccccgcgccgccgcgcaagcagtgctccggcgacgccagctctctcgaggtcggcgccgtcgtgaggacctgtccgtgcatggagatcgttggcccggggagcaagaaggatccgcagctcgcgtgtccgtgcatggacattggggcgagaatgccgagcaagaagccgaggtcagtcggcgtcatcggagacggccggccggcgaaagacggcggcgaagatcggctgaaaggttggctgccgtggtaattaggatctcgagctacacggaggacgcggagggttatcagttcttcttcaggatctaagtacgccgatagatgaacaacaccgtgtctctgtacatgttcgtgtctgtatttatgttcaaggaagaacttgaaagttgtagattttcattgatctcttatatgcaagaaacttgcattggtcgcgggaaacaccagttttctcggtcgcaggtgttgtaagtataattcgagtcgaaagatgtactaactcgtaagatcatcgagtcgagtaattcaatgtttggtcttaaattccaatgatgcatgcgtcccttacactacttacacacagttatagtgcatcaaaattagattttagaatagtttttttctctatatttgagatttttatatgcttattttttttattttcatttaaatgggccatatacatctccactattataaaagtttaagatgtttttgcctcaaattttcgtacgttgtctgattttttatccgtcgtcgcatcggcatagttgccgcacgcccgcacgtcgctcggagacggagatgtacaggcgctgttgcatctgaccgaggaaggcagtaagcgctcttgagtcctgatttttttttaccagctgagccatctgtccatcgccgtaggcctcttgggctccttcctgtcttggctggttctgctcctgcccagctaaatagttaattattattttttctgttgaattctcatctttatgttggtataaataaatgggataagatattatacatgatttatgatgaatttgataattttatcaactcatgcgtttttcatgtacgtttgtgttgtgcatcttttcactaagccacttttaactgtattcattgtttttctttcgttgattcaccagttgaatatgtaatatttgtattcggggttacgggttaggtataccctttacctttcgatatacgtcacatatcggta

SEQ ID NO: 42382 - DNA, 584 bp, Oryza sativa
aaattaagagtgctcacatgttcccctctgttctgctaaaataaagattttcttgtgcattggctttgtatttttccatatgaagtatatggaagcgccagaaaacaccagcttaatcatttatagaggtagagccaacacaaaaacagcatttcatttggagatctctttcatttgctacaaagcatactactcttctcatcccatacacagccgtggcattgtcaaagcccagtcgaggcatgtgtcatgctattcgatctcaaacagaaggttgtcatttgtcaagctgaacgaactttctcaaggggcataattaccacaattaagtactacgactagcactagttgagaacctaccatggcaattctaccgcgcgcatcattttcgagccaaacattgcaattccagtagatgaaaaaaaagaaaacccaaaattggggcagtcaccttggggagcagactccacagcaacttccacggaggtccaaccgccgccgccggagcggcctcccgcggcggggccgacacaccatcgtgcggccgcgccgcgatcggcccgagacgcggctgcgcccgtagc

SEQ ID NO: 42383 - DNA, 483 bp, Oryza sativa
agagaatggctggggccaacttggcaaaaagaaatcgaatttatctctctccaaactctgtctctcctctgcctcagctctgtttctcttcgtccccaactccgatctcgtctaaatatctctctctcttgtcggcggcgagtttcgcggtggcgtagtgttacagattagtgttgaataatcgttgactagtttaacagtagaaacgagcttttccccttttagtccgaattgcgccatcaagaaagtggaacaatacccgttgttattgccttattggtacccacgcagctcaatatgttcctttcactgcaagaagttttagtttggtttaataatttggtcacttaaacctttccattgttcatgtcgcaacgtagtctgttagtctgaaaatttttcactagcagccttgacaattacttatagtggctttagttagcttactgttgttccatctcctttctgatcaaatttactagg

SEQ ID NO: 42384 - DNA, 284 bp, Oryza sativa
aaatttagagacttgaaccaactaaatccgagctaagatgaattagttatgaatttttaaagattaaatcagattaaaacacttatatggattttaattgaattatgacgcaataatgaattatttttataaaggaaaaggggattattgcgtcagcggctagggttcgcggtgaaccgggtgcacggcggcggctcacggaaacgaacggccgagatcgattcatccaaaacggacggccaagatccatcggtccatgaccgggccacggggaacgatgacga

SEQ ID NO: 42385 - DNA, 1501 bp, Oryza sativa
aactcggtggaagtttgttgatgcgagaatacaagtccaattgatgcgagtagtagtagtaccaattgatgcttaactgtaccacatcacgggcaaacagcatccctgaaaactttagtccctatatttagcactaatttagagtattaaatatagactacttacaaaactaattatataaataaaaactaattcatgagacaaatcttttaagcctaattaatccataattagagaatgtttactataacatcacataggctaatcatgaattaattaggctcaatatattcgtctcgtgaattagtccaagattattgataggttttattaatagtcttaatatttataattagtgtccaaacatccgatgtgatagggacttaaatgttttattcccatctaaacagggtctgaagctatgtactactgctaaatggtaggcaaggctagcggcacaccattagttccccagtttttaacctataaattttccacgtatctgtccagaaatcgaaccatcgctttacgatgtcgctgtctaaatttcacagtatcttaatttcaattataatgtcaatataaggtcttgatgtcaccgatattgaattcatgtagtcttgcacaccaagcttattccagttaaccagttataactgataaccgcttgaaataaatttttgagtaacatacacctgcaagccatggttttgtaagtagccattatttaggtccataaacttaaaaggcacacatttaatcccgcctaacttactaaatgtattaatattagaccaaaatccgatatgacatgtcgcattgatgctgatatggcaccttcaccaattctacgtcaaaggataagtgggccacctataaaagatttttcttttctttttccttttcctttctctttttttctctcttcttcttgagtttgagctttccgctgtctagcttgccatgacccccgttgagcatcccatgatcaggatgctcgagctcttgtccccaaccatcactgtcgagttcgcctcgcccccaatctccacacttgagcattatggttgcttgtcgtgatggtgaactatgctagtgatcacccaaggataggagaggcgaaatgattaccgggtacaatgaactcgtatacatgtttaattttggaacatgagaagcaacactaatgaatttagtcattttgtgctggcgaagaattaggatttcgatctaatattgtttaatggcggtgactgaagcaatggaggctagggtgggtttcggttggtgaaagaggagatacgtaaggatagggtttttgttttggccgtggatgcataggagctcagtgatggtagaggagtggtggtgaccaagggtaggacgagctcgatggtggcggccgatagggacgcttaagcatcgcagctgtaacgtcccgcctctcccaagctgggcccgcttacatctggcagctttcatgcacactttgtcctcactc

SEQ ID NO: 42386 - DNA, 278 bp, Oryza sativa
ggaaaacactccataaacatggtaatttaccaatggacaccgcgtcgataaaataataatttccggttaaagaggagagagaaatcgcgtgaaagttctaaaatacccgtgggcccacttgtcatatcttccatctctcttcaacggaaagcgtcgtcgtccgtggagtggagcgccaggagcatcggcagtcttgtgtgtgcatgatcagctgttttaacatagctgatcatgaacacacaaactatacttgttaaatcacattcgtttgttgaaaa

SEQ ID NO: 42387 - DNA, 1501 bp, Oryza sativa
ggcgaggagagcgcgaggcggcgcggcgcctggtggatggtgaccgccgggggccgtgcaggcacgggggggtggttgggttgggtgggggtggggtgggggaggaggagctcagctcgcgcggcgcgtgcgacgactggcggagaacgagaaaatcagcggtcgtggtctcgcgtgatgatggcaaagcaaatcaacccttccgcccgcgtaccgggccggcctcgcgcgcgaagcagttgcgttagaccacgctcccccgcggcccgcgggcgtgcaagcgcgagggcagaggcgcggtccaacttgcgtgatggtgagacggcggtggggaggctcggggcccggtgattttgagcggacgataggaagaaaacgagccgggtaggtgagacggaactgtatgggcttaggccagcggctgagcggcctgctgagtaagtactttgggaaaaaaaaacaattttaaccctctttaaaaaaactagcatggtggcccgcgcagattgcgcgactagcatcattatattttctctcatataatagcatatatgttttctcattatattattcaaatatattaaaatgacaacataattttaaattttgtaataactttacaaaactactaatgtgtaatattcatattgtattttatatacgtgttaattattaattatttttaatatcaaattttaattatttgtaaattatatatattcctatatggactctagactcgtcttttaatatttctttttttttaattccgaattttctgtaaattgtatttctatatagactctatgctcttcttctaatattatttatttttattctgaatttttattatttctaattgtatttttatttggactctaaactcatctttcaatattctttaatttttaatttcgaatttcagttacttctaaattgtattcctatattgactttaaactcttcttcccatgtttttcttaatttcaaattttagttatttgtaaattgtatttttatatggactctaaaaactctaattttaattttattatatttattccaaattttagttagttttaaactcaatttctattatttcctaattgtatttctgtatggactctatactctacttctaatattccttattttttaattccgaatttctgttttttcctaattgtatttctatatggactctatactctacttctaatattccttatttttaattccgaatttcagttttttcctaattgtatttctatatggactccaaggttgtcaggatcgggatactaggtagtatcgttttgctcaaagtaatatcgtatcgtaggatcgggatactatgagattttcttttttaaaatttaattaatatttatattaattatatatagccattctatataaaaaaagtagtaatgatatatgtcatgtaaatagagacatttattaagagaaaccacgttggttttgatatatttaactgatt

SEQ ID NO: 42388 - DNA, 728 bp, Oryza sativa
aatattttttcattttgaaaattgacgaaagtagtcgcctaccgccctctggaagggcgatttttaaaaatcgccatcccagagggcggcaaaaattacgtgtcagacggccgttcgctctcggcgacggccgtcaacgaaatttgtagcgggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtccctcctctctgaaatttcattatattcactaaaaatccaaaaaaaacgaaagagagagaggggagggcagcagaaggggagcggcgaagccctgctggttcgctcacttcatcacaggtatgctcccatacatcttttacatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 42389 - DNA, 1501 bp, Oryza sativa
gcaacgtgggcaagtgccatagggagggatagcgccatggaaggttgtgggagggggaactcggtctcttcaatcaccaacaatggtggctcgtctagcggctccatgagagtgtcgaggttggctgtcgaggagtgtgccgttgactcacactctgccgccttcctcggttgatccgctttctcactctgctgagtttggaccaccgccgctccatccttcgttcggagcgagatataggaactggcattcttccgccattgcatcaccccaaacgcccaatgagagcagagagaggaagaaaggagatatatagtgttattgacaagtgggtcctacatctttttttattattttcttttaagactggttgccacatagatatcacatcaatcaaaaccaccctcaaacccatcgagggagtcattttacgctggtcttgattgattgaggagtcattatacccggttttgtggttgagatgtacaaatcatatttgaaaattttttcctagtactttccaccgtttggccctctttgaaaactttgttttatatactatagtagaagaacttttttctaaaaaaggtggaaccctttcaaacaggaacataatatttgtggtcatgtaggtatacataggatggtccatgaaaaagttttcatcggagtttatttgtgaggaaggaccaaaactccaaaagagattattcacgccaacgtggtatccagtccatcatatgagcttctctaatcggacagttatgtgtgtccatcgggtcatttggattcacacgtcgaaatgtgaaaaccattcacttgcaaaaccacaaacatgcgaactatatccaccaccacatgctagctcattggacattggtgttgcaaaagctgtagaagtactaatttcatcttgctttggtgccgaggctggaacgtcggtgacctgttgcccttctagctcggcacgagattattgatgcactgcaaaagcgaaaacaccatgctgccggcccggtatcaaaacaacgtcgaccgtttcatttgtggcacagtggcatagtgggttttgcgtcaatcccaaaacgccaccacactagatgcttgtttagttcttaactttttcttcaaacttttaacttttttatcatatcaaaacttttctacatacatgaacattaaatttttttcttgaaacttttaattttagtcaaacttctaattttaaggtgaaactaaacacagactaaaatactgggagacggaaggtatagacgtagcgacggtagcgtcgcctagccgcgtcggtgcgaggcctaggagtacagcattgtagcggctggctaacatcaacgtcgccgccgtcgcgttcatacggtggtggtgatggtagtgcacccgtgcggcccatgcaaaagccgcgccggcgaatcgccatcgaacgtggggacctctccgaaacgtgagggcaagagcggaagggaaggatacgatcaaccca

SEQ ID NO: 42390 - DNA, 964 bp, Oryza sativa
ttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggcttta

SEQ ID NO: 42391 - DNA, 1501 bp, Oryza sativa
atgcacggggtggatccagatgacgaggaattggggcgccaattggcagtgtctcgctggactggccggacaggcgctcagcttcaatgtcacctccaccggcggccagaccatcgtcttcgacgacgccgtgccggcggggtggtcgttcggccaaaccttcagcacctaccaccaattcgactactgattgagctatatatgttcagacatcaggaatatcagatcctcgtctgaaatctgaatgtctatctgatcgatccagcattggtaatctgtttcattgtaagatcgagcattatttgggagtaccattcatttgatcgttttaattgctagtcggtggatgtaaatcaagttgaatccactgctatctttaatcgatgtgaaactgtagtagtaccactgaagatcacattccatcagacttcgattacatcataaaacgtgtaccacatgctgatgacagccgacgagtcatattcctcgatggaagcagagtggcaattaaaggctacgactagagaggctcacgagaaaaatacatgtacaagtacgcaataatatcaacaccaaagccatcaaataattcgagactcgtacacaagaaaactgacaggaagacagcggttgagctgattctgaacgaagcctttcgtgtggaggtgattaccaaacgagacgagctacgcaggacagacagcgtcagccgctgtctggtgatgcatgacagcagagacagctctggggatcgcaacaagagcttttacttgtggacggacgcttgcaaaatccatcgacgatcgtgggacgtggctagctcggcgatcaatccaaaggagtaccaggagactactagctaggagtgtggaaccttatccaacaacacaacaagacaggagaagataaaggccccggattctcacgtaacagcgtgtgttttgcgcttgcgttttttttttttttgacttttttgcgcttgcattcgaatcacgttcctgtatcttcatgtttatgtcttctcatcagtcatccctgcatgcgttcgagagatcaccttttccttttctgggttccaaaagatccgttaaaatttggggcttatttggtttaataccctatcaatatatgttggtagtgccaaactctaggcaagttttggcactacaatattttagtagggtagaattgtaaatgagtgcatttgaatttataccaattgagagccaaattttaaattgtggtgaagaatattctaaaattatgccaaattgagtattggcattaccaaacatttggcttcaaaccaaatcatcacatttgctatttaaaccaccaaaaaattggtatggcaatattttggtatcaaaccaaaacgccccttaatataggcaaaatactgtagagatgcatttgatagtacagtgataaggagcgtattcaatcttcaacacgaaatattgcaccaatagtaacacgctagaagcatatctgaaaattc

SEQ ID NO: 42392 - DNA, 1501 bp, Oryza sativa
agatttttgcaaaactttgaaattgtaattgtattttttattcttttaaaaaataaatatatttttttcttaaaaaatcacaacactgttgttgtgagataaggcataaaacctggtagcacaagcatgctatctaaatcgtatggtatatggatatgctgggaaaatatgtggtggaaatcacatatgtacttatgtagggcctgttcggccgcttggtacagccgctgcgctgccacagccgaaagaaacaacacactgtgctagttggctgcagcacagtgaaaataatggcagtcgaacatagccgtagtggaaactcggaaactaccgatggattgaaaaatggacatccgagattcgtccatgtcatcacgagtaaaaatgttgctcacggatatattgcgagatttttactcgtaatgatgtggacgaatctcacaagtcaatttttccatccaatggttgtttccaaatttccactacatatgtggtttccaccacatattttcccggatatgctacctagtttttaataagatggcatcgttaatttttaacgcatgtttaactgtttatcttatttcttaaaaatatgtaattattatttattctgttgtgagttgttttattactaaaaatattaacaatgatgatttatctcttatgtatttgtataatttttttactggaggaattctatccttactcatttttttatataattgcctggcgaaattttcgtttataattagatcgcataaaacactactcactatgtcccaaattataaagcctatattttttacatggtctttaataacatattttaaccaatattttattctattatatgatcccaacaaatataaaattagcatcacatgaaagtacttcacaataaatctagtaatataacgtacataatacttaaatctagtgatataatatatataatacttagtatagatatagttagtatgattattagtcaaaatattccgaatttgattctcttaaaaaaaaagagcgtcctataattttggacggacggagtataacgctatcagtgactaagctactcaagatgacataatcagttatgtcacaggagaccaccaaacaaaagctatagaaattagaaaagggccaaaaggcaggttacattcttcagccacaaaacctaccacttaaaacataaagatgacccaatcagttgtgtcaccctgccattacgcatctcaacacaccattagtccagtcaatgattggagctaatgaacttggtttgccaagtgccctcgccgccacggacacagacgtttccaaaccatttgtccaaacaactgcgacccaataacacaatgtgttaactaatcaactcgtctcccatctcctgcaagtataaaaatactcacccagatcaaccacgaatcactcagcatatcacattcacaggccacataattggatcactcctccctctcccagctcatcgcca

SEQ ID NO: 42393 - DNA, 1501 bp, Oryza sativa
tttccccggcgcccagattttctagaacaaggagttgagacttgtgtttggcgcccgcaagcactgtgcatggtaggccgaggaggatgtgtagtgcctattacttatgaatttccaaacaatctggtccggttcttcgttgtttaagttcacattccgaaccgcttcccactagcggactaactggtcaacaaggttgattgtgaaatatgagtctgcatcgagggtcaggtcatgcacccaggtgtcgtcttcttttacttggcgtagggactttcctttgttcttggagatcgcatagacaagaggcatgaggacttttggtttgcacccatcaatccatgcagaacgcttgatgttatggtacgtcttttaagtgtgtcaaagggagcagcttttcgtgtgtgtgtacgtaggggtaaaaacggtcgaaatcggtagcatctcttcaggaacaacggtcgatcagccggtaattgatcatatttatcatttaaactactcagtgtcgatattaatacgatgcagaaagatattagaaaaaacaaaattttaaaatagcaataaacggtatggtcgaaaatggtaccctttatacaaaaacggcgtttggaatttccgtaaccattttcacccctatatgcatgtatgatgcgcacacgaactcaaactaggatcgaaataaaacatactacttcgtccgtcctaaaatataaggaattttaggtggctatgaaacatcctatcacaataaatctggaaggcttatgtctaaattcattgtaataggatgcgtcaccttcatcgaaaatttcttatattttgaaatggaggtattaatagttaggtgggtctcaacaggcctatctagaacaattccctatgtagtgagccaaggaggtaggatagttccctccgtaatggatcgaggatgtccgtctccttaacccacttcaaaacgaacatattgtggttttgtataatttgggccgaggaaaacccgaaaacatctccctcggtcccaccccaacaaaccaccggtttccttctggagaaatcccggaagaaagcacaggaacacgggaggatgtgcgtgcacccacaccacgttctcgtccaggtgctgagcggcttgacgaacctgaccttccgcgcccgaatcagctgctgacgtatcgcctccgccattaccacctcacactctctctccccatgaattcgctcgctttccctcgcggccgatgctccccgtcaccactgacgcgcccctccacctcccgtagttcttccgtcccatcgtcgcgcacaataaagattcgcccgagctcgcgaagcgtcgcccggtgcaacctccgcgacgccaagaatctctccccgtcccgcaccgtcgccatggctgccgcggccgccgcaccggcaaggtgagcacgcgtgccggctgcggcgaggctgaggagaagaataaaccgcttgttgcggttcttgattaaaatctgaattt

SEQ ID NO: 42394 - DNA, 1501 bp, Oryza sativa
tactaacttaccagtattaggcgattcaaaagcattcaagtagtataaaaccggcggagtaatttatttgtgttcagtttacagcggcaactgcaaatattactcatgctcttgttagtactaccttgtaatcctttgcttaatactccactactacatgaatacctttgtatacatgttaagatcactgagttggctgagcacgagtagtcaaccaaactcgagaaatgaacacaaatgccagtgtccatttcatgtggccttgaaaaactaatcactcttttgacagtcatcaccatacaagaagtctacgatgtactccctccatcccataatatagcaacctagtttcagacgagacacttcataatacaacgaatccggacatgtttactattcagattccttgtaccatgaagtgtcccatctgattctaaattattatattatgggacggagggagtagcaaaaattggttagatgtctataccacgcatgatgattttagttgccttgtattctcttaaaatacttgtatctccctgctctctcttttttggcacctctctgtgacaccctttaaatgctgaaactttgtatgttgaaactttgtatctctcttcttctataaacgaaatggcagagctcctgcccgttcctaaaaaaaattgaccgctctggcacatcctgtgtattcttctccagctcgtgaagaaccgtgtgcaagatgccgactaatcaccgctttgtaacgtgacacgttccaggagcgacatggcaccagccatcaccactcgctcctcttttgcttcggccgtcaccgctgacgcctcaagttttcttctcgttttacctttcaacgcccgtcttactcctgtactctcgtttaccagagcacggtgtgacagatgcagcggtttcacctacaaaaagtgctcatttttgcaagttgtgtacggcaatcgcaatggcaatggcagcagcagtagcagcaagtaggtgcgatgcagtttctactctctttttttttcaaagaaaagtttcttaggacaagttttataaaagaggtggatgttgcatctaatgttgaccacatcatcagctaataaatgtagaggtaacatgtacaatatatcacatatatactaattctaatacactagccccaatgtttgtttgcccaatctactcttcacctctctccttttgtcttgaattttgtgtagtggttgcctcttgcatgagaggtggctgctttatctctctcatctcttctctcctccacctcactattttagcttatgtggcatctaggagattatgcttggatgccatagtacttgccctaaggcagcgttcgagagggtgagagagtgagtttgtttgtttcgttttccgcacgcacgtttcccaaactactaaacggtgcgttttttgcaaaaaatttctatagggttgctttaaaaaaatcatattaatccatttttgaaatttaaaatag

SEQ ID NO: 42395 - DNA, 1501 bp, Oryza sativa
catgcacaattaccaaacgattaaacaatatgttttttacaagataaaagtatagaaaagttgttttaaaaaaccatatcaattcatttttcaagtttttcagttaaatagtatttaattaatcatgcgctaatccgtcactccgttttatgtgtcgggaggaaaggattcacaaccctcactaaagaacacaacctaattgtggctctatgattttcttttttgaaacaagcaagagatctgtcatttcattaagtagcaaagaaaatattctggtggaacaacgaagcctcacaaggtctttcaaggtccccagttcagcatctgaagatcaggtcgtgttaggccgtgtttagttccaaaataattcttcaaactttcaacttttccatcacatcaaaacttttctacacacacaaacttctaatttttccatcacatcatttcaatttcaaccaaacttctaattttgatgtgaactaaacacaaccttagtgtgggaaagttattacagagatgcgaagacaacttcttcctccttttctaaatatttgacgccgtttgatttttttaaacatgtttgatcattcgtcttattcaaaaaaaatatgtaattattattttttttctatcatttaattcattgttaaatatactttcatgtataaatatagttttacatatttcacaaatttctttgaataagatgaatgatcaagtatgtgctaaaaagtcaatggtgtaaacatagggagtactaataacatgaactaacttgctagcttttttttttatgctagctctctcagctcaactttgcgggcatcgcaggaattactttttggtatgattaatcacacacacaaacgagaagtccaattcgcaggcatgcagcgttgggttacttttcaatggcgcgtgtgctgttcctctctcgcttttgtttgcatagagaaagaaacggatcctatcattttcaacgatgttaaatcgtcacaggcttcagcgtcagatgtactacctctatcctaaaaaaaaaagttcaattctaagaatgaacctgtacacacgtcatctgggaagataagatgatccttttttcttggagcaaaagctttaccttttgaaaacacgatcgaccgcattaaaaatgtgaagcgtgagatgttcatcgatcgacataatcgatcagtgcaggtcattatctaaggaaggaaaatcaatcagaagagcaggtatggtgcatgcatcacgaaaagcatttcttgttctgcctctctgtctggcgactggcgtcgtcgcttgtaaaatagtgttggctaagtcaaatgtattatgttcctgctctccgggatttgtcctggcaagtgccacaacagcgcaatcagcaaaagaaacctcatcatcagtgtgctgctcggattctacctgggagtaaacccaagtcaccttctctgtcacaggagaggtattaactgaccggagagagagagagagacga

SEQ ID NO: 42396 - DNA, 804 bp, Oryza sativa
atatatatatatatatatatatatatatatatatatatatatatatatatatatatatatatatatatatatttacagcatgtggatgtcattttatcttttaggaattatttgggctacctcattggatgagcatatctaggacacacaaaataaagcatatcatcggcgtaagattaattaagtattatatatattacataacccgtgcttatataagaaaaatatataaaaaggtagaatctagctatttatttatacaaaacccgtggatatattatttcaacaattatatatatctattcaagtaatccctcactacgtacgtacaccagagttatcataaaggaaaaaaaagaagagtgtgtatacgatcagctgcatcaagtagttttctttctttctttctttgcagctatgagattttcctcgaattgtgcatatgagtagcgaccactcctgacgagattgtcgaagaatccacgtcgccacagcaccacttcacgccatctcactaattttctaaaaagtatttgtccatgtttgatgtcacaattctggtatttgcatggtatggggatcgttggtgctagggtatacgcgagactgaggtaaaagaggcggagacagggatttttatacaggttcgggcccctgaattgtcaggtaataaccctacatcgttttggccgaagccagtattgctcttattcatgataatcacaccagtacaatatttggggtagcctatctaactgttgtcgacatggcggtctgacgatctgactcgtagtcgacaacagg

SEQ ID NO: 42397 - DNA, 1501 bp, Oryza sativa
atgctattaagttgaataatccagaatttggattcacgtatgaacttaaggctaccaaattaaccgaagaagaggatacctgtggagattatgggtaccccatacccacacggcatggttatctgaatggttatagggataacttatatctatataaaatatgtaacggatcatgacttgggtattacgtttcctagtataatatggaacggcctaaagtcctggtttgttaatattgtaaagtagatttaggaagccggtaccgtattggttaaggtttctatcttgtaatcctgccccccatcctatataaggtgggcaggaggccctctagggggcatgagcacatatgatcgtcagatctatactatacccggcggattcaaatctctaaacaggagtagggtattacctcttattgagagggcctgaacctgtctaaatcctttgcctccgcatccatccacttttaggtctcgtacgctacccccttttattattgccgaattcatgtttcgacagttggcgcgctaggtaggggttgcgtcgaattacccgtcgaaaagtgcgatggaatcaactccatgagtcaccggcttcgtcttcacttcgggattgtcgcttcctcgtcgccgacaacatcaacaagctctcgttctctgacttggattcaaaccagtcaggagagattcaatctaactaagaaggagatgccacttttaggagttatctccccgacgaggcctcatcagttccgcccgaccggagaacgccgccactgccgacacgcaaggagggagatcgtgtgctgcatgtgcctgcagcggtgtcagcggtggcctcgcatcgcgctcgcgatagtgctcgtggtgacctcgcgctggtgtcgcgaggcagcaagaccgatctctccctgatggcatcctcggatactccaatctatcatcattagattgatttctaatcagattaatttgctctgttctgctctctgtttttgcatgtactggtgacgagacgggcggcatccaactgaggtcatctctgccacgtattaatccatgcatgtgttgctggattaatgccgaccaaatctccagtcaatcatgctattagcaaacgaaccaacatgcatgcatactgcatatatgcaccgacacgtgcattatatctacagagcattaatctctaattactaattagatttatttataatcacaacttaactgaagcttgtgttcgctattttgttcgcatgtttggagattccacacgcctgggggctgcgggccagcgccgcctttgcgtgcctaacgcggcctgactgctcctagggcacgcacgacctggatgcgacgccgcatgtcgggggcttcggtcttcgcccggccaacacagcccgactacgcctcttccgccgcgggctagggggttttgcctttgtgcgccgccgcctcatccaccgccgactggtgtcctcgcctacacggttggttggtca

SEQ ID NO: 42398 - DNA, 1501 bp, Oryza sativa
tggcatattaaatcagtctacttgataaaatttgattaaacgtcccatattgcacttgtaagtaaccatgtatcatgtctcaaaaaatagaaaacaatccaacataactcgatggatttcattattttcatcaattagatttatttttgaaagaacaataagtaacacatgtcatctattttttaaaaaaaaaacataagacaacatgtgtcatgtcttacaagttataaaaacaataaaagaaatgctgagaaaaaaaaaacatctctcatcggttttcactaaaatccctccacctcatcctccatctcacatgtagaaaacactgcgctcccattccttatttttttagctactaaactagaagagaaacaatgaatgttgaaacaactacagattttttataagctatacatgtctgatttctgtctaattattctctatttataattaaactaacaatgtaatatttatatatgcatatattttgctgtataagaattatagcatttgggcacagtccacccgtgcactttgcaccacatctaaataccttacaattttgacaataaatattatgtcattatgaaaaattctacaaacatgcataactaaattaaataaatagtaccggaacaaaattttcaaatttaatttgccaaaagaaaaagaaataactcaacaacacagagtatagtgatatgttttgaaacatatatagctaaattaaacatacacttcataaacaaaaataactaactgaaatatgaatagtccgagccactgcataaaacatcgagttcctttaattagagaaaatagtccaattacttaatgtttttttctaaatgtgctcaaataatcaaaaaaaataaagtgatcttttataagttccgattaacatttcatcgttataggttctcaaacatagtctacgatgcatgtccgtacgaatgcgcgggctacctttctagttgtagaaaaaataaaaccgacacgagaagaccgaacaaaatcggtttggtttgtttgggatttcatttttttaccgaagcagctgattggtagggttaacgagaggtgggggtttgatctggccacgtgagagcagggttcaccctaccgccggttaccgcgcggttaccgcggtaaccggccgtaccgcggggggtcggtaacccttaccgacggtagggtttgagcaaattttgctcaaattcaaaattttcaaaaataaccaaaaaaaatcaaaaaaaaatcatggatgtatagcttgatttgtatgttgttatggtgtaaaaatttcttgaaaaatagtaagagaaattcaaatttgagcgcaaaaactaatgtcgattagaaaatagaaaaaataattaatgtaatgggccaaatatgcactgttcaggaggcccaataaggcccaacagtggggggaaaatatctaccgcatctcttcctggtttctgtcgcgttcttctatttctttcctctctctctc

SEQ ID NO: 42399 - DNA, 1501 bp, Oryza sativa
gcgacgaactgttgccacaggtctgcccacgaagagattgagtagggaggaagatgcatcagccatgaacgtgcagaacctttcaacgcagttggtaaatgtcacgaccggaaataacccaacgggcgttccttacgtgcgtgcattaatccttgtcctaggaggcaaggtacaccaaaagttgatacaattcagagtttaacaagcggaagcgtaaatagttaatctattacatgggcagcgaaggcccagcacacacaaagacaaacgagaaacagcggaagactagggcgacgaccacaggcacttgacggcaggcacgagctagacaccgaagccttcatcctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaagacgattctagtactatgcaatattatttatcaaggccgtgaacccaaacgaacctgccttaacccaaggcctacgatgattcagaccgaactggcaacccgaccctgggtcccagctcgtcccaagccaacccaggctaaccattccacattttagttgttaagcaggttttaagaattaaaacactaacttgggtacattgctcggcttgcccataaccgagggcgcggctattcgaatagattatactctgagcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcttccatctccatccgtgtacttttgtttataactagactgagccacaaactaagccttacccactagacatgtggaagtacggtagtgcttttcaacagaggcccgaagaccggtccttatatggccgaggtgctactatcaaaaccatgcaccccgagcccagccaattccacaataaccaaaccattccatagtgtccaggtgatatgaatattcccaaagtctagagttgtaaaaccgcctaatgttacctaattaaaagcgaagcatctacctaaaattatactagtggtaccatgagtagagggtccactagttggggttttgtttattctagggtgaacaaggtaataataataataacaataataataaggtcataacaaaggtaaataggcatggctaaataaaacagtgataacgcggg

SEQ ID NO: 42400 - DNA, 882 bp, Oryza sativa
ggggatcggaggaaaagggaaggctggaagggggaggaaggggagaggaagaaggaagaaggggaggaggcggataccgagactaagtctcagttgtttttaaggagagaaaaaaggggaggggataccgaggagatatcggcagtttattttggtcccggtagatataaacaaccgggactaaaaatagatctttagtcccggttgtttataccaaccgggactaaagataattggagcttaactgtacccaccaacttctttgaaccgggactaaaaataatctttagtcccggttggtaaatttttttaaccaggactaaatatcatctttagtcccggtttttattgcaaccgggactattgtggaatttggtcgaccgacgtttctccagtgtgcatatatcttaatcattgttaccccgaacagaacatcaaacctccttctgatctttagtcccgatttttattgcaaccgggactattgtgaaatttggtcgaccgaccaaagatggtttctccagtgtgcatatatcttaatcattgttaccccgaacagaacgtcaaacctccttcaaattgaataaacaaatcgcacaactaaagaaacgtgcgtacgtatccatttttttaactttccaggctgaaggtataaagcaaaatattacgtgaatttgccctttgcgtgctcgcagtagtgacgccccactgaccactgtacagcttatacctctatatatatacatacacacatgcacacacactacacacacaaagctcttggagctgcatctgcatgcaaacacctactatacaatattacacacagtgacacacactatcggagaacgtaggtaagtaagggcttacggccagcaacga

SEQ ID NO: 42401 - DNA, 1501 bp, Oryza sativa
acgctgccatatcctccaccgttcatgtcgtgactacaatggcgtcagacctatatgcgagccgcatatggcaggaaggggcaaaatcatactttcatgattgtttctctccctttcctttcgatgtaaaaaaataatgccacgggtatccaaccgctaattaccattttttttctgtgtcccatagcatatatatgttcttccagtgtctctcaactaactacacttcttttatgtcctgtagcaaattttatctttattaagtagaggcttcaatatggatgtgggttcataaagtaattttttttataaaaattagcacttaaatatagtcaatatcggtattaagttattgtttccacttaaaaaaaaatagccggctagacctaatagatggagattcatttgtggtcttttctttgcccataaaaataattttaattttaattttcatagagacagaaaaaacagagaaaagtaacgctgcacaccgcatggggacggggatggagggaggtttggtatgtttcttttttttagaaaaaaaatgattgatctgacggcataaaataatgtgttgaagtttaagccaaaatcgatggttggatattattttttttctcagatttattataatcttttctaatttaagtgagacaagtagcagcttggcaaaatgcccatagggatggagaggaagagaggaagggaagatgatttgaggtgtttttttagtaaaaaaaagatccaataacgatgtaaattaatgtgtccagatttaagtggaaaccaatggatcgatgtttctctaatgtcatacaacgatttagaaatatttatagaatgtttaatggactttaacacctatttatgagattgttttgcataatcataattttaatttaaattgtgatagggataaaaaaaagagaaaggaacaaggagcctggtcgcacggatatgggaacgtgggaggtgtgggaggttttggttttctaccatagatctaacgatatagaataatgggtccactgatttaaatgaatatcgatatttattgagtgacttgagattatttatagggtgccatgtgacggtttgggagtgtttgtagaaagtttaatggattttatttattatataatagatagatagatagatagatatagatggtactatgtaagtatggttttttcgctttatcttatacggtagaaaattatattctatatttttcttccgatgatactttgtttgtattctttttttttttgctttatctctattttaatacggcctggcattttttttcttccacgaacggaacatgagcgctttttttcctgaatcatacgtactggagatacttgatttatttttgccaaccgtaggtactttcactttttatacagggaagatattatatatacactaatgattaatctaaactaatgggtacaccaatttaatgaaaataaacaatacatatatatctaatcta

SEQ ID NO: 42402 - DNA, 559 bp, Oryza sativa
ttgtgattgggtagtcaagcttccgttgttctctaataagtctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacaattaagccctatgcaaccaataatcaggttgagtacgaagcggttctcaaagggttgcaattacttaaggaagttgaagccgatgctatcaagattatgggcgattccttgtagg

SEQ ID NO: 42403 - DNA, 795 bp, Oryza sativa
ccttcatgtacctcgcctattgcaaccttggcttgatcggcactcaaacatttaagcaacactccatcaatcgtccgataatgcaactcatcatccaacaaggtgtacttcaaagccttacagcgcaatttctgagaagccgattgagatggattctgcaaataatgatacacatcatacctccaatcatcggctgttatcgtggcaacttctattttgacatccttcatcatcgggttgtaacccaatgccccttgagccaagtcattagctttgatattttgttcttgaaatacatgcttcaaagtcaccagctgaaatcctttcattaactctcggcacttctcattgtagacgatcaatgtatcattcttgcactcatattcccctgccaattggctaatcacctacaaggaatcgcccataatcttgatagcatcggcttcaacttccttaagtaattgcaaccctttgagaaccgcttcgtactcaacctgattattggttgcatagggcttaattgtcgtaggctctccggaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatcta

SEQ ID NO: 42404 - DNA, 661 bp, Oryza sativa
tttttttacggcagggacatgtaaataacttatttggttgtttggtttttcctcctgctctatcaatatatacgaggcaaaactttagccttcttttttttaaaaaataaattgctactgatagaatggttagaagtgatctatcttcgggcttgttctctttcatgttaattttaaattttgacatttaaaatttggcaaggtaacacatactaccactagttcactagatcaataccaagtcaacacaatcttatcaagttgtggcattttcagtagtttctactgttgaaaccttaccagaatgtctcaaacctaacaccacacatgtccgtcttactttcctaaaatttgataatgacataatttgatatcaccaaagtttcgtaagggacattattactaataaaacgtatcattcacagataataccaattgcagaccatacaatggcctgcccacaactttgttatactcttgagcacaactatagagatgaataagattttttcccccaagtaaataggaaggatctctgtgccagaagcacataacagcaattttgccgaagaaggcagatgtttcatagcggcagatcgatgtccacgttcgaccaaatcagcataaagtatacataacatgaatacgattttcaaaagaa

SEQ ID NO: 42405 - DNA, 639 bp, Oryza sativa
ttaacgcaggacttcaaaaatgaattgagagctgtttcattactaagttttacttgccaagttcctttggttaaaacttaatgtatatcacttacaggtacactcttaactgattagccactaggaaaaactgaatgtctctgaacgtaatgctagaacatattacgaggagaatcttatctagtgatagcaaacaagttgtcaataggtgtattcaataatgatcttaaggttttcctatagattggaattgtgatagcttgacaacactgttatttatcattctacttacccgcatattcacttaagttaaaaatatctaaatagtaaccaccaactcatctagaaatcactcatctatcctccttgattagaaatcactgtaataaacttctacagtagtagccttttcttttgtcaatcttctgaaacaatatgacttgaaggaaaatttcgtttagcctgtgacaccccaattgactccccaagacgttagaaacatcatgtacttttggtttcctatcatggcttcttgcttgaaatgagaatgacatgaatatgttttttttttaattctaattcacattttctccatacatctgagttctcgctgtgtttcttgcatacttactttacagg

SEQ ID NO: 42406 - DNA, 795 bp, Oryza sativa
cagtgaataaaatggtgaattaacagtgcgattttcgcaaaaaactttatatatgtgaatttctctatattgttcgcaaaatcattcagctatttcagacgtgctatagtacattgaaggcgagtgtagtgtatatatcacagcctgaatcgtataaggcttcttcatgcaggaagattcacaacagagatctttttcttctctctgtctagacaatgcttggtggaactgaatgaaatctcacaaaaaagatgcacagcacggcccgaccaaaacagcaaaggagcgtagaaggttcgcgaaaaggtgattcacaaaagaaagcctatcacgcgtggaaacatccaaatagaagcaaccggacagagctccatttccaactaatgagttgggatttgggaagcatgcagagcaatccagactcgtccatccatgttactattctctaccacggtacactcgcgagatgcgtgcgctcagcccattctgcttgtattttcagtacactgttttttcgtcagaagcacaagaagcgtctcaagtttatccttttcacagccatctctatcggtataagtacctgggaaaggtggcatcatcgatcatcagatacccttcgtttggaaagcctataaaccggtaaaccctcctgtgaaagaaaggcattgtgagagcccaaatcctggctagtttcattggtccaagtgctgagctactgataccaacaaccgccatcggagagaatgggcgtggacgacatcatcgccgagctgcgcgtgctgccggccaagatcc

SEQ ID NO: 42407 - DNA, 703 bp, Oryza sativa
ttggagcaagcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 42408 - DNA, 709 bp, Oryza sativa
caccatccggggctaaagatcccggtgatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctacccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatatgcacctatgttttgcacactttttttgtctccaaaatttagttgtaagttgatgagagagaaaatgtgtgtggggaagaaagaatatatagaaatttagttcatgtgctaaacaaggtttatataatagttgagaaggaaaactctagtgaaagttaatattaaataatagaaaccaacctaaaataaaaattaaagaagttaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 42409 - DNA, 323 bp, Oryza sativa
ttcctgcagccccggcgccctcgcccagccgcatgcagcacgagagcgaggcgagctcccccgacgccaccaccccatgccagtgtgccaccgcccgacctcgccggctagggcaggaggcgtgaacggcaccagcgagcccccctctcccttggccctccgactggcttcgccccccctcccccctctctgtccactcctcctgaagtcggtgacaacaaggtgatcttccttgtttctatcgactccctaccactggatccaccaccattagccactagcccactacctcttaactagtcgctttgttttggccccgcagc

SEQ ID NO: 42410 - DNA, 1501 bp, Oryza sativa
atatattttaggaaacacacggaagtgcttatatttggagcaaatgtggtataaattgattatgcaaaaaaatgataaacattgtgctatattactcaaataattatgattgcaatggcgggtgcagatgtgaatcggatacccataatgaacaaaatggttagttatgtactcaacgaagcaaggtataacataccaaccggtatttccgagtatgtgcagaatttgtgctcacagcgtatgccgtttaattactagttgcactagaactcatcagaacaagaaattcataaagaatgttgtattttactatattgatcatacggttcttgttggttgacctcgagcactgaacaagatgatgcaaattatttgactatttcaatgtctcgccagtagttggaacttttttttagataatgagtagttggaacttggaagaggaaaaagaagctgcggttgtaaaagggttcaagggagttgagcctgtagttaattagacagcactgaaagaacaattaattaagaaatgaaatattcctactttctttccattccatctacttgcttatccaattaagaacttaaaatatccggtactaataaaaaaatcaagaaaagaatttaggtagccagtaaatgagcggatgcatctttttggcgtgaaatatttctgattgaggatttcatttccgatctgtagaaaatggaaatactatctccttttttaaatgtatcatgtcattgacttttttataatatttgactattcgtcttattcaaaaaaatttaatataaatatgtaaaattttaagttaagattaaatttatttgatgataaaataagttaccacaaaataactaattttagtataatattttaataagacgtacgatcaaacgttatatgaaaagtaacggcgctatgtattataaaataagggtgtattatagtttgttacctcagccagcggaaacagtgtgaacatgacatgtaattagaaagactctatggctaacattcaattcagctatagcttgcgtgatggctagcagaaacgacattcgcgtgcgtaaatgatcaagagcatttctgctgttcggaacatttctgttattccccgcggacaagtcacaactacttctgttcagttttaactactcgattggaaacttcagtttcaaggtacgacttacagtttctgacgacagtagagcttagaccagcaaaccaatcatgcatcattacgcgttagtcaatctctcggcgtttgcagagccatgtgcatgcgatcgttggaacagtgttcgcatgcttcaataatgcataacgacaatcattccctagcttaattaattggtatgcaatccatgcctctctgcagagttcagacctcctagatcttattactactatttaagcaccaccaatgccgcacacatccctcacctccaaatccattcttcccaacaatatctagctgcacctgcgcaggagacc

SEQ ID NO: 42411 - DNA, 1446 bp, Oryza sativa
ttttattctatgcatgttaagcaggtgtttgcctaatattcagtctcagctttaaaaagaatttgcaggggaaaactggctcccatgacttttcactaagaagaaacctcagccaaagccagccgagaaaggccacgaaccctggccccttgacacgtggatccacaccccatggttcaggccttaacaaatgctttgaggcccctgccccatacacgagggcccacccaccataggtcgtttcttaacaagtgtttaaaccaaggggccagcgtgtgatgtttcttaaaccaactctgaaaattcgctcccgagtagagtcgaacccagacactggttggtgctagtagagtgctgcaaccactaggctatagacccgttcgttatccattcttagtttcacatttgcacatatgtatttcattgtggttcagacttagaagaccttttacctttattgtttgtataaagttggtagtatgtctgtatgtgagaaaatcatatttttaattcccatggtataggaggaggttattaaagtggtccaacattggtcatgaagtggctgggattagtttttagcataagtgggtgataactgagaaggcccaatagcagaatgggagattccttggatgtcgtcagttttcataaacaagcactcgtctttcgtcaaagggtggtagcgttaatgcctagtgttgatttcatatgtatcagcatgacatgctaaaatttgataaattttgttcctatatgttcagagtgactatctgaggaggctttctctcagaatgctcaagttggagactgagcctattcaactagggcatcagcaggcagttgatcaatcttccgagtccaaagttggtcagtacccaacctcaatgcttcaacaacagaccagttgtgatcagcagagtctatgcattcaggtagataccaagctccaggagatgccaccgaacggtaagttacatttgaatttctagtttatagggaccatttgatccataagaaatagaagtaatatctaacctaaagaaactaacgatcccaagataagcacattgatgtgttggaaggaaactcaccaaacatgaatagtacttgtggtagataataccgtgctgcgtgcacataacacaaggttgttgttctgtttatattgtctgattgcataaagaaacataaatctggctaaggttaataattgatcatttggagtcctttatatttattgttattgaagccacaaccatctaataactggctggtatggttgtagtattatcgctggaatgtatatttacatagggaatcacatatacccagataacaggttaagacctaatattggcataacatctaattgctttagtcttttatcctgaaaattgaacacttgttcttactgaaaacagaactttgatggatgtctttatt

SEQ ID NO: 42412 - DNA, 824 bp, Oryza sativa
cccataaactcagggtgttcaatcgtattataagttttaagttacgaaattggtaagagagaaaaatccctagaaatcaagaaccgagttcacctaggacacccgctgtcaaccatcagaaattcacctaatcaagaaatcaagaaacctaatgtttccccgcaaaaaaaaaaagaaacctaatgttcggctcccctcgcggccgagccggagcagcgcgagcgccgcctcgagcgcggcggcgagcggcgccagcgcctgctccttcttcttcttcccctccccctccgctcccggagctccttcacgaagaaccctagcctagcgccgatgcaaaccctagcgccggagagagaaaggaagaaaacgatgtgttaacggcgagaaggcagcggagagcgcggacgtaggatgggaagaggtcgccgtcgccgtcgacgtcgatgcgccaccgcgccgtctcttcgcgtccatttagatgaggcccaagatttctctgcaattgaatcccacaaccctggtgtcggattgcctcttcggccgtgcggaggttcgtccccgcggatgatacgtacggaacagggatttgttaaagatagaattggttttggttgttttggttgttatcgcatgtgacctgataaggttgttgcgatgtagtttatttgttctgatctaatcctatccttgtaatctttggattctgttgtaacaagccacggcaggggctgttcctgtcctatataacacgcagggcgacccgaggcaaagggcatcgctttaatccacttttacatggtatcagagccattctccctccaccc

SEQ ID NO: 42413 - DNA, 956 bp, Oryza sativa
tcatcggtctgtatgcatcataaaatgtgtatgtgctagtggtttcttcggccccgtttggcacagctctagctcccaactccaacttacctagagttagagctgtgccaaacggtacagatcctccattttttgagtggagctagttgagctactcatagaaaatgaactacgggggttaggggtggacagaaaaagaccgaaccgaaaagaccgaaaccgaaaaattcggtcctaggtagtgaaagaccgaattttgttcggtcaatttggttagtctcctcggttaaccgaatagaccgaaatatcaaaaaattctaaatgcaacctacaatccactatatttaataggattaaactctaattttcacatccctacttcttctaggcatgcaacctaataaaagtctttactcataagtgcttaacgaatttttttgtgatttttgtgttgaaaatttccattttttctttgcatatatgaaaatattgttgaatttcggtcaggagcgagaccgagaccgaatttatcggtcctgactttttgcgctgaaattcggttttcatttttcaaagaccgaaaagaacgaaagaccgaagaccaagaccgaaattttcggttagaccgaatgcccacccctaacggggatggagctggatttttgctgctccacagctccactctaccccaaaagacccactaccctttaattttttagtctatttatacaaaaatgccactcaactgctctttcagtcctcctctcctcccccatcttcctcccgatccaaaccgagctgcatgcggggagcggtggcgtcggtgggtagcggcgacaggccgaaggcgcgcggaagacgacatgcggccggcggcggccggcgcgcctggggacggcgcacggccggcgggccggcggcggatgcggaggaggatgacagagcggcggtcttct

SEQ ID NO: 42414 - DNA, 651 bp, Oryza sativa
caatggcgtcatctattaaaaaacggaggtagtacttattattgaagcatgataatatgaaaataaactgatagagggcatctctccatgtgagtcagcctagtttcagaaatgcattagcagagcaactttttgtgattaaagcaattctttgatgcaagctatgataattgataactaatacagttacaaatgagtagcagcatcatgaaactgaagataatttacccccctgataaaaaaccagtgcatttgtctcactgtacatcatcaccaaactgaagttaattacccccgaataaaaataggcagtgaatttgtctcattctattcttcagacaaagtatggctgtttgcatatgtgtacaaaattttcaacaacaaagctgtaaatctaccagcggcagctggccatccaacctttgacagtgaagttactgccttttactgatgctgaggctttagctgagatgagatctcaagagatatggagtatatatacatacagctcctatcattgcagacaaacacagagcagagacaaccagagtgacagagcagggtgaggtgaggtgaggtccccttcatcttcaagacaaggagctcagctcagcttagagctcagatcgatcgatctgccattagagatga

SEQ ID NO: 42415 - DNA, 1501 bp, Oryza sativa
caggcttcaaggagaggctgttgtttttgcaattgattttatttgaactccttttttctaaaaacgactaagtgagtgcttctcaaacgacacggatgagacagtgcgtctcgtccggtcggagtatgtgcaatgtatcaatctttagatcttgaaacaaggttggctcccggccaacagcttttcaaacggccacccgggccaacaacttttcaaacggccacccgggccaacaacatttcaaacggccacccgggcctagctgatcccgtcagctgctgatttttcaaacatcgaacccattttctcaacagcaatttcacaagcggtagtcaaacaaaactacgctaggaatcacctcacatccgcccatgaccgtgggcatggctgttcgaatagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaacggtccttaagtgcaagagcgggaaaccgtacacctggtacgttccccggtccgcggttttggaaattcatttagttcacaagcaccgacccaggtgtcgggttttccaagtcttttgtaaaactcccgttttacccaaattgttactcagattttaagtttgaaggcgaccgtcgatactcgcacagagtgcacgaatatcgaggcgcaactgggtggttacaaggggacatggtatggcaattaacaatcgaaggatcaaatgcaacaagtcaggtaggtccaccaatctgccttgcagatgggacaaaagattaagtgcggtcctatcaatacataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacggcgaaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttaattaaatcctttttggaaaagaaaaagaaaagaagggagaggggggaatatagacttttctcgggcggctagggtgcggcccaagagatt

SEQ ID NO: 42416 - DNA, 1501 bp, Oryza sativa
ttttcatcttaatttatttttcagtttttatttttagattgctaaagacacatatgtaaaagttttattcaggaattatttttcatctgcaaacaagccaaacgatgaccccgtgggccatgtgggacgcaacagcctcgtgggccggcatgtgatgagatgtggcttgcccaccacaaaagtacagtactagtatgctgctggtgctgtgccacgcttcttgtcacctccacggccgtgccttaccctacacgaggttgaatttcgcccttttcttttcatttccgtttaccaaccaggtattcctaccaattatctaactaaaaagaagacattcctacatttttctggtcacaaatatataccgtatattctattttgccattataggacgggtctttaaccacggaattttaattacaattaacttgtaaaatctaacaagtctatgagattatgaaagtatttttttaactattatcaagaaaaggaaaggaaagtaattttcacgataaatctacccctcatcatctttaacaaatatttcaaatatgtggtcaaagttttaaaagtaaacgacatatgtttcatttgagatagtactccctccgttttatattattagtcattttgtctttttctagtcaaactattttagatttgattgggtttgtagaaaaaagttataatatctaccacaccaaattagtttttttaatgtaatattgaatatatattttgattatatatacgttatgttactattttttctataaacttggaaatctaaataagtttgtttaggaaaataatcaaaatgacttataatatgaaacggagagagtaattgtttttggaaactaaaattactacaacacctctccggtacatgctttgtgtagtgtaggtaaatcaaatacacataggccttgtttatattccaaaaaaattggcaaaaaaatatcacatcaaatatttggacacatgcataggacactaaatgtgaaaaaaaaataattgcacagtttgcatgtaaattgcgagacggaccttttgagcctaattacgacatgatttgataatatgatgttacaataaatatttgctaatgacgaattaattaggcttaataaattcgtctcgcagtttacaggtaaaatttataatttgttttgttatcaatctacgtttaatacttcaaatgtgtattcgtatacttaaaaactttacacccaaactactaaacacacgcgtagtattattttttgcagtcctaccgacgattccagcccaccacactatgcaaagcacgtgcaccccccatttggtatctgtccatttgtgcaacggcacaaaatgctttacagtagtttatcttctccagccacaagccaagccaagccaacaccccatcctgaaagatcaccactttttactgaagaatcttgaggtttccactacaaaattctcattgctgttctttttttcccctctctctttt

SEQ ID NO: 42417 - DNA, 1501 bp, Oryza sativa
aatcatggattgtgaaataaagttaaatttgagtttttttgttgataagtataggtatgaatcaaattattataactaggtatatactcacaatttgaaaattttgaaaaatttgagtaattttgtgcattagataccatggtgccccatatgaagtgcccatatatatatatatatatatatatatatatatatatatatatatatatatatatatatatatatatatatatatatagacacacacatatatatatatagtatactatatagtacttacacttaaattatacactacttttatatatatttatatatatatatatatatatatgtaatttaaaaacttacatatgtaattttaaaacttatattgtaaatacactaaagttacatatgtaatttaagacaatacgacgtaaaatagccttcacccattgtaacgtacgggtatattttagattaaaaaaaaagagattatagtgaccatatgaactctgggaccgtcaatcggataggctactcaagtactgaacgactcaagctccgactgggtcggattcggctgcccagtgcccacgcagcagagagctttcccgacggcgctaacgcagtgttacattaatgggctaaattttattgactcgcatgaagtgctatgagtaataataccaccttaaaagtaaagaggtctcaacttaaatatgaagctagtggatagactttgttgaccggttgagaaaatacggtaactgattctgtatcggtaatattaacgagcacgtcgcttactgaattaagcacacggttgatggtcccgaatgttactcttgcgcatcgcttactgaattaagcacgcgcggttgatggtcccaaacggtaataaacacagtaattgattctgttttaatgagcatattggttattgggaattctctctgcggttgatggtcccgaacagtaataaacatggtaattgattctgttttaatgatgggaattctctctcgttttgtaacggacgataatattaacgagcacgcggttgatggtcctgaacggtaataaacacagtaatcgagcgcatcggctaccgaattaagcacgcggttaatggtcccgaacgttactcttgcagttgatggttccgaacgttactcttgtgcacgcatatactccgccaaagggaatgatctctctcgttttataacggacgataatattcacgagcgcgttggttattgaattaagcacgcggttgatggtctcgaacggtaataaacacggtaattgattctgtattggtcatattaacgagcgcatcggttactgaattaaacactcggttgatggtcccgaacgttagtcttgcgcacgcatatacatactccgccaaagggaatgatttcaatagtgcatggttcttttgttcttcctctattcctcttgccggtttctctctcttttcctgcccagcatgatccttccccagtcctgttca

SEQ ID NO: 42418 - DNA, 1501 bp, Oryza sativa
cattttacaggacctttgcatgcaaaactagaagataaccctctaaggccatgtacaatgggatgcttaagtagacgcttagagaaaaaaaccgggtttttttttaccaggccggcgctacgcgagtcgcccgtcgccacgcgaagcggtcgtcgcttgggagcacttgcgcgaaaaaaggaggagcgtagcaagccctggcgctcagtaccaactaactaatcttgttttaggcatatggatcacacatggaagtattttagtacatcacctttgtcataaagatgacaataaaattaaaaattggttgacaatgagatagtaaaataaaaaaaattggtagactcattcactaccattgtagcacctagatgcttagatagactcttaaataactaagcatctgtggaatggattctcttcattggagattaaggctcttcaacagatgcttacatacttttttttctaagcatgtatctaagcatctggaccattgtacatgccctaagaggatggcaaaatgaccagctctcgccattagcacacgtcgatgattgtttgctacatcatagaaaacgccataagaaaatatgttttttttaaaaaaaacgtcctccaagaaacgtgagggatatagatttgtaaaggttttaaaaatatatattttgcaaatatcttaatgtaaaaatataaaaataaaaagaaatcgaaaaagagaagaagtaaaaggccaaaagagtgtgtttgatccctgcataccgtccagcctggttcgtatcgttcgattgagcctgctcagaatgtgcaatctcaatgggaataagtttatctgaggtcccttaacatctcgacgaatccgattttcgtctttcaaccaaaaaaaccaaatataacgggtccctcaactattaaaaccagtgcaaaataaatccaaaggcggtttcagctaacatggcgcctacgtggctaatttgatatggtcttcatctaacgtggcattgacgtggcacatgaatcaaaatttaacaacttaaaaaataaaacaaaatatgtggacccactgttgatgaaaaaacacactagcctgggagatctgcttagctctagtgcaggtctaaatcttgatgagatgcgggcgtgccagtcagtttgatcctgcaattgacaagatatgcaaatagtagatcaatgagccgatcggcggacaagccaatggagtagttctagccgatgccgataccagccgataacgatagggttttgagccatcggctatatgtccaatgtagataatgatataaaggcaatcggctgatgatagtatagtataacaatataatcgagtagaaaccaatcggctagcagtatgatataatagaattagcactgatccgaaggttaaagcatacatcaactggagatccgatatcataaaatccacaatattagataacaataaagtctttgttgtcatcggctaaatattatatatatatat

SEQ ID NO: 42419 - DNA, 1501 bp, Oryza sativa
atcctatattcaatccaaatatcatcgccgtatagatatgggatatccataatctccacaagtatttattgttatatcacatttccaaaaagaatcatgtccgtttgttttttcttctaattttcatccgagtaagagttgtgatcagtttcctaaacctatacaatgcatgagtgtgtttctggtatgtcacatttccaaaagaatacatgtccatttgttttttttgtttttttcttcgattaacgtgataatatctagaccgcgagaatgaacatggtggcttttttttctattactttattaagttaatagactagctattaagctctgaaaattttgagaaaatttagagagtgcaattaatcacggataatttaataaaaataaaatccagccatgttattttatttcccacacttattttacttgtaaattaatttaattatacacacccaagtattttgggaaatttgtattttaattaattgtataatgtgaatctttcttaacttttcctcatttttttttgccttttcttcccgttgcaataaacatgcctgtgtgaacagcgagcttcttctatttacctagtgcctcaaaaatacagtctctcttgtgatgactttgttgacactgtcacactgaacgtgcaagaagagggttacccaaaccaccggagccggggttactgggccccagcagtaagcacagttatcgcgcggtaaccatgagaagctgtacgaaacaatataaaatttattaaaattttaaattatttttaaatttatttgaatttaaggaggttactatggttttcttttaccatatccacagtaagtgtggttttcttttatcatatccacagtaagcgcggtaactacgtggttaccggcagtttaggaaatcaggtcacccctgcattgtagagaaaagtggatcgattactttgctaaaaggaactaggcccggtccactagctaggtagctaggggaggcaagaaagattttgccctgtcctactcctaatttcctatccatcttgaactaattcatcaggaacagagaaaggaaaaaaggtaaatgctgctgcagctgcagggacggacgaatggggctccatgcatacatactgtggagttttgctttaggttacgtgattcgttacagtgccgcgccgtgtgtgtccatagctaggtcgtaggcctcgtcactggtcggtgatggtcaaaaaccaccctcttatccatcgtgttcgatcatctccaacttctcatccacaatgggatatatggcttatttcttccttcctataaaataaataggtgaatgctcacgtgttgcaatataattaaataacagaacctgttgtacgctttaaagtctcaagaatcaaataaaattattctcactataaaatcttcttatcatattatttgttattattttgcttcacttcaaaagaaaattatcatgtttgatggcttgagattggaaaagt

SEQ ID NO: 42420 - DNA, 1501 bp, Oryza sativa
gcaatgatatgatagaataagcactgatccgaaggttaaagcatacatcggctggaggtccgatgccataaaatccacaagattagattaaacagtgaaacctttgttgcgatcggctaaatccaacttgtatgtatatgtaatccttataagccgatgcaacgtccagataacttataggctagcaccctgatagaacattagcatgaacctatcggcttaacaagacttatattatcaacaacaatctagtaggtcgaacctaaccgatgcagcacgagattgtatatgataatctaatactcgatgagccgatagatctgtctaacgtgatggatatagcaaatctatctagaacgacattgtgattgtagagatatattggctaagacagaagatcggacctaaccgagacagttctaactaaaccgatgagtctctaaacacaatgcaattaaagatagaatcgagatatcaggtaggtacatcaatcaaccaaaccagagcaatccaagatatcagagcgacgcagccttgaacaacgccgacgtagatgacagattcaccagggcccgatggaacgtaggacttaccccttcgccggagatcgaaagccgatgcagcctcgcatcaggtgcccaaatcccgccgaaagataagtaaaaacctcggtaaagagggtggcgatgcgccgagagtattattgattgagagtgatagattacgtacatagaccctaggtgtacatatttatacccatgggttgatacaagtccttgtcggataagaaagaaattatcctaaagataaaaggaaaacataaagtccttatcggacactaaacatacttttctaaagataaaaggaaactaacaaactattcctaattaatagataaactgccatgccgcatcctctttgaactcgattgcttatggataaactttctttattagattgatttccttaaccgaatatagcagggatccgactattggcaacttgataactcccatcggctgattccgtgatgctgcagccgatagtgattttcagccgatgatgactttagggcttaccaaatttcactgttaacaactgcttccttccaatagtcagcgtcaggagatgaatatgccccttcaatggttcttggagtgccatccacaaggtatacaatgtagtcatctccaaaagactttgcagtcatttgtctcttactctttcgagttgctacaatgctatcctcctcaggattttcctcatgcgtttgatcaatgtgttctatcggcgtaaagtgctcaggggataaaataggttcttgactagaggtgctaggtgcatttttcatatgaaattcattctaaaaaatgtggcatctcaaaaaaacttgatagatccttttcggtagttggctttgctgcatcactaaaaccacacgctttcgatggttcaaactataagagatggacatcacgtgcacttttgtggttgacagcga

SEQ ID NO: 42421 - DNA, 1501 bp, Oryza sativa
gggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtctggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggtgtgtggacgctttcggagttaactgggaccgaagccgcaatcatggtcttcgtctggttcaagatgttgacgacgtggtcggatcgattgagctcgttttggttgaggaggatgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctcagcctccttcgcggtctgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgttgtagcgagaactaaattcgtcgtactccacgatatcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagccgcagtcgtggtggagacggccgctaaatcgtcggggagcttcatcaggactggtgggtaagccccatcatcttgatctggtgtcgttagagaagatgcgatctcggccgggtggtttgaagccgactcggttgagatggtcttgaagtagctttcagccgcgttcgggaatccaaacgggaccgaaattcggttctctcccgactggtctgattccgagtcgaggagagaaatcttgccgaagttgttggtgacgaagtcgaggctgccgaaccgaaacgtctgcctgggcgggaagacgaggtcgtcgatgccggaggtggaacccattgcactgatcggcgaaaagcttgacgcggcccctacctggcgc

SEQ ID NO: 42422 - DNA, 1501 bp, Oryza sativa
cagaagcaaattaatcctcaggctcagtgcatcgcgatcatgcaaatgcaggtctgaattgttagctgcagagcagtatgatttttttctaagaacagtagagcagtatgatgcgtgtggattcgcttacttccattaggtcgtcctctccgacgactccgaagggcacaatggtggcgttgaactgcgctgccatcctcacaaattcagtctggtctggccagaacagtctgtgctcttcaccctagatagattccagagcacacataagtgcatcatcagttggaaacataattgttagacttggaccaagtaaggttctgctaattatttttttaaaaaaaagacaatattttcgtctggaagcacatcttaaacccctgtttttttccaagtattttggtctaaaattacgaatcctgctatcaatactcaaatcacaaccaaccaattgctaaaattgaacttaaaaatgtgatttgtttatgaactttgtagggttcctgaacgcaattccaaaagataacaacaaatacaccatgtaaatattattcctgccgtttttcaatatacaacaccattgactttcatcctattaaaaaaatatataattgtttttattttgctatgacttgttttataaaaaatggtacaatattaacatatatttttatatttttatattaaattttaaataagacagataatctttgtgcattaaaacccgaggggactaactatatatttatcgataaattttattctaaaaatttgacagatgtaattatagtataatcgtagtaataattacactgtaacttgtatgtaactacagttacacttgtatttaagtttcatgtaattttgaatcgttaaatctattacaacatttgttctggtgaggaagaaaaaaatcacagcacacacatatgtgaaaggatttgttcccacgacctctattttactgaaataacatagtaccgagagattcttgaaagttacatacaagttacattatagttacagtgtaattacatgcaagttacagtgtaattacactacgattgtactgtaattacatctgacaaatttttggaggaaaatttgtcacaaatatatagcaaattcgaaacccgagatagtacatgccagcctaggtagttaataaggggaaaatggtcgaattttcagccatatgatgatgtgtcaagattcgtgtataagttacgttgtagttacagtatatctacaataattataatttattgcaactacgctgcaactacattataacctttatataatttagatataaaaagttacatattttttattatttttatatacaagttgtattatagttataatatagttacgatggaattattatattatagttatatttttgacaattttctaattaagaaacttgcggcagcattttaagatagtctttatatataataaatgacctgaaaattttgggatgaaggcagtagta

SEQ ID NO: 42423 - DNA, 1501 bp, Oryza sativa
tacgattggtttgttaactgttgtccgtttcctacactataaccatacatgagtattgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatctgcccctaaaggcacccggaccccccttatatataggaaggagtccggattacaaaagataatctatgtccctaactgaatacagtcgtgaccgactaagtctcaaggtgtttccttgatatacaagttaggaaacaaacccaggatacacataagatattctatctatactcggtatcctatattcaatccaaatatcatcgccgtatagatatgggatatccataatctccacagtagcccccgagacctttgcagtcaatcgtcgtagccttctcaaaaataataatccgagtgcttcaaacttttcgtgccaaggcctgccgagtagcgaagacaaagactgtaaagggcgaaaagataaaaatatggtgcatcgaatagatgcacctaattaggtgtagcccccaactatgtgattagttaacgaactaaacatatagttgagagaccaaataatagcacgatcgtgcatcatatgacaaaagcacacacagcgcctaaataggcatgctagccgaccgctttttagccataatgaaaagagtccgagtagtttacactctaaaaaggttcacgaatgaacacactggacaggcatccgaatttaaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaaactaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggccgaagtactgttcaggcctaggcccattcgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaaatgcatcaaaatccttcccgtgatccaccgccttaatccctcatttctccctagccatccctcgaatcaaatcagcgcattcggatagaatcga

SEQ ID NO: 42424 - DNA, 1501 bp, Oryza sativa
cctaggtagttaataaggggaaaatggtcgaattttcagccatatgatgatgtgtcaagattcgtgtataagttacgttgtagttacagtatatctacaataattataatttattgcaactacgctgcaactacattataacctttatataatttagatataaaaagttacatattttttattatttttatatacaagttgtattatagttataatatagttacgatggaattattatattatagttatatttttgacaattttctaattaagaaacttgcggcagcattttaagatagtctttatatataataaatgacctgaaaattttgggatgaaggcagtagtaaaaagaaaaaagtttgtactgtactaccttgcagtggagtgcctcgcggtggccgccggggtagaggaggacgaactcgccggcggcgagcagctggtagatgtacttgtaggtcatggggacgccgccccagaggttgaggaagtcgaagaagtcgtggccctcggaccacgtcttggtcttgttggggaacagcagcgggtgcgcgatcccccggagcaccctccccttccgccgcaggaactccgtcgccagcgagatgagctcgatccccagcagcatgtggttccccaccagcagcaccggcccttcctccggcacccccgccagcccccgcaccaccaccccgtcccccatcgtcgagaacatcgccgggcacgtcctcgccctcaggtcactgctttttcatccatcccattttcatccatgttcatggatgcatggtgagccactctactttcttactctcaatatttaattacatgttcagagattcagaaatccagaagtgaaccttttcaattctccaagtacatgttcagagattcatagtgatagtaaaaattcagaatttgttttatgaaaagagaaaaaaaaaagaacagtactgaacttcaggaattcagtactgaactttcaagtctaaacaacacttgttcagaaatttagctctgaactttcaagtcacaataacacatgttcagaaatacagaatgatggtaaaaattcagaaattcagctccgagctttcaagtcgcaacagcacatgttcagagattcaaagtgattttaaagatttagaattttgtcttttcttaaaagaaaaaaaatcagtactgaactttcaagtctcaacagcacatgttcagaaattcatagtgatggtagaagtttaggaattcagcaaaactttgaattgttacctgccagctttctcgacctccttgagctcagtggctgatggggggatgtagtcgaaaacccggtggtaccgcctcgagtggcggtaaaggctggtgcatttgatgatcgacgagacatgaacaccgtactcctgaattttttattgagttttaccatcagcagggtttccttcacttctacattttgttcttttcagttgaaaaaaatgtctttctaaatttgcatatg

SEQ ID NO: 42425 - DNA, 1501 bp, Oryza sativa
ggtgacctccagcccgctggtcgcctggtacctctccaacctcccggcgtaccgcaccgccgtcagcccgctgctccgcggcatcgaggtcggcctcgcccacggctacctcctcgtcgggcccttcgcgctcaccggcccgctccgcaacacgccggtgcacggccaggccggcgccctcggcgccgcaggcctcgtcgccatcctcagcgtctgcctcaccatgtacggcgtcgcctccttcggcgagggcgagccgtccacggcgccgacgctgacgctcaccggccgcaagaaggaggccgacaagctgcagaccgccgacggctgggccaagttcaccggcggcttcttcttcggcggcatctccggcgtcctctgggcctacttcctcctctacgtgctcgacctcccgtacttcttcaagtagatcttttgtttgtaagtgcatgaccgggtgatgcatgtgtagatcgatcgatgatggaacatgtgtgtgttcatgtggtggctgatttgagtgccttctacttgtataaatgaaatgcatctgcacaagggcacaaacaggctgcctgcatggatatatggatggtgtgctgttgtaacttgggagtgttactttcttactttgcagataatttaaaatggaaagaaaaagttttaacaatgataattaatcagtttgttgtaattatattagttaatttgcaagggcgagaatcaacaacagttttttttaaaactaaaccggtaggagtacttcgagaacaaaatgacacagagtattcatgtatcacaactaaatcgttcatactctcaatattaaataatacagtggcggatctagaaatttttttttacctagacaaatctaataagatataagcatacatataaaatctatacaatatatatatatatatatatatataaaatttaatttgtaattgagtagactaaaatcaacgtgaaaggttatatcgattaatgtagcatgagagactagtatattcttttgcattagccttaactactttgctaattgcattgttaattaagcagggtacgtgctagcacagcgggcggagcccaggcacttgcccatggtggccgggccttggctccgaccttgaaataatatagtatatgctatatattcaacagtaatatgcagcagctgccattcttaccaaaactaagatttctagtctggaaattgctacacatccgactggggtgtacgacttagcatctgaccagtacttacctgctccttgctctgacccacatggagagaagctggctcgttggagtaaattgattggcagatacggcagcgtcggacagaagtcgaacaacagggtcggatgtatagcagtagtcttccagtcttcggcttgtagtactaattgtaggaaaagcgccaggatgtgatagatgaagtttcaaaacacacaagtgatgacaagcctcaccaacataaaacagtcaaccatag

SEQ ID NO: 42426 - DNA, 1501 bp, Oryza sativa
cgcacatgattaattggatattgattattccaaacttgaaaaaaaagtttatttttctttttttgaaaaaaaaatggcaacgcttattagtttgggaaacatgcatatggtaaacgagcggtagcaacatgcaaacccattttcaaactccggcttagtgggccacaagtctgcccacttgcatccctaacttttttgcattatgatagaaaagtttttttcctaaaaaatcaaaaccacaaatcagtaagaaattttcacctaaaacataaatactccatggtatattgtccaatataaatgatcaacagcagaaccatacttaaaaagaaattttacatataacgatataaagagaatctgcctatttcgtgatggaaagatacaaaccttcatgtaagtctatcaagttcagcacaataattttgatgccagcccatactcctgttttatctacaacgactataatttaggtatatcattgcttcgtaagaaaactttgccttcttctcactgtacttctttattaccacgcacttttcttccttagttttatttacagagctggacgttgccattactatctcattgccttgacagcctacctatctccttaattataacgggagggaaaccctctcttgatcttcactcaatcaccttccaattcacactacttaattaacttaggccccgtttgatctctcttttgggagttggatttttgttgcacgcaaaatgagaaacctcattagcacatgattaattaaatattaacgatcataaatttgaaaattgaattatttgctttttttaaaacaacttgtatatataaactttttttgaaaaaaaatacactatttaaccgtttgaaaatcgtgctaacgaaaaataaggaagttgaagaatagaactgagccttagtgtcaccgatcatttcccattcacaactttgctgattttgtttttattttagtatcgttacaggtgctaataatgctgcagattattgtttagaaaaatactgacttaatctcactatggtattttctgacgaaatagtttgggagagcagtataactgatttttctttatccctttgcatgcctaatctgattcataatctatattctttttctccacgtgactgaaatgccctccgtacttaaaccaccaaacccgaagaccaacctatctacgagaccaaccaccaaatccaccaaccgaaaccgctcacccgttagcccgttaagatcgcgcccagtacaagttgccccacccgcctccacgaaacggagttcgccgacgagccgaccgttgcgtccgcgtgttgcgactccgccgagccctagtttccgccgccgccgccgccgcgccctcgccgccacccccaccgatctcgatccccccaccccgcgggcaaatcgccgccgaatccggcctcggatccgcggaatccgggccgggtcagccatgatcttggagcagttcgacgagtcgg

SEQ ID NO: 42427 - DNA, 1501 bp, Oryza sativa
atgttgttgtttatgtaaaaatgagtaatagatagaaccagatgaggaaatgaaaataaggtatgataataacatactgaaagcaaaggcagcatggaagtgagactatctgacaacttctgcagagtttttggaggagaaaggttgttctcaacgctgaccatagccattttaagaggatcgcctgttcacacaccatctttagatcaattaaaaaagatacaaaaggaagtgttgagtgttaattgtaaatatgctgagatagaatcctggatgaaaatactaagataaatttccaaaaaaaaaatgtaaaagctaatatgcttttatgtaaaaactagtatgcttcatactagagttgttgatcagtgacccggcatgaattttccaagtttaaggctaccttttggaacattggactaccaaagaccgtttcccaatataataagaaataaatgaacagtaagcaataaaaagatgctttggttctcaggctggatcaaaaaagtgtattgcattacaagcatagcaaatcatccgattggccaaaacacacaaaacaacaaagctagaatgaatgtatattaacgaacttacaagctaaaaagaggtatacccatgacaaaactgagaagatatggaactgtgacatgaagttcacttggcattgcttccaacacaggtaatatcggctgcaacggagtctttgcaaaggacgttgctggcaacattgaaggttgtttgttactacaactcaaacaaatttatgagaaggaacgttaccaattaaaatagaactaaagaaaatttcacctgcctggattaatcagtatgagaaccagatcaatttgtggattacgagctgccaccgaaagtgctaggcatcctccaaatgagtccccgatgagatatatgggtcggtttggtgacatagcatgctcatatttgatagaattttccacaatctgcaacaaccctgtatgcattgtattcacacgcattagcagtttgatttaaattcaaggtcataatttcgctttgaattaatttcctaaattctaataagcctttgggctttgttagcccattcccaacccaatgactaaaatagtgtctatagcattaaataagttgccacatatgataaaaatgatgtgtcaagtgaataaataaggaaagaaaaggaaaccatgtcatgagacatgatttctacataacattcaagacatcctgtgagataagtagcattaaatttaaatatgaaatagtgttgtttgcattggaaaattattgtctagtcctagtttcttgatgacgtggagtttatgaactatatctggtgtcttagattgggaatggccttacatcatgctgaaattaccacggtgcacgaaaattcctaaattccatgcagatgaatagtttttcaccgttgtaatttttttttgtcgaccaaaagatggcatgaacgtcggaggagtctccttcctccgagcccaac

SEQ ID NO: 42428 - DNA, 1501 bp, Oryza sativa
atttgtggtctcgtatttaaggtattcataatcatactattttgtttctacagtccttttagttttttattacagtactatcagcaatatttatcgagaataaaataccatatcttaatttgcactacttactttactgtttatcattaatttactttttatcatgttagtaatgtttattaatatcactttataaaaaaaacatggtttatagagtatatattgcaaataaaaaggtttagggcctatagaatcaaggggctcttgaaattatagagccggtcttgccctcttgaccatccgccggtggttgcttggagaggaagaaaaatgatgcatgtttcctctttgacggaaatatttatggcgatggcacatttctaattttatgataattcagtgacacccacctagtttcggctttagtagtggtatttttccaatacaacgtttccataatggcacgatcaaatttacccttcttttttcaaatttaccaaaacaactaagatctcagagtcagaatcaagatgggaggaggggggaagggggagttcttcgatttagatgaatgtcgaggtggcggcgacttgatggtagaccacgacatcgtgagggaggtgagacgggcgacacaccacgaagacgtaataggacggtggaggcaaatgggggcatcaagaaaccagtggttaggtgacgacaatggcacatcctatggcggaatacaaaggaaacatcagagaaattaaggtagtgtggggctttagagacaaagaatatatacaggtaatgggaagaattaattgagccagagtgccagagcagaaggagacggtgttggggctagccaaacaacatctctagtgggtctttaacggtcgtagcgagatagacaagtggtggcacgtagaacagaaatagtgatgaaaagacggtggcggtggaagctgtggcatagaggagacgctcatatgagtgggttgagggtgggccagtggaggactggtggaagatagcaggacatggacagcagttggatcttaatccggtggtaaaaaacttgtcatatttaaaggggagtttttttaaatatgatatactatctgtatctcaaaatataacatttttttactgtgtatttggggatctcagaaattgttatattttcagactgaggtacgtaccatgcagtttccaaatttaaaggcgataagctcactgtcatgcccactagtccagacggtgtttaacccatcacctgattaaaagaagaaaaaaaaacagggtaaaaacagaaatagaaaaaaataaaaaaaattctagtggctcaggaccagtgcaagccacactgctccacaaaggcagggtggaaggagtcctccttgccgctgccaccattcgtgccagagaaaatcgctgttcccctgctgcatgcatgcatcgccccgccctgaccacttcacctgcctctccatatatacgcagtttgcagcagatc

SEQ ID NO: 42429 - DNA, 1501 bp, Oryza sativa
cagcatttaccttttttcctttctctgttcctgatgaattagttcaagatggataggaaattaggagtaggacagggcaaaatctttcttgcctcccctagctacctagctagtggaccgggcctagttccttttagcaaagtaatcgatccacttttctctacaatgcaggggtgacctgatttcctaaactgccggtaaccacgtagttaccgcgcttactgtggatatgataaaagaaaaccacacttactgtggatatggtaaaagaaaaccatagtaacctccttaaattcaaataaatttaaaaataatttaaaattttaataaattttatattgtttcgtacagcttctcatggttaccgcgcgataactgtgcttactgctggggcccagtaaccccggctccggtggtttgggtaaccctcttcttgcacgttcagtgtgacagtgtcaacaaagtcatcacaagagagactgtatttttgaggcactaggtaaatagaagaagctcgctgttcacacaggcatgtttattgcaacgggaagaaaaggcaaaaaaaaatgaggaaaagttaagaaagattcacattatacaattaattaaaatacaaatttcccaaaatacttgggtgtgtataattaaattaatttacaagtaaaataagtgtgggaaataaaataacatggctggattttatttttattaaattatccgtgattaattgcactctctaaattttctcaaaattttcagagcttaatagctagtctattaacttaataaagtaatagaaaaaaaagccaccatgttcattctcgcggtctagatattatcacgttaatcgaagaaaaaaacaaaaaaaacaaatggacatgtattcttttggaaatgtgacataccagaaacacactcatgcattgtataggtttaggaaactgatcacaactcttactcggatgaaaattagaagaaaaaacaaacggacatgattctttttggaaatgtgatataacaataaatacttgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactccttcctatatataaggggggtccgggtgcctttaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggccgcgtcaagcttttcgccgatcagtgcaa

SEQ ID NO: 42430 - DNA, 1501 bp, Oryza sativa
taatcgtagtggaattcatcagcaaaataaataaatcatatagaaatagagtttttttactattttcatcatacgattcttgttggttgacctcaagcactgaacaagataatgcaaattatttggctatttcaatgtctggctcgccagtagttggaacttgggagagaaaaaaataagcagcggctgcaaagggttcaagggagttgagcctgttgtagttaggtggtactgaaaggataattgattcagaaaagtgaaatactccaacgtcctttccattccaacttctcgcttgtccaattaagaactttgaaaaattccgtactaattaagaatttcacggaacgaatttaggtagccaataaatgagcagatgcatatttttttattacaaattaaaactgattgagaatttctcgttgagaaatctgtgtgtgaaatatttctgatttagaatttcatctctggctggtaaaactgatatattacagtttggcacatcaggaagtatatttaattttttttaagatgatggatagaaatccgatcctatattcacacacatacttaaagattacatgggtacttaaggcacattctaaagagataattgagcttaactactactcgttttctattagcatgttttttaaactattaaacgatgtatttcgtgcaaaactttctatattaaaaatactaccttttcaaaataaaataatttgatttatattttttaataattaatacttaattaattatatgctaataaagtttttattttgcgtgtcgctaaataagacaaaacgttaagctggaaagaacgtgtcctaacactccaaatcccataactgacacaaaagaggaaaaacaacaataagaaagataaattttacagttcctaagatgtactgtatcaaaacttttaatgcaaacttagctcctctcggtacctacttaactactataaaatcactaaaagaaaaggtaaacacgatatgtagttagaaagattgtatggctaacattcagtttagctatgcatgcttgactagcatagaaacattcgcaagcatgcatgttcagagcatttctgttcttgctgcgaaaacgcaacgacttgtgttcagattgaactgaataatgctaatatacgacttatcatttctgatggaggaaacggtacgtagagcttagaccagcaaaccaattaatcatcatttcgcataagtcaatttctggacgttgcagagccatcagccatgtgcaacgatcgttggaacagtgatcgcatttttcaataatgcctacgacaatcattcccttgcaatatgtaatccacgcctctgcatgcaggcctcctagatcatagtactatataagcaccaccattgccgcatacatccctcacctccaaatccattcatcacaacaatatctagctagctagttatctagcttaattactctcgatcgactgcacaggctcaacctagct

SEQ ID NO: 42431 - DNA, 297 bp, Oryza sativa
ctcgggtttgggggcaatgtttcctctagacgaagagtggctaacaccccgtcactccaacctcatgcatggctggagtaacgtacgtaaccatgcatgaacgaacaccaaatcactcgaggttgaagacaactagctagccacctaagaaacgagaaacgagaaacgagaaacgagaaagatgaccttagcggcaaccgcacaacggctcaaaccaacccagcaaccaatcctcctctccaaaaccccccacttccttcctctcctcctcacggcctcacagcaagcagccaagca

SEQ ID NO: 42432 - DNA, 439 bp, Oryza sativa
cttcaacgatctagatgaaaatacaccctaaacagatctgttttaactggggaaattgaattatgaactggccactaaaacgtgaccatgcatgctgtcaggccttggaatgggtggcgcgacgggcaccgtggcctgggcctctagccccgaagggctgttttggtttaaaaccagaacttgtgttaccaaatcattgatgtttttgaatagtacttttgaaatgattcttcactgacatatcgaccaatgtcgtcaaaatattagcaatgtcaaaaattgtctaggttttgacattataaatattttaatataatagcaaatcaaactggaagccactacgaatcgggcacccgatctgggagaaaaaaaatcgggcgcccgtccgagccgtccgatccagcaccctaatctcgtccgtctgcgtgcattaaacagg

SEQ ID NO: 42433 - DNA, 1501 bp, Oryza sativa
atgctcagttgtataatcggttacttcagtcttgacttgcaagtcgcaatggccaatctcagaagatgtagggcttttgtgacttagtaccctatcaaaatattttttgatagtatcagtattttcataagttctgactaccaatattttagcaggttaataaagaaaaagtgtgtttggctcgatgttatttggaattcaaattttttattatagtgaagaaagttttagaactataccaaattaaacatttttttatcaacatattggcttcaaaccaaaccgtcgcatttactacatccgtctcattttaaatatagttatgggtttctatgttcaacatgttcattcacttgtgataaataagaagttcagtttaaaatattaataatttggcgctacataagttgctattttccatgaatttactgctagcgggctacctatatattctcccgagtgttcacttggtcattaagtttgagttcagcgctgagagttcccaactctcatccctagtttttctcgcgcacagttttcaaacggctaaacggtgtgatattttttaaaaaaaaatttatgggaaagttgcttttataaaaatcgtatcgatccatttttcaagttttttaatacttaattaatcacgcgctaatgaactgtaccgttttccgtgacagtgggcaacgtttcccaccatcatgttcgtgttttgacttttgaggtcttttgccgaaaagcgttttcgtcgtatatctaaacctgtaaaccgaatgacagtatctgaaactaatgtagtaaaatcgatgccaggacacaaggcaaagacgatgatcacggtacagtaattgcctcaatcaaaggcacatatactgcgtaaaaagaacgtttgcctgaacaccgtgtcatcagtgttcagcagtagtgtcactatggctgtgtttagttcctaaaaaaaaagttacaagtttagaaaaagttgaaaatttagaaaaaaaagttagaagttcatgtgtgtagaaaaattttggatgtgatgtgatgtgatggaaagttgaaagttggggttgaactaaatacggcctaattgcaatcatcaaaacagacacaactttaatggtgatgtatgctctagtagagatgaaaacggatcggaaacggacggaaactagctttatcatattcgttttcatatttttttcggaatcggaatcagaatcgaaaactcgaatacggaaatgaaatcgaatattatcgaatacagatacggagcgaatacgagacggaacgaatacggtagcgagtatttaccggtatataaaaaacccctcaaattgagtttcttgatcaaggaagatatatcacttattattttagttcaacatctccaatatttatatcgtcaattttacagacggtctcacaaccgtatgtgaaaatcgatttttacggctgtttctctaagagatccatatgcaaatatgattatcattttctattc

SEQ ID NO: 42434 - DNA, 1501 bp, Oryza sativa
aataatagtgttaaaatcttgataagttttaacacgttataaagaaaaggtgtgtttggattgatgttatttagaagtcaaattttgtatagtagtgaaggaagtttaataactatgccaaattaaacatttttattaccaacttattggattcaaaccaaactatctcatttactattcaaactatcaaaatatattttggtagacatgttttagcatcaatccgaaatgacctggtgtaccttttttagcgattggctcaacacggtcgtttgacagtgggcttaaaggaggcccaatacatgcgggagtcagcgaaagagcaccagaagaagcccatgccatcccattcggatcggcacatcctctcaaaaacggcccagtcgagccattcgtacaagccgccggcggcgagatttgttttacaacaattactactcctaagccccgaaaagtaatttatggaataagtacgacatatttacaaacaaaaaataatttgtaaataaaacttctatatacgtgttcttagcgatctaagaggctaaaaaataaacttcgataaaaaaccacaaaatctgctctaaatttaaggttgaaaatttaaattttggcagataagcataagcataagcgaaaagatgaggcctccatctttgtgtccagataagaataagcataaacgaaaagatgaggcctccatctttgtgtcctccaaacgcgtacacttcagatagcgtacacttcagataaaaaagaaagttgttcagtttcaaatattagtttggcgctacataagtttctattttccgtgaacacgctacctatatattctcctgagttttcacttgctcattaattcgtgttttgaggtcttttgccgaatggagtgtccaaagaagcgaagaaccctaatgcgttgctctccttctctagcgggccgaggtcgtgcatcgggcagaacttcgccatgttggaggcgaaggctgtcatcaccatgatcttgcaaaggttcttctttacactatcccccaagtatgtccacgcaccaaccagtttgatcacactgtggcccaagtatggtctcccaaagatcctcaggagcctcaagatgtgtaggatggaatcacaagaactaagccaaccagaggggggtgaatggttggtatacccaaaaacctaaacttttagtggaaataaaagttaccctcaaattcgatgtagatcggtctaaccgaggttgatccgccggtctgaccgcgctcgtgccgccggtctaaccggtgttgatcactcggtacaaccgcctgaagatcgtctgccacgcctgaagtcgctgccggtctgaccgtctctcctccgtcagtctgaccgcctctcctccgtcggtctgaccgccgcctgccgccggtctgaccgccggtatatcaccggttagaccgccgaacccgattaaacacaaatcgaagaactcttaaagtagatgacaactttattgctt

SEQ ID NO: 42435 - DNA, 1501 bp, Oryza sativa
ccgcttcttcctcgtcgccgtcgccgtccgttgaccttctgccgctgttttggtcaccggtgagttcgccgcgttgcccgcaacccgtaggtgtccttcgttcgcgccgccgcgctatcattcgccagcgagcacgcgaggccgagccgccgtcgatgatgacgtcatcgctgacgtcatcgttgcccatgtcccgtgaaccgcggtagatcaagttgatctcggccgttcgttttggatagggtagatctcggccgtccgttccgtagaccgccgctgtgcacccggtccaccgtgagccgagcccgctgacgtaataatcctcttttccttttcaaaaataattctttattgcgtcataattcaattaaaatccatataaatgttttaatcctatttaatctttgaaaattcataattaattcatcttagctcggatttagttggttcaagtctctaaagttgtataaaataaagatctacatattaaaattatccataaattgaattaaatttatttaatcctttttaaatgggctttaattaagttaaatcttgtaaaattcgtaataaattcatatgaagtcagagtgaggccgttcaagtctcataattcatctaaaattatgatctacatgtttgtttactttatatgtattgtttatttggagtttcttagtcgttttcctcgttttgcgttttagcttgttgtttccgtcgtttcgaaggtccgcgagtgcgttggaagtattcaagaagattaattgaagaccgaatattgcaaggcaagtcacacagatcccaaacacagttcctttgagcatgttgatcctatatttaaattctctatttatttcaactgtgcatttatttttgaatgtcactgggtggtgtgaacctgttcctttgttatggcctgtttgcattgattactctattccttgataccttgggttattataatttgactagttgagctttatatattggttcagctagatgttagacataattgcttagccatgcttagaaacattagcacacgattgggataactaatgtttcactattacttaatgatggatatttaatgatagctcacgatggtcaatcgtgattggttaattaattaatgtgccaactaaaacttgataatggtgggttgtgagcacatggttttgatggtagtgctcatgacaattaaggaccggttcacgattttcggttgtgaaacattaaccgtgccaaccacaagccagaatgggcaacggctggacactttgtataacaaggctcattacggagcactagactgagaagtggcggagataagcccacgggggtcgctggggagtccatgccttgtttataagggggtgattatgatccaggaatggtgcactgctttgagttgagttatgcgaggggtcttgtcacaatcactcaacatggtgacgtgtctgcgcggacacggtaacatgctggtgggttgtgtcttgtg

SEQ ID NO: 42436 - DNA, 1280 bp, Oryza sativa
ccgtggcccgcgttccaccaggcgccgaggaacgtgatggtgttctcgacggcgttgaccggaggaggcgtgagcttcacggaggagtagaggaagcggctcgatcggcgcggtgcccctgaaaatctcactagcaagcacagatcaatctcatcacttctttcttctcttagatggcctggttgactgcgaaggtcctgctgcagatggcacctcttgagcagcctcaactgcttcagctttagagcttctcaaactcctccttgtcatcctcgctgatgggcctgctctttcattttcttcaaccagttcagatttgactcctctgcgtctagtcctcaggttcgttaacatcctccccgctgcgctcctccctcaccagccgctggccgcgccggtcgcaccaccgtgcgtcgccgcctcaccccgacgacaacgcgtggccacagcaatggcgccgcacggcacgcggaggaggaggaggtaaggcagacgaccgcattaccttgaatggttttgtaagttgaggaatgtgatatatctggttttgtggttaggtgatgattttgtaactcgatgacaagttgagggaccttccgtgtactttttccttcatcttctcctcccttcttctcaggctcggtgtatatatgtacatcctggaactgaaagaatacacccgtggaaatacagatttgagtaatccaatttatagcaatctaactcaataatcaggattacaataatcttaaattgaaataaacagagcatcagtaactcaaacaaaattagttaaaagccatcactcattactaccccatcctttgtgtctttttttttctttcaaatatttgacactacataagttgttactactttccacgaatttgccactagcacgcttcatattctcacgagtcttcacttggtcattaatttgtgctttagcgtatctcttctttatataaagctaatgcccactaaaaatataaaactcaatatgcaagtataatatttattagcactcctaaaacctacatgcaggtatgccacatcaacccattaagcacacaaaactcaacatgcaagcatatagtaattatatctacaatttatttcattctaaaactaaatatacacatgctaaatcatcattatcaaatcatttttataatatttcaattcaaatcatttcatcatttctccattatctaacatatatcccgcagtaaagcgtggggcatcatctactgaagagtgctatcgccaaaataacaacc

SEQ ID NO: 42437 - DNA, 1501 bp, Oryza sativa
gccgtcgctccggtcgtcgtcgtcgctcgggaaagccattgtcgtgatcgtcaagacgtcgctgtcacatcctgatttttgtttcaggatttataaattatttaataaattattaatagaatttatattaaatgttctttaatttacaagtgaagtaaaatgtgggaaataaaatttcctaaatataaggcatggatggatttaatttttattaaattctccatgtttaaatcaactctctgaaattttctcggatttttcagagctaaattcttaaataatacaaagaacagttcagtaattatttgatcattaatgatctaagtataattgttaagagcttttcttgtttaaaaatccttaaattataaattgttgtttaaaaggaattattagaaatgattttaaaagcttataagagaagatctaagtttaatttgttaaatctcaacataaaattgggctagataaaattttgttaaatactttgcttaaatctataattcctagatttttctgggatttatttgagctaaggaagtatttttagtaaatggaattgcatttaagaaataatttaaattgaaaaaggttttaaaagtcttcttttggctttgggccgaaagccggcccaaaaccctctctctctctctctttccctcggcccagccggcccagtctgccgagccgccgctctcctctctctctctccgccgctgacaggtgggccccgcttgtcaggttcttcgtcctccttcggccgccgccgcccgcaaaccctagcgcgccgccgccgccttctccttccaaatccgctcgattctttccttctccggtgaaatctttagaggggaaatgatcttctcgatctcctcttccttttctcttttggaatctctggtcaattcggtttggaaactcgatggaatcgagatcgaatcggattcctctctctcccaaaccctaaagtttccttctcgccgccggtcgccgtgggcctccgtcgccgctcgctagcccctttataaggacccccaagctctcctctacccgtcgcctcctcgccttcgcccgccgtcgtgtgtagcgccctagcctcgggagcttttgcgccgccgtcgccgccgttcgtccagccgtgcgccgccgtcgctacggtcgtcgtcgtcactcgggaaggccaccgtcgggatcgccaagtcgccgccgtccccgtccgccgcttcgccgccgccgaagaccgccggagcgccgtcgccgtcgtcgacccgaagagcttcgccgcttcctcctcgtcgccgccgccgtccgttggtcttccgccgttcctttggtcaccggtgagttcgccgtgttgtcctctacgtcttggtgccctccgtttgcgtcctagtgccgccgttcgccggcgagcgtgcgccgttcgagccgtcttctccgccgagccgccgccgctgtcggtgacgtcaccgctgacgtcatcggggtcgtccgccgtaag

SEQ ID NO: 42438 - DNA, 1501 bp, Oryza sativa
ggtgttcgacatgttggcaaagacgatgtagaggaagacgaacaggagcaattgcgcatagcgctcccaaaaacttgatcgtccgcctatccgtgcaagtacgcaagcggacggagttctggaggcacctgctcgtcccgtgcacctgtgcacgcaggtgaacaggactggggaaggatcatgctgggcaggaaaagagagagaaaccggcaagaggaatagaggaagaacaaaagaaccatgcactattgaaatcattccctttggcggagtatgtatatgcgtgcgcaagactaacgttcgggaccatcaaccgagtgtttaattcagtaaccgatgcgctcgttaatatgaccaatacagaatcaattaccgtgtttattaccgttcgagaccatcaaccgcgtgcttaattcaataaccaacgcgctcgtgaatattatcgtccgttataaaacgagagagatcattccctttggcggagtatatgcgtgcacaagagtaacgttcggaaccatcaactgcaagagtaacgttcgggaccattaaccgcgtgcttaattcggtagccgatgcgctcgattactgtgtttattaccgttcaggaccatcaaccgcgtgctcgttaatattatcgtccgttacaaaacgagagagaattcccatcattaaaacagaatcaattaccatgtttattactgttcgggaccatcaaccgcagagagaattcccaataaccaatatgctcattaaaacagaatcaattactgtgtttattaccgtttgggaccatcaaccgcgcgtgcttaattcagtaagcgatgcgcaagagtaacattcgggaccatcaaccgtgtgcttaattcagtaagcgacgtgctcgttaatattaccgatacagaatcagttaccgtattttctcaaccggtcaacaaagtctatccactagcttcatatttaagttgagacctctttacttttaaggtggtattattactcatagcacttcatgcgagtcaataaaatttagcccattaatgtaacactgcgttagcgccgtcgggaaagctctctgctgcgtgggcactgggcagccgaatccgacccagtcggagcttgagtcgttcagtacttgagtagcctatccgattgacggtcccagagttcatatggtcactataatctctttttttttaatctaaaatatacccgtacgttacaatgggtgaaggctattttacgtcgtattgtcttaaattacatatgtaactttagtgtatttacaatataagttttaaaattacatatgtaagtttttaaattacatatatatatatatatatatataaatatatataaaagtagtgtataatttaagtgtaagtactatatagtatactatatatatatatgtgtgtgtctatatatatatatatatatatatatatatatatatatatatatatatatatatatatatatatatatatatatatatggg

SEQ ID NO: 42439 - DNA, 1501 bp, Oryza sativa
gactatagaattcgggtttaggtgatgcaagctgattccatagaagcttaatatcccgcggaaaaatctcgaggtcggaagagcgaagccgccatagaagaaatgcgagaagactacgatctcatgtgtatcaggggtcggaaaagcctcaccgcacgctggccgccatccgatgatctccttggctgggagaacgccgtgcgccaccatctccttcaggttctcttccgttacgtcggacggcgcccattggccttcgaagctttccttctcttccgccatcgattctatccgaatgcgctgatttgattcgagggatggctagggagaaatgagggattaaggcggtggatcacgggaaggattttgatgcatttttcgaaggtggatttgagtggagtggtgaaccctagttcgccggcgcagttctgcactgtagcaaggagtggggaaaatggcgagagttccggcggggaagacgaagcgtcgcttggatctcgggatttcttgttaagggtatcggaggtgcgaatgggcctaggcctgaacagtacttcggcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagttttattaggctacaaaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttaaattcggatgcctgtccagtgtgttcattcgtgaacctttttagagtgtaaactactcggactcttttcattatggctaaaaagcggtcggctagcatgcctatttaggcgctgtgtgtgcttttgtcatatgatgcacgatcgtgctattatttggtctctcaactatatgtttagttcgttaactaatcacatagttgggggctacacctaattaggtgcatctattcgatgcaccatatttttatcttttcgccctttacagtctttgtcttcgctactcggcaggccttggcacgaaaagtttgaagcactcggattattatttttgagaaggctacgacgattgactgcaaaggtctcgggggctactgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactcc

SEQ ID NO: 42440 - DNA, 1501 bp, Oryza sativa
ccgccgtccgctgctgccacaccgccgtcccgctgccgccacaccgccgctccgctgccgccacggcatcgaacaaaataacgtgaactaacgtgaacgagcgaacgaacgtgaacaagaacgagcgaacgaacgtgaacgagaacatgaacgagcgaacgaatgtgaacgagaattgaacgtgaaagaatgaacgaacgtgaatgaacgagcatgaacgaacgtcaacgaacgtgaacgtgaactaacgaacatgaacgaacgttaacgaatgtgaacgtgaatgaacgtgaacgtgaaatgcaatataggcaggtgaatgaatgtgaacgaacgaacgtacgtgaatgaaacgtgaccttaacgagaacgcgaacgtgaacgatcgtgaacgaaacgtgaacgtaaaatgcaatatatgttacttcgcgtttatcctaatacatctttttgtatcttgcagaaaagacgttgttggagtcgtccctcaagccggagtggtagctagccctcgaaggaattcgcgcagacaagtgacgtaattatatatatgattgttatatttgtaatgcaattaagactattagatttaatatacgacacttagacttagttttaatataagattattatagtttgtaattagactttagtatataatttattgactagctagggtcctataatatacgtcacctagacttagcatatatcactatttgagttttaatataagattattagatttgtaattagacttagcatataagattgtgtagggttctaatatacgacagttacacttagcatacatgactatttgagttttagtataagattatttacgttttaatataagattattatagtttgtaattatactttagtatataatttattgactagctagggtcctataatatacgtctcctagacttagcatatatcactatgtgagttttagtataagattattagatttgtaattagacttagcatataaggttgtgtagggttctaatatacgacagttacacttagcatatatgactatttgagttttagtataagattatttgagttttaatataagattattagatttgtaattagacttagcatataagattgtgtagggttctaatatacgatagttacacttagcatacatgactatttgagttttagtataagattatttacgttttaatataagattattatatttgtaattagacttagtatataactattgactagctagggtcctataatatacgtcacctagacttagcatttatcactatttgagttttagtataagattatttaagttttaatataagattattagatttgtaattagacttactatataatttattgactagctagggtcctgtaatatacgtcacctagacttagcatatgattgttagcatataagattgttaaaacataaatgtctcatgacttagcagctgtttcatgtatgaacaga

SEQ ID NO: 42441 - DNA, 559 bp, Oryza sativa
tttgataatgccaaaattttatcatgatttcttatatagttaccaaaatttagcagcaaactaaatgtagccactttttttaacaactttaccaaaatttggtaatattaaaaatgacatcaaatgaacaggccctgaatgaatgaatgagagagttgtcctcctttctttcgcctcacttcctggctcctgctataagaaacacttctcttcccgtaaaaaccgattaaagaaaccaatcatgatacataaaaccaatcaacctattctgttcaaatactttcactaaactgaataaagaaacgttacgacagacgggcctataaccagtaacaagttgaaaaacagtttggcacgaggcaaaatatactccctccgtcatataaaaaaccaatttaatattaaatatacgttttctagtacaatgtatctagacattagtatgtctagatttgttgtattaggaaacgtctaatccaatacgaggttaagttttttttaacgggagagtagacggtaatcataaagagggcttaatcaccttcttttttttttaagc

SEQ ID NO: 42442 - DNA, 1501 bp, Oryza sativa
acgttagggtcctgcagatgcaaacatttaagagatactgaacttcttcatatatgtaatcaagaatgaagaaacaagcaaacatcaagggttattttatccaaaagcaatgatagaacagagtaacaagcacaagcacttggtgaatcacgacaatgtctattggagtgtctgacagaactaaaaaaaacttacttcttcacctgtagtaagacacaactaacaacagtggaaaggtataatgagcaaacatcaaagtgaagggagtgactactgatcgacaagaaaatgcaggtgctcttccaacattaggagtacctaactggatactaccacaaaaggaacagaggcggttctaatcattcattcagcacaaaaaatcggtagtttgtacttgcaaccgtaaaatcatgctaaagttgtaaacgttaattagacattgaacattggtcgccaaatttttatttcagagcaagtaaaaagactaggaaaatgagcctcaacttttgatttaaacttttttttcaaacaatttctagaccatgcctcacctatacttccaagaaagaaaatgtggaaaaatccattttagtcaagccttttaggccaaagtacaagaaagtatgtaacatgaggcttcttgtacatcagcaactaaactatcaaataactaaggaacaaaaaaaaactatcaaatggtcagcaaaaaacaaatacttctttttaaaatagcattgcatcctgaatagaagagggaaggaaaaaaaaatctaaatcacgtttactggcttaggctatttccatgagaaatggaaaaaaatagattgtactttcttctgacaaaaatgttggacacaactactccctctgtttcaaattatttgtcgttctaggtttgtcctaagtcaaacatgtctattttttaccattagtttttaaaaatccatgcagttcatcatgtgaattatttattatgaaagtatttctcatcgcaaatccaaaaatataaaccttatgatgttaaactatatgagtttatagaaattgatggtcaaattaaaatgcttgacttaagaaaaacatagaacgacaagtaatttgaaacaaagggagtattggacataaaatttcacataaccctatgtaataatggaagcaactttgtattcaattcatgtttaaatataaaaaaaggcatattgaaaatttaataatgcatgttttgcaggggcataattgaaggaaaaatgaatacaaatgaaggaccatgaaaaaggctgcgatgtcaaaaaataacggatgtccaactatctgtccttgctgagtatagaaagttatgttaaaaattcattctacagaccatgtatgactgaagaaatttccttacaagaaacattccggatgcattatgaaactgcctaatattagcagttacaatggtgaaaatgacactgatcaacttcaattcaataactgaaaaggcatctcctaattaagcatc

SEQ ID NO: 42443 - DNA, 358 bp, Oryza sativa
agcccttgcgtgcgacggcagcggagaagtcggtcccttcctcaagggggacgcgggccagcacggccgtgggcagcggcgactgctgctggtgacggcgtcgtcgtcgtcactacgtctttatatttatatttatatacatgtgggacccaccttgaataacaattacctgcttgctgcttttggttggtccaaccttacttacttactacttggtaaggatacattgttgatgccctaagatatctcctcctgacatgacatatatatagatagataaactcagccgccctagagacaagctagagaacaaccaagacagcaatgtccatggcgtctctccaagctcctgagttcc

SEQ ID NO: 42444 - DNA, 196 bp, Oryza sativa
atatgttaatgagtctagatatatatatatatatatatatatatgaatgtgggcaatgctagaaagtcttataatatgaaacggaggaagtatttgtgtttatactgtgatcgtctaaaaggtatatcctttcttcatgtaatcatgtttcagataaaaagcaggggaagatgtttatttctaccacatatcaagt

SEQ ID NO: 42445 - DNA, 1501 bp, Oryza sativa
tggttcgaatgcagggcccccttcgttggagcacagtgagagctgggaggcccggacagagaccattgtactgtatatttccgttggatcagggttcggtttgggatttgcaatggccttcttgttccaagtgttccgcggaaagtgaaaaatgaagcttggtggtcaataataaatagagggaaacaacaatatgacatgccttaccttttagtatacacccatgataagtaatgtacatataagcctattctttctatatttttaaagaactgtcgagataaacttgctacacttccgttttaactgagttactctaaatagttagactaccatgaataaaagttctaattttatggttgatgcaatacaatttgataacatggcatccacatatttaagtatttctaatttttcaagaaagaccgagaggtcaaaacttgaggatgaatagctgcaatgtcagttttttttttaaaaaaaaagagataggagtacagtgttttattctctatcactaagttaaagttcatgaaaccttgtacaatttatttggcatgcatataaccccatcggtaacgacctatacttgtcggtaccaatctcagagatactcggtggcaccaagccttatgccgatcggtgcaagatcgatacccaaataacaagcttagcacctacaagatcaggggcatcccggccaaattagtcctcgtgcgaaatgttaaaatggggccctagtagccctagtgcccctgctcggtggtgtcctggtgaactgtgaagtttttttggcagccaattttctctggaagcttcaccttctctgtattgctatccttatttacatatacatgactagatgggccctctagcagatgggccagcacataaaacacacacatactgttgtatttacagcccaacactccccctcaagatgggtgatagatatctatcatacccatcttgtcacatgaactattacactctttaacacctaaaccctttgtgaaacaatcagcaacttgtccaccagacattacaaattctaattccaaaactccctcatccagtttttccttgataaagaaacgatccaactccacatgctttgttcgatcatgttgaactgggttgttagcaatgctgattgctgacttgttgtcacaccacaatttcattggagtatccaccggcaacatcaactcagaaagaagattccttagccataacaactcactcaaactcactgacattgcccgatattctgcctcagcggttgagcgagacaccaccggttgcttcttgctcctccaagatactagattgccaccaacaaacacacaatagcctgaagttgatcttctatcatcaggacaacttgcccaatctgcatcacaatagccttcaacctccaagtgtccatttttcttaaaccataggcctttacctgggcttcctttcaaatatctcaagatcctatagacagcatccatat

SEQ ID NO: 42446 - DNA, 608 bp, Oryza sativa
acaggcaaaactcaactggggtctgagccttggtcctctaacttcgtcttcagctcagaagcactacacttttgaaaagggggaataatagcaaggctgagtacaaccaccgtactcagcaagccacaccaacgatgcagacgtgcaaggggatacaaggatggtttggggctatttgcataaaggcggttgtaaaacattttattgagcaaaacagtaaaactgttgagtaattaaagtaacattaaatctccactgatcaacgctacaccacgttgaacaggcccaaccaacccacctggactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccctctctaaccgatcgcaccacaccttagggttcgcccccgtctccagcaggcaacgggcagcccccctttcgtgccgcggtgaatccaga

SEQ ID NO: 42447 - DNA, 1501 bp, Oryza sativa
tgtcggctggttgaacttgtcctacaatcgtttggagggtgctattccgcagggaggtcaatttcagacgtttggaagtagctcatttgaagggaatgccgccctatgcggcaaaccgctgtctattcggtgcaatggttcgaatgcagggcccccttcgttggagcacagtgagagctgggaggcccggacagagaccattgtactgtatatttccgttggatcagggttcggtttgggatttgcaatggccttcttgttccaagtgttccgcggaaagtgaaaaatgaagcttggtggtcaataataaatagagggaaacaacaatatgacatgccttaccttttagtatacacccatgataagtaatgtacatataagcctattctttctatatttttaaagaactgtcgagataaacttgctacacttccgttttaactgagttactctaaatagttagactaccatgaataaaagttctaattttatggttgatgcaatacaatttgataacatggcatccacatatttaagtatttctaatttttcaagaaagaccgagaggtcaaaacttgaggatgaatagctgcaatgtcagttttttttttaaaaaaaaagagataggagtacagtgttttattctctatcactaagttaaagttcatgaaaccttgtacaatttatttggcatgcatataaccccatcggtaacgacctatacttgtcggtaccaatctcagagatactcggtggcaccaagccttatgccgatcggtgcaagatcgatacccaaataacaagcttagcacctacaagatcaggggcatcccggccaaattagtcctcgtgcgaaatgttaaaatggggccctagtagccctagtgcccctgctcggtggtgtcctggtgaactgtgaagtttttttggcagccaattttctctggaagcttcaccttctctgtattgctatccttatttacatatacatgactagatgggccctctagcagatgggccagcacataaaacacacacatactgttgtatttacagcccaacactccccctcaagatgggtgatagatatctatcatacccatcttgtcacatgaactattacactctttaacacctaaaccctttgtgaaacaatcagcaacttgtccaccagacattacaaattctaattccaaaactccctcatccagtttttccttgataaagaaacgatccaactccacatgctttgttcgatcatgttgaactgggttgttagcaatgctgattgctgacttgttgtcacaccacaatttcattggagtatccaccggcaacatcaactcagaaagaagattccttagccataacaactcactcaaactcactgacattgcccgatattctgcctcagcggttgagcgagacaccaccggttgcttcttgctcctccaagatactagattgccaccaacaaacacacaatagcctgaagttgatc

SEQ ID NO: 42448 - DNA, 1501 bp, Oryza sativa
gtgtgatcatagcaacacgccaacaaccattcctgactctgagctcacatggtaggcaacatatcctatgcacacaagccctcacgtgtacacacgtgcacaccaactaaaaaatgtcaccaaaaaatctagaaaaaatcatacatatactttcaattgtattacacctagggttaaaatcttaacgtcaaattcattatattttagccgtaacaaaaaaaaacaaaaaatctaacagttttaaggttacaattttgtcataattttatcttttttgttattctctatgtagaatgaatttgaagatgcgattttgcacgtagatgtaatactattgaaagtacatgtataaatttttctagaattttttgtgataatttttagttggtgtacacggtgtgtacacgtgagggcctgtgtgcataggatacgctccccacatggtaatgtcacactattttccttgtggaaacaccaagcgacgaagatgaccacaaggcgtgaccatttttttctaaaaagaagcctgaaaatgtggatgtagctcactgcattttttcttcgtttcgtcttgatattccgattagatcaggatttcacgtaatcacagttattttcttcgcaacaacaagaatgatgatggcatgacgaaaatgctagcggagttttgtaccttttctaccatgaattgagcatttctccaccccatttttatgtcatgccttgcgacctgtaggaaccgtatggcacacacgagcaaaagacttttaaaaaatccatctactccttttgtcattattgtcctctaatttcgttttgcactcgctttccaccgctacgctaccgcaaaagtaaaccaagccaaactgatcaagcccaggcatgcaatccggcgtgacatttttccaggtgcattctcgcgtgagcttagcaaagaaatatctcgtggcacctgtcacccctccgctgccgatccgacggctcgtacgacgccgttggtaggatcggacggcaaggggtggctccagagtccgctgcttccgctataaattggccccaagtgggggctccacgctacagagcagcagtctcgtctggagaagtggactagtggagtgtcgtgagttcttcgcttttgcttggctaaaatcgccgttagaaacttgtggaatcgagcaggtttaagaatttttctagtatccactctagatttgctttgttgtatgcttgaatcaaatttttttcgcttgatgatcaatttgagccaaaaacatgccgtttttctggtgattttttttctagcaactgctttgaaatttgtttcctgtttttttttctcaccaaagcaaatttgtaccaaatctcaccgaaattggcgatttagttgggcagttgatgccattgtttgtcgtcgaactatgcaatcccgatcgatttcgtgttcgtcgtctcgcctcctcgtgatccttctctccaccatgtgcagctcgccgcgcagcca

SEQ ID NO: 42449 - DNA, 1501 bp, Oryza sativa
cacaaatcttctttgccagctctgaaataataggagaagcagatctgtgagattatacagtaaatgacagtatggattaacaaggcaagagaaagtcaagaacagaagaatggggatcgatattgctactggagaaccacaatatggtgatgggagtatcacagctcctgtactgcatgctatcaagacatcactattccctcaaataagatgataagaatagtattctgaatatcattcaaaaagctagaggagcaaaccaggggttcctgaatcctgactagtgactacatggttaagatatcctttatttggttattcctagttctttttatccttcttacttaggtggattgctttctttctacctgttgctgtccatttcttttacattataaaaaaaatcaaataagaacaacatgttcatatatttgaatacccagctaaaattttaaaagattggctcatgccattgcacccgtagcaaagttttgcaaaatatcaacagaaaggtcgaatgtaaagtattactgcaaacgcataaattctggagaatagaatcgacatcacgttttccattcaccaaatctgccggtgtccgtttaaatgagagaagttttttcctcctggccttctttcaccccaactacgggtatgggcagacgattcatacgattgcagcaagatggtgttgacagagcacccacggccacggcatcaagcaagacattagagcgccgccgatgacaactcaagcaggaggggaggagaaggacaccatggacacatggccgcggtctggtgcgcgacgacgacccgtacgcatggtgcgacgggaagagattagaggacgggggggaggggggggggaacaattaaaggcggtcgaaagatgacctggatcgccgatcgcagccgtagacgacgacatcccgacgacggcgcggctcagacgatctttctctgcctggtgcggtgccaccgctcgagggctcgggctcgactcctccgccgcggcgcaactcacagcgccgttgtccgccggttccgcctacctcgtcaagctcctcggctgcgtgatgccagagacaggaatgggcgaatggctagtgtagattgtagaagagtttgtgctttgtagatggaatgagtgaatgacaggtagtacagagtttaacaagaaaaggcaaagaagaagaacagagtgagaatgaaatgtaacggatacgcaatcttccaaaaatgccctacttttgtgataatagtatgtttccatttatgcacgttagctgcattactactccatgcctcaaacatgtaatagtttccatttaaaaaacaaccagttgagatgaaactctaggtgtgaattgtacgtgggtgcactaatacatggacagatgaaccggatgagttcaaatgaatatcctcaaacatttctaagaaactttcaggaggctggtgtcttacaagactaccttgattgtcaggagaaccatgg

SEQ ID NO: 42450 - DNA, 1080 bp, Oryza sativa
ataagatataaatcacacttaaagtactataagtgataaaacaactcataaaaaaataaattataattacgtaaattttttgaataagacgaatggtcaaacatgtgagaaaaagtcaacgacgtcatctattaaaaaacggagggagtaattattttctgaaactaggctgacccttacatttttcttttgctattctgttcatacatttgtcaactagggggcctcacatgtacagatgccatctgtccagttcttctcatatctgcactttgatactaataagcaattatttgaaattatacttgtctggcacatgaattttttgcctttaggtaacattgttgcaaacttagtaccttgcatcaaagtattgcttgtttctactcctatgcctgaataaatgaatgcttacttactacatattcagagaccgaatacttcagaaaagttacaaatggtgccaaacaggaaggaatcaattaggccccgtttagttcgctaattttttttttccaaaaacatcacatcgaatctttgaacacatacatgaagcattagatgtaaataaatgaaaaaactaattacacagttagggaggaaatcgcgagacgaatcttttgagtctaattagtccatgattagctataagtgctacagtaactcacatgtgctaatgacgggttaattaggctcaaaagattcgtctcgcggtttccaggcgagttatgaaattagttttttcattcgtgtccaaaaacccctcccgacatctggtcaaacgtccgatgtgacacacaaaaattttcatttcctcaactaaacacacccttaggccttagctaggaattgaatcatctatacggattattttagttgtactatattttctaaaaaaaatattttagttgactattggaagactataattcttgacctatatatgctagatactggcctcatgcatgcatatgctaacattcctaggcaggtctgtatttccctctaggtcattataatgtgattaggtcaaaataaagtgacatcgtgtctatttttctttgctaaaggggtatttca

SEQ ID NO: 42451 - DNA, 1501 bp, Oryza sativa
tccaaaccaggaatataccattctaaaccaggagctaatcaaattattaccagttatagcatcatttattatggtaagaagtgtgagactaatcacgaaagacattgttagacctgcccatgaccgcgggcacggctattcaaatagttttactctggccagaggtgtaccactgtacccacaagacacaacccaccagcatgttaccgtgtccgcgcagacacgtcaccatgttgagtgattgtgacaagacccctcgcataactcaactcaaagcagtgcaccattcctggatcataatcacccccttataaacaaggcatggactccccagcgacccccgtgggcttatctccgccacttctcagtctagtgctccgtaatgagccttgttatacaaagtgtccagccgttgcccattctggcttgtggttggcacggttaatgtttcacaaccgaaaatcgtgaaccggtccttaattgtcatgagcactaccatcaaaaccatgtgctcacaacccaccattatcaagttttagttggcacattaattaattaaccaatcacgattgaccatcgtgagctatcattaaatatccatcattaagtaatagtgaaacattagttatcccaatcgtgtgctaatgtttctaagcatggctaagcaattatgtctaacatctagctgaaccaatatataaagctcaactagtcaaattataataacccaaggtatcaaggaatagagtaatcaatgcaaacaggccataacaaaggaacaggttcacaccacccagtgacattcaaaaataaatgcacagttgaaataaatagagaatttaaatataggatcaacatgctcaaaggaactgtgtttgggatctgtgtgacttgccttgcaatattcggtcttcaattaatcttcttgaatacttccaacgcactcgcggaccttcgaaacgacggaaacaacaagctaaaacgcaaaacgaggaaaacgactaagaaactccaaataaacaatacatataaagtaaacaaacatgtagatcataattttagatgaattatgagacttgaacggcctcactctgacttcatatgaatttattacgaattttacaagatttaacttaattaaagcccatttaaaaaggattaaataaatttaattcaatttatggataattttaatatgtagatctttattttatacaactttagagacttgaaccaactaaatccgagctaagatgaattaattatgaattttcaaagattaaataggattaaaacatttatatggattttaattgaattatgacgcaataaagaattatttttgaaaaggaaaagaggattattacgtcagcgggctcggctcacggtggaccgggtgcacagcggcggtctacggaacggacggccgagatctaccctatccaaaacgaacggccgagatcaacttgatctaccgcggttcacgggacatgggcaacga

SEQ ID NO: 42452 - DNA, 1501 bp, Oryza sativa
gtgaacgagccgcgttcatcatggttaattaaattgacgcgtctaagtagttactctctttatcccataatatagcagtctaatattaaataagaacattaaaaaaacataggataatatatatcatagtattataaatctgtaaaaaatattctagtactacgttcgggagagtctctctatccaaattcgttatacgaggaaccatttagtagggagtagaacaatagctactatatttatttcaaaacattttgggatggaggaaaaatagcagggcccatcatttatattattcggggaataagccaaagcatatttataaacgaaaaataatttgtatacgtgttcttagcgatttaaaagtaaaggctaaaaataaattttgataaaaaatcctcttaaaatcaactttaaatttaaagttgaaaaatttaaatttggactgataagtataagcataaacgaaaagacgaggctgtgagcttcctcttcacgcggcactcaatcgtggccgttgggagtgcacactgattatacaaactcaacgtatatgatagttcttcgagctacttagatggatgacatagtatgctagaacttcttttgtttactccctttctcttctccttgtagtaatttgttatcttctgcaagtggttcccctagtcaactggacatcatttgcatttgttttgttgttttgactcggcccggatccacgtacgtattcatattgctctagtcaatatcttggctgatgagctaggaaacaccaaaagttctgatatccaaccaacggtcaaagcagagaaatctgcacctgaatttcgtacaaagggaatatatatcatacaagtatgataaaagaataacaaaaccgatctgaagtgtgtaacatttggaatgccaaacaagtaaacaaccgccatatccgaatcaacacgcttataacgtcacatacaaaggcagcgtaaatacatacatttcttccacatattcaggctcttttttggggagaaaaggcattacacatttctacatcttcagacattttgtggattaggctttcgttttgttttatcacttgcatccaaatcttttataaactattatatgtttcagacccagctatcattaattattacaagtaatgtctactgtctgacctagagcactaattcagatgatgaacacgtgattttgcatacaaacgatgcatatttgcataatatatacacatctccttacacatctgattaactaatcttcaggctacttgatgaataagatagtgacatcttatatggttcttacgtttaatttaaagacttgctccgtttctctgcatatatatatctgttttcttgtcttgactgaagcatatgaccttgtcaacgataatttcgtcttttgtttttgtatctccgatccatactgctcaggccaagagtaatatactagtagtaccttggttgatgagatagaagtacccaaaact

SEQ ID NO: 42453 - DNA, 1501 bp, Oryza sativa
ggatctaaaattgacatcaagttcttgtttgatccaccgctattatcacaatatccgtccggtcagagctatcaacgatgaatcgataatttactatccatttttagctttttgaatggaagaaaagtaatgaaacctacaatggctattgaataacctcctttccatttttttatacgaaaccgtttggccattttttcttcgtctgccaaattttctttagttctacccaaactcagttttgtctcaatctttattgaagaagaaacggttttccagccgctaaatccaggtatcccacaaaatcattaaacctggctgttatttcggtaaaatacgctaaatcacaaattaatgaccaagtgaagactcgtgagaatatgaagcgtgctagtggcaaattcatggaaagtagtagcaacttatgtagtgccaactatttgaatgatttttttaagaaaaaaaaggacacagggatggggatggggtagtaatatacggaatgcagcccaagtcaacatcaggaagcaattcccagtctacaagccaacatcacaaatttacatccagttttgtagaaatgaaataaaaccgatctcgtgaacaacaaagcagtgcataaaaaaaggaagcataagtcagacattccttagttcttacatatctctcttacatcttgtaagatcaacgtgtgttttgattcttattctgtgatgaacaattggcatctgtgattattggttttgatatttggagattacagttgaagttgttttggagataattgattttcaagtgatgaacagggtttgctgttttgttgggaccggtcagaccggacggtagttgccggtcagaccggcttgtgttgagcggtcagaccggccggcccgcggtctgaccggccgacgctgtgtcggttttggtttcgggttgtttctttggatatccgtgattgtttcatggttatggcttctagatggatactatacgtatgtaatactgttgtttgctaacaatgagtcaagttggtgatagcttggtctcggaatatggtttctttgtttgtttcatgtgtaggtgattcgatgcctcgggagagtatttgcggtgatggaccgggagtcggcttggtggtaagacgatgtccgtggtggtcagatatcatgcgggatacttatgctagagttgatgcacgtggttggtgaagattccatatggcatatgatggaggtattgtgtgcgtgtgagatgcggagtcgaatttggaaggagtccaaatttggtatgattggttatgtaaagtttgtttcttatactatagggtttcctaaggtgtttaggacttctagtatgagtttggttcgtggctttaggctgcctacctcatgtataaatagagggggagagtgaagcttcccggtatcgcttttgagagcaattgagttgctagtttagttagggtttcaagtttagtcgagatttttgtaaggagtgctgt

SEQ ID NO: 42454 - DNA, 365 bp, Oryza sativa
ggggggggggaggaggaagaaggctgagcccccctctcttgtaaatgtagctccgccactggttgcatgtatccggtttctgatccctcgccgtcggttgttacgtacacctacgtgcatgcagttggaatttttatacttttgttatttcacttgcgatagatttttgagctcctgtctatcggtttttcgttcgtagcatcttacattaagattcgtgtccctgtatatctaacttacagttacactcacttacaatgcacttatgctcagctacaatgcatcaaacttatttttttacaattgtttctatctctagatttacatgtttgacatgtttgtttttttatttcatttaaaatagg

SEQ ID NO: 42455 - DNA, 384 bp, Oryza sativa
atagtgggtagtactcagtcttgctctctttcccccacaccagagctgaagatcttcctagtgggagctgtcttgtcgaagttggtttcgtcgttgctgtcaaggattgcctgtggaatggagttgccccgctgcagaagtcaagtttccaagtctagcttgttttatcttttccgctgcatttgtaatcttttatatttttgcaagacgtggatctgtatgtcaacaattgtcgtttgtgtaccctggctggtcctggacaggggtttaatacacattcagcttagaaattctggttcgtgaatttctgggcttgacaatcttccaagtgctgttgaagaacagagtctagattgagatcggctatcaaaaatgtggctgaca

SEQ ID NO: 42456 - DNA, 1501 bp, Oryza sativa
gcttgtgggtggccggatcgatgccgcgctggcgaagcttcttcttgatgtaagagttccagaagttcttgacctcgttgtccgtccgacccggcagctgagccgcaatctgagaccacctgattcaattcaagctgattaatttcctgtttgattgattaattagctagaaatcatccaagctataattaattaagagaagtagttaaattactagtatgataatctagtagtaatgtgtatatggatttgtttgagttaattacttgtttcctagcatggaatggagatggatgatgaggtcttcttcttcctgtgagaatgctcccctcttgaggtctggcctgaggtagtttatccacctcagcctgcagctcttcccacatctctcaaggcctaatgcaaccacaaattggaatttctaatgatatatatcaaattcaaactaccaattaattcctacctaaaaaggttcatttcagctcaattcagttaattaagtgacatgaaaatttcgtaattaagcacaattgcacaaatcatgcacagagagagtaactagtattatggcactaattaagctaaattacattgtccatctttgtagtagtactagtgctactagagctatgaactatgtatagttagatatagctagtgagtgtatatacctgcaagcttggggacggagctccagcagccatggccatacttggcaatgtggttcatcagcttctcgtcctcctccggcgaccacagccctctcctcagcttcttcctcgcgccgcccgcccgcttcgccatagatggccaccaccaccaccgtgctcaatgtcgcaattgccgccgacgacgaccgagagagaacaaaccaaaccgccggcgatgtcccgacgacgatggcgaagacgaagacgaaagcttgagctgggacagaggagagggggggggggggatgggagggggaagaagacgaggtataaaaggcgggagagagagagagagagagagagaggtgattgcgtgggcgggaggcgggaggtcgctctcaggtaggtggccattgtggtgtgcagagtgttacactctctctgatgagtgatgaagcatctcatctcatcatcttcttcttcttctcgaagactttctcttctcagctcaggtctccctaccttaagctctctcctctctctcgatcacttgctaatattttccaccacctttactaacttcaacctataatagtactcactttggtcataaatgtttgtcgtttaatttaagacaagatttaggtcctctttgaaacgcaggataagtaataggaaaaatgtaggaattaaaggggtaggaaatggaaagaggagcacattgattgcaccattggaaaaaaaattaaacccatgaaaagtttccaagaagtctaaccttttgtttatttttctatgaaattgatcatagaaatatgtaatcctacgaaaatattcatatcttgttccta

SEQ ID NO: 42457 - DNA, 304 bp, Oryza sativa
attcctgcagccctgctgccatgatagattaagttaggtagatctatgagatttctttaatggaccatgaattatctaagcacacgcatcagtacaatcacagtagggatttacctatatatcgtactgacagtgctagcagctaatccttgttcagatctgtgcaaaaaaaaattactcaatcttatcggctgtgcgaggtctcaaatcgggttaacttaattcaatcagtgactgacagaacccagttgcgaaatggagtgtgtaaaacagtagaatagtagcgtattccgtacttcaagaa

SEQ ID NO: 42458 - DNA, 1501 bp, Oryza sativa
gctgtttgggttttattgagatgactggttttaatacagtcattcactcggcatgttatatgcttatttttctggtgtgagtcatagcctaagctagttagactcatcacttgttatgttatcacatttatatcacgtttgatggatctttttgagagtttttactcggattcttatcaaatgtgtgaatttatggatctttagagtgtttttcactcgggccttttcatatcttcatttttggtatattaaagctaaaagcagtcggctggatgttttattgaacgccgcatatgctttgctatatgatattcagttgtcaaaccactctgttggatgtagtttgcatcttgactatatgtttagttttttaactaatcacatagtcgggggctacacctaattaggtgcatctagtcgatgcacccggtttttttctatttttagaccttcacagtctttgattttggtactcgggagatcaaggcagaagaagtcggagtactcggattatcattttgtgctacgagaagagattgtttcgtcgactgtaaaggtctcaggggctactgtggagattatggataccccatacctacacggcatgtatagtccgactaggtatggggtgccatgtatagaaagaatatctttaagaggactcggattaaattctaaacttgtatgtcaaggaaattgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggagatgcataattaatgcaagggggtacaaggggataataatataggggttaagttttgcagtaaacagcatttaaaagtcacttagttgcccaaagctattttgtaaacacgatcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcc

SEQ ID NO: 42459 - DNA, 1501 bp, Oryza sativa
cgccaccgccgccgccggtgagccgtctcccccccccctcacctcgcgcccaccgccgtcgccgcccggggaagcaaagagccgagagagagagatagaaagaagccgggagggagcagagaaaaagaaaagagaggaaaggaggaaggagccgggaggagagaaagaaaagaaaagagaaaagagagaaaaagaaagagaggagagaaaaagagggaaaatagaaaagaagaaaaggagaaaatagaagggaaattgggggagaaattaggaggatttaggaaataaaaatggtcggggttaatcgtagattatttttggaaattgctcgagcgtaatagtatttcggtcgaaattccgagttaattataaaaatatgtttcttgatcagattagattaaaattggtagtaatttagatataattaataactaaacaattagatgaattcttatagattattatagattatttttggtaatctctaaaagtcatcggttcacggtagaaattcggatttaattactagggattttagccgtgcattatatttaatcttttagtcatagactaaattaaatcatataatatttctaggatttcgtccgatatttagctcgtgatagaaatctctaacctattatatggatataatgctcgggtagattaaattaaaaacttatgacaacaaaatatttatacccgcaaaatagtttaagtcaaaattgggtttgccgtagttcgcagatagtaaagttaataaaaaggaatcgactttcacattcgactttcatttggatttatttggatttttatttgaattctaaccgaattcaaatcaatttttgcacgtaactatagagcccgagagagttgcggatccaagcgaaggccaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaacaatgtttacgtatgagtccctagtcaactatgacaattgcttagaaatgctattctagaatcatgcatactcatatttatcaaatgctatatgctggggcaattacctttgggaaggtaattgagatgcggcatgtggagacatgagcgccacattgccatgatgttgatgacatgatttgtgaaaggagaaataaaattaaataactgtttttgactggggcggacggaggatttgggtggtatctggaaaaggctagtaccgtccccggtcaattaagaaccgagccatgaagttaagcatgaaacaacccccgtacaaccgcacttcttgtatgggtatagacctagcggattagatagccgagcggaggcagtatccttgcatagatggttcacccctgagtgaggcaggtgcgctacgatgggacagccgttgaggt

SEQ ID NO: 42460 - DNA, 203 bp, Oryza sativa
tcctgcagcccagatcgacgcagctcagcctcgatcccaatcactgtcaagtcagcgtggcgactgatgaggagcaccactagcactgttccatttgtaagtactctgctagctactagcacaagcaaagcgatgcagggatcagctagggattcgtcagcttggccgtgctgataatataggaaatgcccttggtttacagg

SEQ ID NO: 42461 - DNA, 1501 bp, Oryza sativa
cgagaggaccgcgaagcttcgggtcgcaatggggcggctatgcagggcggccgggtagagagggaccagcctggggcatccaaagaccgtggcagcagcgtcctgcaaaccgaccgatgcaagaaggtaatgagggaaggtggcagcaggggatttccaaagagaaagcaacaaccatccggaaagcaaaggaggcaatgggggcgagttcgattggaggcagcaagcaagtaaagataggagatagggaggtgttggctgatcaagtagagaagaaggagctcgaaggaattgttctcgggctggaagaggagaaaatgtctatggatggtgacctcgaggaggaagaagtttataatgagggaggcaggcgtcacaaaactcagtccaaggccaagttttgttcaagatgttatcaaaaaggtcacattggctaaggatgttcaatagaaatatattgtgatatttgtgattcacatgaccacgtgcttaagcaaccaagaccagtggcacatgctgtcgggtacgctttggagggcctaggtttctatcatatccctcatcctccgttacttaaggggaagaaagaatcaaagatggctttggttgcttgcacaggggggcagcttacaaaggaacagatggcggcgcagttgtgtaagctttttccggcaaagtggaagtgggaactggttgagcatgatatcagctcttacttagttccctttccatcgagagctgatttgaagagagccattgcttttggtagggctgatgtgaaagaaagtggaatatcaaatggcatccgtttactttttgaggagtggtcggagaaagaggaaggctttcttttaccgaaagtgtgggttagggtgtttggctacgaaagaagatgagagagtttcttcctctttgggctgtgggatccttattaggggccacccaaacagttgatatgaaaacaacaaggaaaagtgagtttggaagggtgtttattgctgttttaaatccaaggattattccgaaaaatctggacgtagtgattggagatcattattttgagttgaaatttgaagtggagaaattgggggttgacgagaatggtgacgaggtggagatagaacaggaggaggatggggatcgagatgaggaggctgagaaggaggaggaacacggtgttgataaagaaatttcgagggaaaccaagagagctaaggggatgatatgcaagaggatgggaaggaaggggatgttgcagggaaaggaacgggagtggcagcaaatgatgatctcggcaactgcactttagagaaggacagagctgagatggcagcagaggaggttgttgaggcggcaatggaaaatgtgcttaataaggtttatgatgaggtgatggaagaagaagtcgttggacagggagtgggtatggaagagaacaacctttctgctgcaattgaaagaggagagaaagcaaaggaggaggagcaaatcttgatggctg

SEQ ID NO: 42462 - DNA, 1501 bp, Oryza sativa
cacgcacaacgccttgccaccagttcgtctcatattcagctaattcagtttctaagtgcaatgataatcatctaacttcaggcacaaatcaacccgatcaccattgtgcgttagggttaggatgcattcgggaacaaagacgtacgattctcttccttgtttgcccggtaagccagaaaatctctctctgcaaagtcagaaggccatggatcacggaatggtgctcggaattgcagagcacatcaaccatgtctatgtcggtcagggtgcggcggttcatgtgcagttttagtttgggcaaaaaaagaaaaaaggttatggaatgaagtacgccgcttatctttttgttcggaatgtttctaagctctgaactggtgctggaaaaccatggtagcttctgtttctttgttagtagttctctgtagtcctttcttgtacaagactttgctcctgttctaggctttctttcacacacagctaaagcaaattaccaatttttttaacaaaagaaactactaataccaagaaggatggaggcttgggcaaacttctatttattgctcgcaatctcaaatctttgaagaacatattaaatgttttactagaacacaaaataaaataaatacgggattttgtttatgagatttgtcttaaatgtatcagtgaaaacttatgttcttttacccaaaaatatattttgtgtaaaatcaaagtgtttttgattgttattctataataataattggcattggagattattggttttgatatttggaatttattttcgaattggttttggagatgattggattttacaagtgatctacaggtgctgttgttttgttgggtccggtctgaccgggcatgtgctgccggtcagaccggccagcccacggtctgaccgggcgactctgtgtcggtttcggtttcgggttgtttgtttggaattccgtgattgtttcataattatggcttctggatggatactatacgtatataatactgttgtttgctactaataagtcaagttagagagtgcttggtctcggaatatggtttctttgtttgtttcatgtgtagatgtcttgatggcttgggagagtattgctggtgatggattgggagtcggcttggggataagacgatgtccgtgatggtctgatatcatgcgggatacttaggctagagttcaatgcacgtggttggtaaagatttcatatggcatacgatagaggtattgtgtgcgtatgggatgcggagtcgaatttggaaggaggccaaatttggtatgattggagttaatttgtaaagtttgtttcttgcacaagaaggtttcctatgtggattaggacttctagtatgagtttggttcgtggctttaggcttcctacctcatgtataaattgagagggagcgtgaggcttcccggtatcacttttgagagcattgagttgatattttagttaggtgttcgagtttagtcgagatttttgtaaggagt

SEQ ID NO: 42463 - DNA, 1501 bp, Oryza sativa
actcctaactcacgtaagaaaccctctcttgcaagtatcgaactcatctctttccttatttcaatcaatcttaccgaattcggactcccttccaaattcaactcctctttccatacatacacaatccctcttgtataccatatgaatttcttcatcatgacgtgtgttgtcctctagcctttagtatcccacatgatctcttgatccctggacatcaacttctcccaagttgactccgatctatcaccggcaatactctcccgaagcctcaagcaatacctgcacatgcaacaaccaagaaaccatattccgagcacaagttcgtcccaacttgactcacattagtataataacagtatcaatacttatagaaaccatctagaagccaaatccccgaaggaaacatccaaattcaacaaaacaacccgaaatcgaacacgattaggatcatgcctgtcagaccgtcaggtcggccagtctgaccgccgcaacacttgcggtccgaccagtggcactcagccggtctgaccgccagggtcaaccgaaaactaccacttcacaaaaacaaccgtcttaaaaaaactccaaaataacattagcaaaccaccaatattttcatcacaaaatctaaatcaactctaggattttacaatctccccttgatgaaaatcattggaaaacaacaactggtttgtggtgttttgtgaagcaaatccaaaaagcatctcaatgccaaaaagtttcaaagaaaaatctctcacttttgaaaaaaaaagaaattccttctacttatgacaattatgcacaatttgttaccttgttctcccccttttgacaatgagttaatgaacatttctttttttcgaaaagctttgctataacaaaagtatttcaagaacatgtgttgcaataacaaggtagatagcatgacaatctagttaacaagcatgcatagaagtgtaaacatgaatctaagatattgtcaataagatcaaatcaacactaaagattcatgacttcaaatgatttataatgcaatatattcacaagcacataggttgaaaaataaacactatacatatatacctattgcatttatcactctttcccaaattagcttcagcacaaaacaatcaagagaaatttttaacttttatttgagcctttttgctcattttttctctgaattatgtcgggtacgtccttgtcattaagactgtttccaaggattcgacacccattatttttgttcgcatcaaatacatccttgttgtcaagactgatttcaagaattcggaattctttttttctcttatagatattttttattctcttgcacaatgagcaatttaaagctatttaaggaatagcaattcaataaagcatacacataagcattaacaaatcaaaccatatgctagcatcaatattgcatatttcgttaattcaagtgaaagattatgtatcatgtatcatatcacttaaaaacaatatcaaaagc

SEQ ID NO: 42464 - DNA, 1501 bp, Oryza sativa
gcattgggttgctttgtacttttgccagttgcagctgagactcttctcgcgcgcaagaagctaaactagctggcaaagaggacatcttcttggatgagtcatcatgcaagccaaatctctgtccaacaataaaaacatgaatgaatgttattgggcaagataccaaaacactacacatgtcatctctaactagtaaagctgtaattaggtgcacaggactcttcaatttgtggtgcgccatcgatggttccctgaataatgtgcaagtaatttctgaggaataggcatcatgtaatgaaatcgtgtaactgcatatataagggtgggtgtcaattgcaaacagttttacatgacagacaaaaatgcagttcaattacctgatttatcagtgcaagcgtgcagtaaggtggtgggaagtagagtgagaaatttgtactactagtaatgaaaacaaatctgaaattgcaggaacttactcctattaattggaccttgcactatctataagtttatgcagtgacattctgcggcataacattttttttgcaactgctaccagattagataagggcgacctgcgagaactgcacgattactggggagggaggacggcgatggaggcaatgtcataggccttgttcattcaaacaacatacaaataaggcgccgtgctccttttccacatccatcggccatcccaattgtaaaatcaaaggtgttttctttattattattctgtgatgaacaattgacaatggagattattggttttcatatttggaatttattcacgaagtggttttggagatgattggatttcacaggtgatcgcaggatttgtcattttatgtgaccggtcatacctggctctggtagccggttagaccggcgtgtatcgcgcggtcagaccggccgacattgtgtcggtttcggttttgggttgtttgtttggatatccgtgattatttcatgattatggcttctaaatggatactatacgtatgtaatactgttgtttactactaatgagtcaagttggagatagcttggtctcggaatatggttttctttgttcatttcatgtgtaggtgactcgatgcctcgggagagtatttgcggtgatggaccgagagtcggcttggggataagacgacgtccgtggtggacagagattatgcgggatacttaggctagagttgatgcacgtggttgatggagattccatatggcatatgatggaggtattgtgtgcgtatgggatgcggagtcgaatttggaaggagtccaaatttggtacgattgttatgtaaagtttctttcttgtactagagggtttcctaaggtgtttaggactcttagtatgagtttggttcgtggctttaggctgcctacctcgggtataaatagagggggagcgtgaggcttcccggtatcgcttttgagagtaattgagttgagtttagagttacggtttcgagtttagtcgaaattttgaaggagt

SEQ ID NO: 42465 - DNA, 1501 bp, Oryza sativa
caatgtcctcggcgctgcacgccgcccgtctcgccctccccaccacgtccgtcgcgcgcggtgcccgccgcgccctcccaggggaggactcgtcgcccgccgcttgcctgagcctagagagagagagggacgacgatgactacgtaggccgcatcctccaatgccctcctcggcgccacccgttgcctgctgtgccattcctgcgctctgccgtcgcctcccgcacgccgaccacccgtccacacgccactgccgctgcccactgcccgtcgacacacgcctgagagagagaaggagagggggaagagagataatgacaggtgggccctatattttcttttatttttttgttgattgaatttccacgtcagcgacatgtgtatgccatgtaggagaaaaaccgcttaggaatgattcgggggggggggggttaattcatctggtatcaatagttcgaggtgtaatatgtctagttttgtggttccggggggaggggtaattcatactgtcacagtagttcggagggtaattcgtactttttccttcataatataaggcctgcatgcatgcatggcaattaattatcatatcttctatcttacattattattttttaaatcatacactcacaagatgtttaattctattgggtgcatatattgtattagttggattgattcaaacaaagaggtgataataattgtttcttggtctttgggttaaatgtggttatgccttatattttggaatggagggagtatattttataacgaaaggttttaatcgatgtatgcatcgtgggagaatgtgtctatgatgtctttattgatatgatttaaattgtccttggtcttggtgtataaacttatatgatgattaatttgtaaagcagggatatgttttatcatggcagtcccaaccctccacctaggatattgtctatagcattaactacattgtcatgttggacttttatcttatgtggcactatattaattaagagagagagtgaagagaggaagaaattgggtctcatacaagacacagcttcaacacgagaacctatgcagtagacactatcaagttttgcattgggggagaatagtttcttcataatagataaagaataaatatgattggtagagaagagagatgatgtatttattaatggtccactttaagaaaccataagttatggagtgtaatttttattgtgatgtcttattgacatggtaccatatacactacctttaaacgctatggtttgggactgctctcatgtattatatccctcttttaacttccaagtagtcagcactcctagttcgcacaatttgattaggcatcgcaacgaaaaaaatgcgtattagccactcgcggcgcactatatagcgtgccgtcttatcccagcggtgcctcatcttatccccccgtctcctcgcttcctcctcccgcagctcacctcaactccggaagcgagagctcactccccccatcccca

SEQ ID NO: 42466 - DNA, 1501 bp, Oryza sativa
caaaattaaattttctaaattacaagcaaatcaaagctcatcgaagtatagctatggcattggcatcagacaagttcgtcctctccgccatcgtgctcgccgtcctcaccgtcgcggcagcggcggcgggctacggcggctacggcgacgtcggcgagtactgccgcgtggggaaggcggtgtcccggaacccggtcccatcgtgccggaactacatcgcgcggtggtgcgccgtcgccgggggccgcctggactccggcaagcagccgccgcggcagctcctggagccgtgctgccgggagctcgccgcagtgccgatgcagtgccggtgcgacgcgttgagcgtgctggtgcgtggcgtggtcacggaggagggcgaccgcgtcgccgggatgatctcgcagcacgcggcgcccgggtgcgacgccgcgacgatcgccgggatggcgagcgcgctgacggactacggccggtgcaacctgcagcacactggtttctttggctgccccatgtttgggggtggcatggattaacttccttagtaattaattaattaggcctttgcttaattaattatttaattagttatccgggttactggataattaattatcgatatttgctagtagcatctatcatgtttggatgctgctttctccgtgaatgtgatgataataataatcagaagaaataaataagaagagttggattcatcagctttccagtatcatcctcacaagcctcatggtcaagactatggaacctatacctgtcctgatggtgaagagagtgccactctgatgcatgcggtgcatatgcttagtgctatggatgcagtaagtgtggagcgagccaaagcagctcatgacagggaaaactggaatcgaggcaagatttgcaagttggagagcaaggtgtaccgtctacagaaggaattagctgaacttaaaggagaaacgccgccgccaacacccaagcttcgcctcactgcaagaaagagaacctgtccgccacctcgtctccagttagcttcgaagattcgcgtgatgggtgaagctgtgcccgatcgtgctgaacctgtcatcgacatcataagtgatgaggaagaggaggaagaccctgaagaaagagagccagctactccagaggaagaagatccatcgcttcgttccgacgcaaggcgggattagtcgcttagttagatcgttgccgtagttcactgtgattagattgtttgtttaagtttgcttgtgagtgtgtgggttttacttgttgcttacatcattggtgggatgtaacagcatgagtctagttcttttgcttgtcagagtgtaagatagttggtgagacagtgttaatgcaacttaaatgtaatcatacacagttaagagcaatatagaatttaaattaattaaataactccgttctaagggtgtctctctgtcgttctttcctgttgtctctgcttatcgtcagatggtgaacacgcgcactggaagtg

SEQ ID NO: 42467 - DNA, 1501 bp, Oryza sativa
gcgtggtagcccccggccaaccctgcacacccgagggggggggtccgggtttgcccgagcccaaaacgctgacacccgagccctccctcagggctagaagcgacgaaggtgttcgatgttccacgggttaggcagctcagtgccgtcgcccgtggccaaccgtatggagcccggcggggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcacgcggctcggagggccgcgcgcctccttcgctcttccaagtagtcgaggtcatctctgcgaagctgatcttgatcggcttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtaatcgccgaagagttcactagtgaattgggtgccattatccgtaataatacggttaggcactccaaaacgggccgtgatgcctttaatgaatttaagtgcagagtgcttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatctgcttggcgtgaaactgacacgctctgcatcgccggaccagatcaactgcatcattgagagctgtcggccaatagaatccttgacgaaaggccttgccaaccaaggtgcgcgaggcggaatgggctccgcactcgccttcatggatatcggcaagaagctcaacgccttgttcctgaggaatgcatttcaggaggattccgttagccgcgcgccgatagagggtcccttctaccagcacatagcgtttggaaatgcgttggacgcgttcactcccttcgcggtcctcaggtagagtcttatctgtgaggtatgcttggatctcagagatccatgcaatcaatctaagggagcttggagcgctcccttcgggtcccgaggcctggactccgacgggcctcgggggccgatcaggcgcatccgtctcccctaaggggtcgggtcgcgccgacggctgggtaagcctttcttcaaaggcgcccggtggggtctgggctcgcgaggacgcgagc

SEQ ID NO: 42468 - DNA, 773 bp, Oryza sativa
ttgggagcaaagaaagcaatatggaagaaaaacatatagcacctaagatttagctataggtgttcaacttctccatttaaaattcagattataacttaatagaagcaacatatatgtacatacaaatgaagtgaagtaaaattaatcatgccacaagtaacaattcctataaactaagacctaattcatgtcatgcagatgtagttactctcataaaacaacccatgaacatatagtactacaacaaacaattaaaaattaagacagttgcactattagggaagaagacttgatctaatgacaatatgtgcatactaaatgaagtgaagtgaagtgaaggatatatgagatgtagtgcgtggggctagagagtttacatctagtatttgcaatagaggggttccagcagtgcattgggttgctttgtacttttgccagttgcagctgagactcttctcgcgcgcaagaagctaaactagctggcaaagaggacatcttcttggatgagtcatcatgcaagccaaatctctgtccaacaataaaaacatgaatgaatgttattgggcaagataccaaaacactacacatgtcatctctaactagtaaagctgtaattaggtgcacaggactcttcaatttgtggtgcgccatcgatggttccctgaataatgtgcaagtaatttctgaggaataggcatcatgtaatgaaatcgtgtaactgcatatataagggtgggtgtcaattgcaaacagttttacatgacagacaaaaa

SEQ ID NO: 42469 - DNA, 1501 bp, Oryza sativa
cagctgatgaggcagacagaatgggtctcgtcaatgtagtagtaccagtgagtgcccgaggagtttacaactaatgcacagtctctaactctctatgactcatgccaggtgtttatgcactaaccgtatacattctttgtgcatatagctcgctgatttggagcgagaaacggtgaaatggtgccgaaaaatcttgaggaacagtccaacagccatccgggtgctgaaatctgcactcaatgcagctgatgatggccatgctggccttcaggtactagcaccattcatcgaaagccagagataaaactacagctcctttcttcctcctttgtaattgctgtagtaaaaaaacaatcctccttttgcctctttcctgaacatacttaccccttggatgcttgagtttattggaaccactgatgcaatcggcgcttctgctgcaggagctcggtggcaatgcgacactgatcttctatggaactgaagaggcaaaagaaggcaaaaatgcatacatggagcgacggcgccctgatttctcaaagttccctcggaagccttaaaagttgaacttgtgcactactagtacagatttctctacaattctgctgtatgtcatgacgcagactgaaatgctactcaaatctccgtttcctcgtcaactctgccggaagcataggtgggcgtcccaatgattgccagccccggtggacgggtgtagaagcgagatcgttatcctttacatgtcatttgttagttggcatttttataggtgtaaattgcagtgcttacgtatatgtgaatattcatcccgacatatcatagccgctggaaataaatggccttgtggtgcattagttatttgatcctataacaattggcctatatttatttttttgctggttgttttgtttgcttttcaatttattttaataactttttcaaggatatttatctgtaagaatttggatgtggcttgttgataagagtattctgtgtattcgagattctttcgtgaccccgtgagagatgagatgagcccatagaaaacgatagtttggtgacgtaaacctgcggctgaggcccagtagagaaaaccaaaaaggcccagtcctccttaatattatcctttgttgcgtcgcgtctctccacggccccgaatcgcctgcggcagccaacgcagcatccaccgtgtccccatcgcaagcgaacgccacaccaagtcgccacgtacccaacacacgctacgcatccaccgagtcggggcgcacgggatccccgtctcccccgcgccgcacaaaataacgaaattaaaaaaaagataataaataatattattaaaataacaagaaagcacagccacaattcaccacctcctcctcctcccctctcgccgggttaaacaacgaggaaaacctaacctaatcgggaaaaaatatcggaggaatccagaagcggggggctcccaccttgttggcgacgatgctgcgcgcgggagggaggc

SEQ ID NO: 42470 - DNA, 1501 bp, Oryza sativa
acccgtgacctagacgtccggacggttcggtgaccagtccggttttttctactatggtgcaacatttaacgaagtaatcgacggtgtgtcttacacataacagagcaactagcagtgtgtcttagcttattgatgttgtgtcccacacataatggaacaaccgacggtgtgtgccacatttaacggagtaatcgatggtgtgtcttacacataacggagcaactaacaatgtgtccgcgtataacggagcaactgacggtgtgtcccacacacaacggagcaactcacggtatgtctcccacacatactggagcaaaaagacaagtgtagagcgttatgacgcaaagacgctcgtagtatcacgccgaaatattttcacgttctaaataggaaaaagaaagagaaaagataatagttatgcatgaatttttaagttttagtgagatatcttaggccagttagctcattgacggtgcgccccacgcatgccagagcaagagacaagagatagctcattgacggtgcgccctacgcatactagagcaagagacaagagaaacggtgttacaaggcacaaaggtagtcatagtactacatcgaagtacgttcatgttttacaaaaggaaaaaggggaagagaaaaggtagaacaatgtgtagaactttctaagttttagtcacatactaggtcagttggctcattgacggtgtgttccacgcgagacagagcgttacaaggcataaatgcactcgttgtactacattggaaaccgtgagatgtagcttcctatttaagcctcgactgaccggtggaacctagctggcagatagtgatgttagtcacgtttcttgggccagtgtcctggttagcttattgacgttgtgtcccacacgtaacggaacaaccgatggtgtgtgccacacataacagagtaatcgacggtgtcttacacataatagagcaactcatagtgtttctgcatataacggagcaactgagggtgtgtcctacgcataacagagcaactaacggtgtgtcccacacacaacggagcagctcatggtatgtctcacgcataccaaagcaactgacggcatgccccacacataccagagcaaagggacaagagatagagcgttatgatgcaaagacgctcgtagtatcacgtcggaatattttcacgttctaaataggaaaagggaagagaaaaggtaatacgttatgcagaacttttaagttttaatcacatatctcgggccagttagctcattaacggtacgccccacgcatgccagagcaagaggcaagtgtaggatcaaggaggccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaatagcacaaatgtaaa

SEQ ID NO: 42471 - DNA, 278 bp, Oryza sativa
caccctagaataaacaaaaccccaactagtggacactctactcctggtatcactagtatgattttaggtagatgctacgctgtttaattaggtaacattaggtggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggt

SEQ ID NO: 42472 - DNA, 1501 bp, Oryza sativa
cattccacaacatatttccattttcaaccacaaataaagacccttgatctaggagtatgacggatgatcttcttgagtccatatttctgactttgcaatatatatgatgcaagtatgtcaccagtttatccctaccaagctccacataacagccttagaatagggatgaattctggcatactttgccttggagaggatccaaaaagaaaatatacatctttgagagacaagagagaaaagtcaatatgaggaaaagagctagtttgcgaaaattcataaaaaccccacgagtctaacagagaagcaagaaggactggaatcaagatcattccatttatcaattactcaagatggtaagatagccactgataaaattcacaggtataggtatgggtgtgaatgatttatatgcttgattcatctcttgaagaaattcattctacactgacctttactcagggacgagcaaagtgctaagtgtggggggttttgttggcggctgttaaatgtcgattctataccgccaacgtctgcataaagttcggataataaaacatccaacatagtgataggtgcttaatctcacgtattccacaagtgttggtgtatatttgtatgcagatgataaaccctgaagttgggaggaaaatcagactaaagtgaggagaattatgtatccatacaaggagggtttgtgaacttcatcaaaacattagtgaatcaacccaaaactccgagaaatggatagacgaaggatcggggaatccaccgaccgaaggccaggccaggagggcccagcccaggttcaccgttgatcctggggtttggcgtggacgctccagatcactccctgatggcggttgcggggtacttcggacatttccccttcgccaacagtcatacctacctctatataaaggcttcactccctcacttcacacacacacttctaagcttaagctgaattataagaggctctattgtactataatattgtatactataataggaagagagtagagtagaaggagtcggaagaattccggagttgtcggtaatcttctcctatttcttttattctgtttattattctgaattcaatataatattcttcttgagtaatttagatttatcttgtgagaattacctcttggttagttcctaattagcatacgggattattgttcgctataatcaactaaaatatagtgattgctttggtgagttataaacactaaagtagatattaattgcttagacgtggtgtttaggtaattattatccaataattgctgcgtatcccacagtacgttgaggtgggtgtagaggtggtgacagccctcgagagcacttaagtcctccctgtctgggtacgtagtagagcgacatctaggaacagcgggttgccagtgcctgaagtattgcgttaggattaaaattaagctttccctagacactgtttctcactagtaaatcctctctatcctggcctatcattttc

SEQ ID NO: 42473 - DNA, 746 bp, Oryza sativa
gctagggaacacaagaactaaagtggaatggctaaagaatgagctggggtcgagttggctaaatataacggctaggtgacgtcatctagccgttactcacatatttgaactggagggttgccaggaggttccgggcctgggtgccaggaacttccgggtaacacttaggaaaattttcaacctcacctcagcgccaggaagttctggacagaacctccgggtgggactctctgtcccaagtagagccattttcaaaaacagctcctaaaaatatttcaacacttggacactactaagagcacttgtgttatctcagaaccacacttggaacccctcttaatagaacggcttttcctaaattcaaagcgaaaaagtaaactagtctaactcggccccgagtcttctcgccgctttgattttgatgatttgggggggtctccaagcatcctagcccactcctaagcaacctgggactaatacaccactaggaatgtcatcttcttgcttcaccttgagggttctcaacgtcaacgccatttcactattaagactattctcacctacactcattaagcatattagtcccaaatcaattatatctttgccttgatcaatgcccactttggattttgacttgatgttcatcgaagaaccacatcctcttgatcctcggcattccatcttgcggtcttcttataattgatacggattactcataacttcaaatggcctcgcacggtccatca

SEQ ID NO: 42474 - DNA, 1501 bp, Oryza sativa
gggacccagggtcgggttgccagttcggtctgaatcatcgtaggccttgggttaaggcaggttcgtgtgggctcacggccttgattaataatattgtatagctctaggaccgtgtttacaaaatagctttgagcaactaagtgacttttaatgctgtttactgcaaaccctaaccctttatattataactcccttgtattcccttgcatttattctgcgcttgtgggtgtgtcttgttgagtacggtggttgtactcagtcttgcacaattttccccaaactcagaagaggagttcctggaagatgaaggctttggtgtctagctcgtgcctgccgtcaagcacctgtggtcgtcgccctagtcttccgctgtttgtcgtttgtcttctggtgtgctgggccttcgccgcccatgtaataaattaactatttacgcttccgcttgttaaactctgaactgtgtcaacttttggtgtaccttgcctcctgggacaaggaataatgcacgcacgtaagacacgccgccaccctcgccttggcctctcgtcgccggtagagccctagcgccgtgtagcctagcgccgccgtcgccgccgttcgtccagccgtgcgccgccgccactccggtcgtcgtcgtcgctcggggaggtcaccatcgtgatcgccaagccgtcgccgacctcgtccgcccctccaccatcgctgtcgaccgccggaacaacgtcgccgtcgtcaagccgaaggtcgccgccgcttcttcctcgacgccgtcgccgtccgttgatcctccgccgttgttttggtcaccggtgagttcgccgcgtcgccctctacgtgttggttccctccgttcgcgctgtcgtgccgtcgttcgctcgcgagcatgcacgcccgagccgccgccggtggtgacgtcaccgctgacgtcatcgttgtcattccccgtggcccggtcatggaccgatggatcttggccgtccgttttggatgaatcgatctcggccgttcgtttccgtgagccgccgccgtgcacccggttcaccgcgaaccctagccgctgacgcaataattcccttttccttttcaaaaataattcattattgcgtcataattcaattaaaatctaaataaatgatttaatctaatttaatctttgaaaattcataactaattcatcttagctcggatttagttggttcaagtctctaaatttttctaaaattgagatctacatgttaaaaatatccacatgtactgttcatgcttgtttatgtgctgtttggtgattttgcccctttctatttagattccgacatttccggagagtccgttttcgcaggagaagaatttgaagagttccaaggccagcaaggcaagtcacgcagatcccaaacaaccctttgagcaggttgaacctgtttaaagctattgatttatttcaacttatgcattgttttcgaatgtcattgggtggtgagcctttcccatttaattatggccg

SEQ ID NO: 42475 - DNA, 1501 bp, Oryza sativa
tcctgacttttttcgtagatcatatgattgtatatacatatacaacataaccaccctcccaagcataagcgtacattgagaataaggagtggcgcatatagagcagcggtaccttgtaacttggttcttggtactctttcaaggttcctgttctatgaggaaacattgtaaacattgcaggctcactgataatgtccacatggcctctttaacatagcactaaaccttacattcaattctggcttaactgaaatatcaataatgttgaaggtcctactaggttgattagcattgtttggtttgcggtccttaatttatctgaaaatagatttgctcttgttaactccgcagtgtgtttgatagttgacatttcctagtggaggcacataattcacatcgttaggcatggacctatgtacaagattctgtgaacagcaaaaataaactgaaattagctagtacatggatttctgctcttgtcaagccttttccatctttttgatgtgccaaaatgatgacaggtctacatttggaaaaggcacctggagacgccaataaaggtcttatacggtcattcacttactgtaaattgtgtgagctggaatcctgctaagccacatatgctggcttcggcaagtgatgaccgcacagttcggatttggctagcacacaaaggctcacatcgcacacggttgacggcttgatgtggaaagttttgtatgttttccttgtaaatatatagttgtacatcttgactgtagtagtgtagtgtgcacagagcagttgagattttttttccccgtagagcttttagctacttcagaggtaaactttgaacaggcagaggcccagaagtagcagtatacttcatatatatgcctgtctcggattaaagttttgctcgtctactctgtaaagaatcaaagatgcatcagaattcagaaccttgtatatttttgtgagttgctactcattggtattgatatgtctggatgactggatggattcctcctgcttgtgtagattcagtgctgatgaacgtgttttgcaattctgtttctagttggcaatgctttggtttttggtttgggaattgaaatgccatttcccaaggattgaaatggtgtatgtaacttaaagaatatgctgatgcagctgcactgggaattgttgtccttgcagaaatcaggtattttgtttcgtttagcagctacggctttgtgaactctggctccatgctgtcacctgccattgcaagtttgcaacaagggaagcaacgacagctttcaaatctgtggtgaaaatagacgtggtagcaactagcaactctaatttcagttgcctgatttatattcatgattaacaactttataaaacataatcagacataaagacacattattatactccagcaaaatcagatccacttaactagtcaacccataaacacgattacaatactccaccaaatcgatggttcgagactaattcgcagaaaccc

SEQ ID NO: 42476 - DNA, 1501 bp, Oryza sativa
tgcagcaggctgagggctgccgccgctgccggcagagctggaagggagcacgccaccgggacttgctacccagccaccggatcaagtagcaaaagctacggagcacgccgccgggggtctcgccgtttggccgctgtcgccactgcatcggattcctccatacatgcgaagagggtggcacggggacgacggtgctcgccggcggcgtgaatatcctctctctctctctctctcctcggcttacaactcggctcaagcgtatgtatcccctcctcctctgtgctcgacgacgcctctacacggtgctgctcgacatccaccagccatgcgtgtgcatcgtaagattttcgtctacgtcctgctgtttgccggtctttgcttcctccataatagcagcatctttgcttccttgtgcttgccggtctttgcttcctccataacagcaccatctttgcttccttgccagtcggagcagcaggctgagcttggcggtggacaaggagatcgatgaacaagagagaagatatggagtgagatgggagatgaaggaagaagaagagggtagtttaatttagtcctaaaaaaatagaaaatgtagagaaaagctatgtagtggcatagctctaatatttgtgaaattataatgatacggttacaaataggtaaatatgaatggtatatttcaaaaccattaaatttataatagcatgatccaaatatccaattaacccaaaaaagtatgctacaagcacatgcgttgacccaacaagttgggagtccttgcgcaagttaaaaattaattctttgaatctcgaggccaaccgatggtcaataatttgaaagttttaggatagaaaaaaaaactatcaatagttttctagcaattctgaattgaaaggagtcttggtagaaaatgaaaaacaagctttgcaagttgttgtaggaacacaccggacatgctgcggaagggtgtttggtttgccgcgttttagtttcactcatgaaaatcagcctcccaagtgagtctaacccattgtaaacacgagaattgaccttctctcctaatccaaatttaagctcgtgcaggcatggtggtggtaggtgcaacatgggtgcacaaggtgagaggagagggctcatgcacctccccctcctacatttgattccatgcgcaccgattcactgtcatcttcattgatgcacgctcattgtcattgttcctccctcatcatatagctgccgtctttgcctccttggcacctgtcctgcttgcccgcccagctagatctaacttggattaaaacctccacgagccttgtcgaatacactcatgtaggagtgtctcgtatctataatattgaaatttaactacacaattatgccaatgtgagtattaattttttttagaaaagagtattaggtggttctaaggacttatatcgaagaaaacattttttcagtgattgctttgcccctccctaaaaaagaccttaggaccaaa

SEQ ID NO: 42477 - DNA, 1501 bp, Oryza sativa
aaaatgttctttttagttctaaatttttaaattttgagatggaggtggtacatagtttcattttacattagggaatattaaaataagtttcattttgcacgaggtggtgcatcatatcattgaaaagaaatctagtaaaatatgaggaaaattataaaaccctttgaatttagactatgtttgatgaagatttattcaaaatttatgaaacgtcatggaaatcatatatatattatgatgtatcatgttaagtgaaacttaaatcaatggacacaggtgcaaagtaaaagcatgtcctaaacctagtgtaaagtgaaacaacatacactttatctggtgcaaaatacaacttactcttattttaatggtttactttggtcctaaggtcttttttagggaggggcaaagcaatcactgaaaaaatgttttcttcgatataagtccttagaaccacctaatactcttttctaaaaaaaattaatactcacattggcataattgtgtagttaaatttcaatattatagatacgagacactcctacatgagtgtattcgacaaggctcgtggaggttttaatccaagttagatctagctgggcgggcaagcaggacaggtgccaaggaggcaaagacggcagctatatgatgagggaggaacaatgacaatgagcgtgcatcaatgaagatgacagtgaatcggtgcgcatggaatcaaatgtaggagggggaggtgcatgagccctctcctctcaccttgtgcacccatgttgcacctaccaccaccatgcctgcacgagcttaaatttggattaggagagaaggtcaattctcgtgtttacaatgggttagactcacttgggaggctgattttcatgagtgaaactaaaacgcggcaaaccaaacacccttccgcagcatgtccggtgtgttcctacaacaacttgcaaagcttgtttttcattttctaccaagactcctttcaattcagaattgctagaaaactattgatagtttttttttctatcctaaaactttcaaattattgaccatcggttggcctcgagattcaaagaattaatttttaacttgcgcaaggactcccaacttgttgggtcaacgcatgtgcttgtagcatacttttttgggttaattggatatttggatcatgctattataaatttaatggttttgaaatataccattcatatttacctatttgtaaccgtatcattataatttcacaaatattagagctatgccactacatagcttttctctacattttctatttttttaggactaaattaaactaccctcttcttcttccttcatctcccatctcactccatatcttctctcttgttcatcgatctccttgtccaccgccaagctcagcctgctgctccgactggcaaggaagcaaagatggtgctgttatggaggaagcaaagaccggcaagcacaaggaagcaaagatgctgctattatggaggaagcaaag

SEQ ID NO: 42478 - DNA, 1501 bp, Oryza sativa
gcctcgcctcggccgcgagatcgccggtcgctaccgccgccgccgccgccgctcgccgactcgcggtgggagagggaggagaatgagttggggggggggggggggggaggggtgtggagggttagggttttgataaggccgtgggccgaccggaagggacggaaataagtctattttgggtccctcgggccggaaataagtctatattaggtccctcaggccgaaaaaaaaacagagaagttcatttttagtgcttaattttttcagaagcatttacaattatagttattaaatgtgtttatttctaagcaaacctaaaaggaaggattttctttctttttccaattaaataattattaaataatatttgtattattaaaattagcaattaagttctgaaaattccaaatagcgtaactaatcatggagagtttaataaaattaaatttaacaatgtcattttatttctcgcacttgctttacttgtaaatttatttaattatacacatacctacttaaaaataccaaatatttcagtgaatttgtgttttaattaatttgcatatttttactgatctgtgcgcttcccagtgcaacgcacgggcacttttgctaaaccaaacaacaattttggtcaatatacacactccgtaatcacccggtgcaacgcacgggcacttttgctagtaaaaataaaaatcagagccgcgcggcgtagtcggtaaatactcgtcttctatccggtttccactcgccgccgccgccgcccctctcgctggacgccgccggcggacgatggcgctggcgtccagctcgctgccggatctccggatatacgagccatgctgtgttggtgggtacccgtcgcccgatgaaaaatctgcttgcaaatcgcatttgctgcgcaagatcgaggccttctacccaaaggcgttccagcggatcagccaccaccacgccgccgccgcctctgcttaggcctcctcgggttggtctccaacatcgtcatcaacactctcaccccctcctcctccgcgatgcccgatccccaggcgaccacgcaggagcttgcggcgcggccgctcgacggcatgaaggccttcctcgtccgcttgttccccgacttgagggagtggtaggccgtgcgctacctgttcgtcgccggcgccgacctcctcgtcgccgccaccgcggtcccggcggacatgggcatgaagaagaggaggagattactcggggacgacgacgacgacttcgccctcaacgaaggcctctacatggcgctcgagtgcggagctctcaccgctggccaccccgacgccgaccgcctcgtccgcgcctggctcgccgtatcccgccgccgccatgcactcgtccgcaggctcgtcgggctgcttgaagactcatacggcgatggcagtgatggagacggctcgtcgtggccgtggaaccgcgcggctcatcgtcactgtcctctcggtgtcgagaaaagaaggagagt

SEQ ID NO: 42479 - DNA, 1501 bp, Oryza sativa; identical to SEQ ID NO: 42466

SEQ ID NO: 42480 - DNA, 1501 bp, Oryza sativa
catgctaatttgcttgcccacgttgagtgggaatttttttcatgttttataatttatatatgttttagacttctagtccacaatttatgtacttcatgttcctgagcctctagtatggctgatagcagactaggtgctgagtgctgtccttttttgcagactgaagagagaagaaatacaagactgtccattgttagtcagatttgtaaaaatagactctgatgtagtttacttttgcccctattttatttttaacaatacaaatatataacagatcctaagaacttatcttaatttaggagaagttgctcgtttcattaaattaaattgtgaagtaaaaatgtgtgctcgagtctgtcaatgcaatcctgtgttcttgtttgaagatatggtgtagggcaggccaggattgaacactgaatggtaagactgcttctgccttcagacgttattgctaaatttttagctacttgcagttagtgctgccacgccgattaagcagtagaacaaagtagttttgtcgtgcacaaatgagttatatttcattggaaatcgaagcgaaaacgaatcaaaagttagaagaaaaggggaaacttggtaattactccataaagagagtgcattttattggtaagatggtatccggaagctgtgagctccgggctgtatgtattctggcaaatttgatatgagatgctcgattattggcttaagttagcgatatcaaatttggggaagcaccaaaggaattattgtgaaggagttatgggtgcgtgacgttatctgctaggttcaaatccttgtggctatgaatatttatctgctaggttcaaatcctagtgactatgaatattaatgggtaaggtaagggatttattgttaattttagtttctttaagattgtgccatcggacgccattcggtaactgtaataatgctttgtattggattcacttgtgttacatgcacgcactaaacatgtgctttaccttttcatctgtttttgcgttctgggctagaaactcaaacgttgaattttccatggtctgctcaacttgacaattactgcgtgtcaagcgatcttatacgcatactatgcgcacaagtgattgtatacggatatgatgacagtataacgtgtgatattgatttttttaataaaaaaatgatgttcctttccttgatgaaggaacaaagactttttttaaaagaagggtattactaaaaacaaaaatgacaaaaacaaaatatcagtgcacatggcaagtgtgctcggcaattttttctctgtactttaaacaaaaatacttctatatgttcttttttataagggtggcacaaatcttttaaatgagccaaatatctacattggatttattaaaaactgtataaattataatttatactctgaaaggttgtgtgcatctctcttggagaaaatgtataagttgcaaacaaacattaatccacgttatgtaactttttttcgccggaaaggccg

SEQ ID NO: 42481 - DNA, 1501 bp, Oryza sativa
ataatgattcccgtaaaacaaaacgtgcatcaaacaaggcatgatcttctgttaatttgtcatatgtatagcccatcttgacatgttaatacatacccatgtatatagcccaccaccttgaccttgaatactatcttatgcatgcaacagaccatgatgtgtgatgacacttgctattgtccatgtaactccaattcttcttcggtcgttactttggaagaccgcacacgctatctctactgcgtaagtaatatttggattttttgcattgatctatctttatatgtcaagtggtatgcgatgcaaaatatatcctgatgtaaagtgggatatgatgcgaaacatgtctcgatgtattgctaggagtgcctcgtgttactcactctttaggagatgtctatgatgtaaagtggaaaatgatgcgacacatatcttgatgtgttgctaagagtgcctctagttgtcactctctctataggagatgtacctatgtactcactcagcatcctattacattatttggacgattttgcatgccgttccaccccatgcaatgtggatgcatctaatgtatgttgctccattgtatgcggtgtgaacgcatcctgatgctaacaaagacttcggttctcactctgtaaaccatatcatctactactccatacatcttgacatgttgcaatcactagtgaaatctttttttttttgccatggatgctccttctatgccataatacttcacaaagtttgtcaaatagtgattacattatattatgttccccatgctttatttataaaataaagagtaactagaatggtggcctacgcaaattacttgccaccttgacctatgaatacttttttatgtatgtcgcagaccatgatgtgtgatgatgctcactagtgtccatgtgaactccagttctccggtcatcactttgcaagactacaactgctatctctactacgtaagatatttgtattttttttccgtattagtttgctctttctatgtatgtcaagtgttatacaatgcgaaacgtatcttgatgtattgctaggactacctccaggtgtcactcacactgtacgagatgtatctatgtgcacgctcaacatcctactacataacttggtcggttttgcatgcagctctgccctatgtgttgcagacgcattctagtgtgttctatatcctatatgttgctccaccgtatgtggtgtgaatggctcctaaagttttgttagaaaagactccagtcgtcactccgtaacccctttgtctactactccatgtaggagatacatttttgtactcgttatgcatcatcttataatttggacgatttcacatgttgcttctttttctctacgtatcttaaggcatcttttgaaacggagaaatcacaagagaacttcatgggatctaaactagtttctaaaaaaatgaaaatgcatgtgttctaaagagctctaaatagtggagcaatatttggtaaaa

SEQ ID NO: 42482 - DNA, 1501 bp, Oryza sativa
gtatggaagttttggatgttgacataatttttggtggtttaactggattataattacccccttataccatgggaaatgacatagtttgcgcccatccacacgaccaagtaattggacttagcctagtattgtcccactatatgaaagactgttgggtagctcattaggagcagttttttggggtgaatcatgcgtaaggtgtttgggcggcatgattcacaacagtgggcttcatgaaagtgtgacgatatagtaaccttgcctaggcctggcaagagttcaaccactatgatgaaccaagaccccactgtgcagtaactagtagtaagtgggactctcgaacggctatggtgtttacagcctttgcaaattgttctcatcgtgtgggtaaagctaggcaaacactacatagtcgtaccgtattcgaatacaccatgctcccgattaaggagatatgtcataagggtgattcctactcctgaagtataagtagttttaaaaaataaattttgaggataagaatgatatatgattttattactcctttatttactcattgtttcatttattcatatctcttcacctttaattatttataatatgtcttgctgagtacataagtacccactcttgcataatttaacatatagagaattgtgctaataagaagaccagaagatagcgaggtctacagcaacaacaagtttttctaggatagtctagcttttgcttgtggagttcattagttgtagtttagtagtttaggagtttggattttccttgtattttcaagtaaggatgtattagtgtggatctcttcaacctttaacaattgtataattaggttgtataaacaaatttgtataattaattgaaagctgttttgtatatcaatctgtgcgtgatcgaaatcctagacgatcacgagtggatatttggggcaccaggcctaaattgggtgtccccacaaaacatagccaaaaagaaagctacgagcccgtccacgatttgagtgcctaaaaacgtgctaagactgtaaatacaatggccaaaagaactcaagtatgaatatgtgacggaacatgttgaacatagaagtcaaagggacggttaaacatatactgttcttttgggtatatggcgccgttgagtttttaacaaacatttgactattaattttaataaaaaaatttgtgtagatataaaaatatttaagtcaggcttaaagaacatttagtaaaatcaagtcataataaaataaatactacctccgtcccaaaatgtaagcatttttgtcacaccccaatccggcaccgccgcacaacggcacctgataggagcgtgtcgtaggaaaaatggcgcgaaccgcttcctacgaaaccgcgatctcggtaccagtcccaggacatagtgctggtacccacggtgacaaatatgaatcattgcaaatccttaaaatagatagaggacttatttaccttaacttaggttgcagctcaga

SEQ ID NO: 42483 - DNA, 1501 bp, Oryza sativa; identical to SEQ ID NO: 16678

SEQ ID NO: 42484 - DNA, 1501 bp, Oryza sativa
tagtccggtggttcaccggaccggcagcggctacgccttcgggcgtcgtaacctccttggggcgctgtcaagggttaccctctccccttcttgatgagtttctctgggtgaaaaccacatctttttagatggacgatggcagcatcctacatgtcgtgaccaccttggtggcatcgttttcgaagtctcatctatgtgttgctgccgtaggcctagcggcgtttggtcacacttagtggcggtcgtttggtgctaggcttcaccctcagtggtttgtgcttgggggtagtgtatggtgtgtggtcatgcaccttggtgcattgtggtgttttttcttgtaacttttactccttaatacattcggatggccttgtcgatgacatgggatcaggagtatcatgactagaggtttgaggcagacacaatcgcccacgtggcctggcaccctcgggggacgtcgggcccgagggtgatgtgttcgccctcctcttagtccccccgagggggtcggaccgcacccgcctcggccccgagggccgaggcgccccgacccctcgtgggtttttgctccgcgtgtatgggttaggtgagcacagcggggctcacctaaccacatttattgcggtttggctgagcgtgtcacgcggcatgtaacgaagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcctagagatggcacgttagtcctggttagatatatgccaggcttcatcctaaccattacaggcaagatgttgtgtgaagaagggccaacatgtagattgctaaactgacgcgtggtggacaggaatgagcaatttgtgaccagtctgacactggtcatgtcgtcagcagacagccataatcccacgtcgcacctgctttcggcggaagtggaggtaggtatgggccgtcctatcagaaggtcattcggacggcaactatacaaatctccgtccatttatgaaaaggtagggtaagtccccacagaaaggagggagatggtgcatgtggtatccccttaagatataaaaggaggaccttgcccacttagagggggggactggactggacttttccagattcggaacccagaacaagggagaggctggctcatactttgtagctccttcatacacagatccccccaaaacacaggagtagggtattacgcttctcagcggcccgaacctgtatacatcgcccgtgtcttatgctctttcgacggtcgcgaaccttccacatacagagagcttagaatttcaccctgagtccccggccgaaccggcaaaggggggcctgcgcggtctcccggtgaggagccccacgctccgtcatctggcgcgccaggtaggggactcagtgtgtgtttttc

SEQ ID NO: 42485 - DNA, 594 bp, Oryza sativa
agagaaacatgatggattaataaatgatggaagcagaataagctcaggcagcttcagagttaatcaaaatgaacaaaaactagcagcttagataggcatgcactcaaccagtgtgggcacacaatattctcagagtcaagtcctaaatcgcaagttaagaaagagttgtgcctggagtgctaagccaagagggtaagaggttagatacttagaaactccctttttacctctatctgttgtaagagaacatttaattacgtagccaacatgttggcttgatttggtgctgtacttcaactgggagttatcaataacttaactcggtaccagattgtgtctctcatctcaagggtagtgataaaggtattacacaaagtttcaaatgtgacagcagacaatcttacagtgggagcacactagcattttaagggttaaaagtcccagccggaatgttttctccagttgagaaataaaacatcctgttactattcaaacttgaaacaagttcaaattttccttatttatgtgaaattttgcaaacaggcttcctggatgggaagtacaattatggtgacacctcacacctcagacatg

SEQ ID NO: 42486 - DNA, 1501 bp, Oryza sativa
atgcagtggcagcttgcaagcccagggctccaataagctaatttaaccagtcagtcaaagagatctgcgcatgcataatgcatcatgcgtaagtacgattagttaacacattaaacattatcaagaagtagtatgtaaaaaccacagtatatttcatattaatgaacgttactgtattaattatatacggatttttgtatttgatgaactaaacaacaaagggtgtgttccccgtaaagaaaatgtattgtaacttaatttctccggccagtgaactagcattatacgcttttatatagtagtattttcggctgtatctttattgacttacatgtatattcagggttggactttgaacacgagtctacgccgtatttgtcttttgtgccggggaaaaataaacgttcggtgagttggtgcacaccttgcgctgtggcctttaatgcttttgaccttctagtatgttgtctggttctctgatgcctatcaggatttggccatatatgcgtaataattctaatatcccaacacaaaaggttatagtcaaaattaaattacatatactgcatgattgatccatccacttgtgcccatcacatgtaaaatagtactataggaaaattcagcaagctaaggctggaaaaggcacaaagaaaacaaaatctaccagccacaagctaggtagacatgtgtaacagtccaagcatatatcgatatctttcttactcacgcaacaaccatcagctgatcataatgaagagaatagtgagtatatcgcatgcacgatctcacatataaatatagctccaaattgaagagatgcaattgggcaccctctggtagtacaagattgagggtacgtacctgccaattgaatgaggccgtgagaatctgctgttggttaaaagctgcacaagattttgtttttctcctttcaaagttgcgtccatgaccatgaatctagttatcttggatcgattagtatatatacatatggtccagaggtgtccttggctactccttgttgactaaactgctattagtagtaaattaaacaatatggcatcaagcaagtgagataatgcttgcatgtatgcatgcccctctgcagatgatgaatctaagtctctaaagtacaatcgcatgcacagtacaagaagattttgccttaccagaattaacgggatatggtcaccactcgcccaaagtgtagtatatatttttctctcggttccgagcctttaattaaagaaaggacatttctgtcacatgtgtttcaaagtaaaagctacaattgtttttagccagttcttatctagctagggaattagatactccaaaaatccttgggtttgagatcatgtacttgtgtaattaatctggctggacacagtacgtaattctgtaaccagttgaaatgtttgacttcttactcgtacaaaccaacttgataatcaaacatttcaaattggtttacacgtgtaaattaattgcgtgtgaa

SEQ ID NO: 42487 - DNA, 1501 bp, Oryza sativa
ttgtctgggggaaaatatcaagaatatcatatatttctccctgaaaaatacaagtcctttatagaatctttgagctgctgaagcattttgcagctttgaaattctgtgttggaattcttttctcctacagtccgattagaggagggatcttctctgtatgtgtaaatagcgaggtatgtatgtcacctctccgaattattttgactgtggttcctggactgtaaacaagctattatcttctggtgttgatgccagaaaaaacacaaaagtttgtcgttatctctactaacggatcataaaggggtttgtaactggagtttcaaacttaaggtatctaggcagtaggtatatattgatcctacatcttatgatcttaagatgatatccttctcattatcctctgctgaaactttagcttgaaccgtcatctacaccacaatttgagccccttagcacagagcacaacgagcaatagcttgcccttacgttcattatttagcatgcactactactaactacccaataatcaatacatcggttattaaactgtttgtacagtttaataatgtcattttatcacgttaacatatgtttcattcaacaccacaccggttttggcacagttgcaaacttgcaataacatttttactacttctccgccccataatataacaatctcgttccatactatattgctatattacgggacggatgaagtacttctttccttccaaaatataagaatctagtactagattagatattatttggattcacgaatttgattaggctatctagatttgtagtcgtatgtaatgtctaattcggtaataggttattacctctttggatggagggagtagtttttatttcgtactccctctgtttcatattataagttgttttgacttttttcttagtcaaattttattgagtttgactaaatttatagaaaaaaaattagcaacatttaagcaccacattagtttcattaaatgtagcatggaatatatttttataatatgtttgtttttttattaaaatgctactatatttttctataaatgtagccaaatttaaagaagtttgattacgaaaaaaaatcaaaatgacatataatatgaaactgaggatgtagcagactatagcaaatttaaactatgcttttattttagagcatcaccaaaagagatagcctaaatcttatcttaactaattaaaatattcataattttcctttcgtcacattaaattttcgtccgtaaatccgattgaaatccaactagacaatccaaaaaatagagaaaaagaacagaaaaaataataaaaagcacacaaatcttatctcaatcccgcgggaagctgccgatgccgccgaatccgctcgagcgccgccgccgccgctcacggggaacgatgtcgctgctatcgcacgtggtatgggagggcgccgccgccgctgcttgggagataggatatggagagagaaggaaatgtgagg

SEQ ID NO: 42488 - DNA, 1501 bp, Oryza sativa
ttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgccctcgcagccgctgacaggtgggtcccacctgtcaggcccgtcgtctttctcgggccgaaaccctagtttcgcgccgccgagctgccgtcgccgccgctttccaatccggccgctcctttccgtttccggctgaattgatagaggggaaatgatctccgggatctcctctaccttttctcctttggaaacttcggctaaatcggtttggaaatcgatggattcgagttcgaatcggatcggctttcctctctccaagccgcgagtttccttcgccgttgccgtcgccgtgggccttcgccgccgcccccgagcccctttaaaaggatccccgtgctcttctcttctcgccgccaccctcgccttcgcctctcgtcgccggagtagccctagcgccgtgtgccctagctttgccttcgccgccgccgctccagccgtgcgccgccgtcgttccagccgtcgccgtcgctcgggaaggtcgccgtcgtcgtcgccaagtcgtcgccgtcctcgtccgctctttcgctgccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtccgctacccgttggtgtcctccgttcgtgccgtagcgccgccgttcgccggtgagcgtgcgccgctcgagtcgtctgcctcgccgagccgccgccgccgtcggtgacgtcattgctggcgtcatcaaggccgtccgccgtgaaccgccgtggacccgatcaatctcggccgtccgatttggatcggatcaatctcggccgtccgttcgcgtgaaccgccgcccgtgcgcccggtccacccaaaccctagccgctgacgcaataaatccccttttccttttcaaaaataattcattattgcgtcataattcaattttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaat

SEQ ID NO: 42489 - DNA, 891 bp, Oryza sativa
tttgcaaatgggaccctattatgccatccttggttatccgggcccctggcttatttgctgcgtggcttgctgagtatgtcatatactcaccttgcaatcattcatcagaggaagagttctacattgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcctttaatggttctcattcaaaatttattccagtgttattagtactgtacatctattactgtactaatggctcatttactagcaaaagttttacaatactgttttatttaatcttgctgcaataaaataaatttagtatgttgattttataactttcttttgaaaccagttattcaaaattacaaaatttgtgacctcgtttccaaatgttttaatttatttcgcaaagcttggtttactttatttacttacctttttactctgattttctaactttattcaaattaatccaaaaacttgtgctattaattggataaaggtcttaactccctcctttcacttgtctttaga

SEQ ID NO: 42490 - DNA, 926 bp, Oryza sativa
taaccacatttattgcggtttggctgagcgtgtcacgccgcatgtaacgcagtgcagtgcactcatttatccggtctgtgaccagtcacagaccggtcaggtcgtgggttaggtggcgacaggcgatctgacgcacgcctcgccccatcccgtcaggacgagggcttctaggcgctcgtccccagctggagctagcgtgttacctcccagagatggcacgttagtcctagtcagatatatgctaggcttcatcctaaccattacaggcaagatgttgtgtgaagaagggcgaacatgcagattgttaaactgacacgtggtggacaagaatgaccgatttgtgaccggtctgacaatggtcatgtcatcagcagacagccatcttcccacgtcgcgcctgcctccggcggaagtggaggtaggtatgggccgtcccgtcagaagatcattcggacaatggcgatgcaaatctccgtccattaataaagaaaagtcaaattggagggagagatggggcatgtggtatccccttgagatataaaaggaggaccttgcccactttgagaggggacgggacttttccagattgggaacccagaacgagggagaggctggctcatactttgtagttccttcatacacgaatccaccaaaacacaggagtagggtattacgcttctcagcggcccgaacctgtatacatcgccggcgtcttgtatggttcctgtctcgcgaaccttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctcttgcactctttcgtgtgcgccaagcttttcctattcagcctca

SEQ ID NO: 42491 - DNA, 924 bp, Oryza sativa
aagcatgttatttccatcaatatccctcctaatcattactggagttgcctttctggctttctttattattcgtcgattattttatcagtcctccttctattcgactattacttttgttctcgccgtggctgccttgttcatagagctatggcaaataatctctggtgtgtgttctaactggactaagctggccttgctccaataccatatcaaaaggaatggccatcaccgatgttgtctcatccagaaagcactagccatggtgctgcgcttccgtgctgtgcagcggttcaacgacaaaatggggcagaactcggtgctgcagcctcgtcggttccacaatcctccaatagtgttgccaaagaagatggttcatcgtgcaagccttcacaaatccgccaatgtcccaacacaagtgaaggctgctgtcttagcggcactaaagagaagtaatggacggctcagcaatggcgtggcagccattcagcgtagcacactgcgtgatactgtcatctggtcttgccaaggagatcacatcgtcactgccaatgtcatcctcgtgtggcacatcggcacaagcctttttgagatgaagtacctgcggatcaaatcttctccacggactgctgatatgatcaccgccacccatttgtcgcagtattgcgcatacctagtggccgccgtccccgagcttcttccgaacgacgctacatggaccaaggcgcactgcaaggaggtggcgagagacatcaagaaagctctcgatggagaaggaaatgactttaatcattttgtcgatgctcttggtgcgagctgcaggcacaaagttttgcagcaagggtcaaagctggcgaaacaactggtaggagaagttggaaggctcgaagacggagaaggagagaccaaaggcgtaggcgaggcagc

SEQ ID NO: 42492 - DNA, 1501 bp, Oryza sativa
agttaaccgggaccgaggcggcgatcatggtcttggtctggttcaagatgttgacgacgtgattagcttgattgagtgtgtcttccttgaggagggtgtcgaggagggtgatcgctgcaaccgcgttctgttgaggggtgcgaaaaaccgcagttccctcgacgtcttgctgcccgataagctctcgtgctcgtcgcccggcgtccaaggcccgttgtcgtcggtcctcagcctcctttgcagcccgttcgcgttcctgttgttcacgctgcagccgttctcgctcttgtgcttggcgctcctcttctagtcggtgtcgttcggcttcctgttgtacgcgtagctcttctgtttctcgggctttgcgctattcttccatctcgttgtcagccatgaagatgccgaagtagagaggcgtgtagttgtcttcaaagccttcgtcgaagtcgttgaggttgcggtagtcatagcggtagccgaagtcgtcgtactccacgatctccgttggtcgcgagtcgacgccgggggagctgaggtagccgtccagttgtttcgtcgaaaccgtgccgagtggctggagtatgacgccgacttccctggagctaggccgaaccggggctgaagccggatcccgcctaggcctacggggagaagacgcccttgtggtgaagacagcagccaaatcatcggggagtttcatcaggattggcggataggccccattgtcttgatcgggtcattttgaagtagattggatctcgtccaagtggtttgaagtcaactcggtagagatgatcttggggtagatctcgggcgagttcgggataccgaacggagcggagatctggcctcttcccgactggttcgaatccgagttgaggagagaaatcttgccgaagtcgttggtgatgaagtcgaggctgccgaaacgaaacgcctgcccaggagggaagatgaagtcgtcgatgccggaaacgaaacccatcgcactagtcggcgaagaacttgacgctacccctacctggcgcgccaactgtcgaaacaagatttcggcaatactaaaaggggtggctatcaagctggaaaagcggatgggtttagagacaaggaattttatacaggttcaggccttcttaatcaagaagtaataccctactcctgtccggggattgatccaccgagtgtattattgatcgtatgatctgggaggaaatcgtgcccctagaggcactcagacccctccttatataggggaaggggtccgtattacaaaataccgtccatatccctaacggaatatgtagttacaaataaaatacaatcatgaccgactaggatctcggatatttccttgacatacaagtttagaatttaacccgagttctcttaaagatattctatctatacatggcaccccatacccagtcggactatacatgccgtgtaggtatggggtatccataatctccacagattctataagatccattcctttgattca

SEQ ID NO: 42493 - DNA, 1202 bp, Oryza sativa
atggcgcggcggccccaggcggcgcggggctcccagtcggcggtgtggcggccctcgactgcgatgtggtgcttccaggtgacggcgcggcggctccaggcgtcggcgcgtcggcggtagtctctcaggcgacgggaggcgaggaggtggcaagcggccggcacaaggggtggtgcgggggctgcatgcgccggtacggtggtcacaggggccggcgaggaggtcactggcagcggcataatagtcccagcaggtggcccatccctctcaggggggtccattttccttcttttgtttggcttcatttgaagaatctgcactacactgatgtgaatgagatattgtggtggaattatagatggattggagcacagtgaaggggagcatgaacatgaggggatggattcatcttggattccggatgggtatgtctttcatcttatgccctatgagtaatatacttgtattagggagtcagagcagttacatttttcacatttttcttctcacacatcgacgatgtgttcatcaacagaatggacccatcttctacttatttacttgacgtgagaataatgggcaagacatgtaggcctgaatttccgggtggtttttctttcaaatggcctattgatgcagacgtaactaacttcaaagattttctgggtgatatttgtgaaaaaatccatgggctttaaatgaaactgaatgtttgcattatattcatgctagtagcaaagaactcattccaatatgcaaagatcaggacttgacagcaatgtttgagtgctttcatcatactaaaaggggtaaagtggtaatcactctgggaaaccaaattaatctgtcccaagttattgtgccttgcactccatcactttcagtcccctctcaggcattttttactcaggaaggcagcactagtcaggcatccaaaagtgatgcatacctagaaaatccattcccgcactatgagcatgtaggtgtagatgatgagaaacaatactcagttggtattgatgactcttcatcggagagtgatgactcttcatctgagagtgatgactctattgctgaaactgataatgtgcctgaggtagaagggggagatgatctgagtatcactgatagtgatgatgaagagtggattgcacgagatgctcaggcagatccagtaatcccacaagttgcatatgacaaag

SEQ ID NO: 42494 - DNA, 1501 bp, Oryza sativa
cattgtgaatgatctcaaggggcttggggcaaactacaccgatcttgaggttgcccaaaagatgcttagagccctaccggagaagtatgagacccttgtcactatgcttatcaactccgacatgtcaagaatgacacccgcaagcctcttggggaagatcaacaccaatgacatgtacaagttgaagaagaaggagatggaggaagcctcaccttccaagaagtgtattgctctccaagccgaagttgaagacaagagcaagagcaaggtgaatgaagtcaataaggacttggaggaagagatggtccttcttgctagaaggttcaatgatctcttgggaaggagaaaggagagaggaaggggctccaactccaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagattgaggccttcattggggaatgagactcaaatgaggagagtgattgatgattgtgatgatgtttcctatgatgagcttgtgagtatgtttgaggagctccatgcttatagtgagaaggagattgtcaagttcaaggccctaaagaaggatcatgcttctttggaggtcttgtatgagaagctaaagacctctcatgagagactcaccattcctcatgagaagcttaagtaagctcatgacaacctcctttccactactcaacatggagctcacattgatgttggcatatcttgtgatttgcttgatgatagtgctacttgccatattgctcatgttgcatcatctaacatttctacctcttgtgatgatcttatggatatgcctagccctagctctagctctagctcttgtgtttctatttgtgatgcctcacttgttgttgagaacaatgagcttaaggagcaagtggctaagctcaacaagagtttggagagatgcttcaagggtaagaacactcttgacaagattttgagtgagcaacggtgcatccttaacaaggagggacttggattcattccaaagaagggtaagaaaccttctcacagtgccactcgttttgtcaagagtaatggtaagtattgctccaagtgtcgtgaagttgggcatttggtaagtgattgccccggtgataagcctcctaagacatgcatgttcgattctcattatatgcttaggaaggctcataatggtagtattgttgctagatatgtgggttcccctatactcggtggtaaaaagaatgccatttgggtgcccaaagctttggtctctaacctccaaggaccaaaacaagtttgggtacctaaaagagcttgatcttcttttgtaggtgaactaccgcaccggtgggagccattgggtgcttgatagtggatgcactcaacaca

SEQ ID NO: 42495 - DNA, 1501 bp, Oryza sativa
tgattcagctgtacgttccattcgctctggctgctgtaactgcagttctgcgtggtttctgctcatgctcagcacaggctactgctgttgcatctcatgccccaactgctcggaagaaaaggctctagatcagatgtaagtttacaacatatgtcctaaaagagatcagatgtaagtatcactagatgcaagatgcacacccaaaagagaattgatgcacacacttgtacagtttaccagtaccattcactatattccgattcactcggatgtattccgatccaatcaatagaaccaggtaatatgatttatggaaggaatatgcaagggcatcgctgttgcattagaaagagacctcgaggatgtagattggttaagccatggtttggcaaaagcctcataccaaagtttacagtgatcctttcaatcaaataaataatgaaatggagttttttttagataatgaaatggagttggttttaatgcatttgttcaaatttatagttggtcttattctttgggatgtagaaatggaaagaaaacactgtaataggacatttgagtatcataggaattggatggaattccccatgattcctacgggaattaggaatacagagaaataccaaaggaggtccctatcatggtgacttcatggattcgctatgaagatggctgtcatgctcaatgccaaggctggtggtgtaacatgggtgctggtacctttagatggattggctccttccacggccatggtcaccatacctaggcccccatcatttggcttttttcctaataagccaaaacgaataaaaatgaatttgtaggtaaaacttttatatatgtattcttggtaacttaaaatccaatgctgaaaaagaacctacattgaaaatatctcaaaattaagtttgaaaatttaaattttggcttattctttggttgtttaggccatccgacgggagcggcagccatcagttatggtgttggcacccaattgcctattggtgaccttaaagatagttggaccatacatgagggcaaacaaagtaatctctcgttttaagttgtcattttatttgtttttttttcaaatcgatgtattatgattcaatgttaaagagttactacatttgcctcaagcagcttacaaagtaatctcttgttttaagttagtaccattttatttgttttttcaaatggccgtcttaacttaagatacaatgttaaagggttactattacatttgcctcaagcagctttggagcttggtggttcccagccttcagtccagagaaccctttgctcaagtcctgagctgttaatagttactgctccttccgtccctaaatattttatgccgttgactttttaaaacatgtttgaccgttcgtcttattcaaaaaaatttaagtaattattaattcttttcatatcatttgattcattgttaaatatacttttatgtatacatatagttttacatatttaacaaaagttt

SEQ ID NO: 42496 - DNA, 1115 bp, Oryza sativa
ggctttgtatgacaagtgggtcccactttttttaaaaaaaaaagaaaatgctgactggattgctacgtgtacgccacgtaggacaaaaccgctctggattggatcgagggggtaattcgtccggtattgaaagtttgggatgaaaaatgtctggttttcgggttcgggggtgtaattcggtcgaccgcaaaagttcagggggtaattcatactttttccttttttctttcctttccttcgccgcaaagcactccaacgccgccgccccgatctcttccctccggcggccgccatgtcatcggcggcgaacgaattacttgttcagaccgaagagatgctgcagaaggaggcgaaatggatggcttaagtcaagctaattttagatatttattattttgtgtatttgagaggagcaatacctgtactttattatagcatagcaagggacggcttgttcttagatgatattgtggatgcatgttgattaatttttttctaataactctatcgctcttttcctaactatctgttctatgtaccattgatgaagcatatattgtgtcgctgtcatttggttgtttcatttgtaatattagttgtcaccgtagcgttagcacgggcatactcctagtgaggaggaagaggatttgcttcgccgcgtcaccgggggaggtgtcacgttgagattcctgctggggctggggttgggttgagattccccaggcgcccgcggcggcctcgatctgggcggcgcagatcagaggacggcgcggatcggcgagcttcgcactgggcacgtgtgcctgtgtgtgggagtcaggcctcgcagccgccgctgctgctgctgctgctgctgcacctgtcagctagggcgggcatggcgcgccgcgccgcttcccgcgctgttggctcggagggctcgatccaagggcgagggggccgcgcggggggcaatggcgccgaggacgcacgccacgtgttcgacgaattgcttcggcgtggcaagggcgccacgatctacggcttgaaccgcgccctcgacgacgtcgcgcgtcacagccccgcggccgccgtgtcccgctacaaccgcatggcccgagccggcgccgacgagg

SEQ ID NO: 42497 - DNA, 1501 bp, Oryza sativa
gctctcgccgggatggggttggagaaggcaccggccgccggtgccgggaaggaagtggaagaagaaaggggagagaaagagagggaagggagagagggaggagaaagaaggaaggtgaaagagaggactgacatgtgggcctcacatgtcaatgggtccacatttctttttgtgtgaatgagtaatgggtcacgcacatttttttatcggaatcgctagtgctctcgcacatttttttatcggaatcgctagtgctctgttgacaaaaaaaaaaatagggtgctaaatctttcacttttttgaccattcatctctgtttacaattagtgctgcatttggattgagcaaagtcatacacggctgtggactttgagatggaccgagcttttgttgttgcattatgtggactttgttgttgcgttctgtgggtctcacatatttaccgttcaatttcgaaacacacgcctgctttttttccttgcatttgagcagtgttttctactgctactttgcttatgatccacgcttactaattacatcgtgcttacattataattacatatgtaattttgtgacttacatcgtaaatatactaaaattacatatgtaattttatgacttacatcataaatacactaaaattacatatgtaattacatatgtaattttaggaacttacaatgtaaatacatgccaactttttttttaatagttactccctaaatttaaatagatgagattaaatttatcctatggcttgaaaaatttgcatgatagggggctagaaaatctatcgcatgatgtataggcagtccctttttttatttctaatgccacgttaacgccacgtggaaagaagaccgagtcaatactgtcacgtaggcgtcacgtcagcgaaaccactcttcaaaatcgtccagggagtcaaattgcaccggttttaagagtttgggagtcgagatatccggttttatggtttttatggtttagggatacgaattagatttcgatcacttttaagggtcatgaagtgaacttattccttgcaggggctgtatcaagcagctgaacaggcccatatctcatccgttcccagatactggtccttcaaccgcgatccacggcgagaccaaacaaaaccggcccatccatccacgcacaactcactcgaaccatctcgatcgaccccaaccgaaacagcgaccaacatacacccaaaaaaaaaaatcagcgcacatagaggagataaaaacgacgagaaacaataataataaaaaataaatatcccgttgaggggaaatccagcccgcgaaaccccattggccgggccatcgccagctcggcgccacgtggcactcctccccctatcgccttatcgccacctggtataaaacgcccgcctaatctccttcgctctcttcttcttctagcttagaaccccaaccccccaaagcctcactcacttcgctgcagaggaaaaaaaagagagaaaaatctccga

SEQ ID NO: 42498 - DNA, 1501 bp, Oryza sativa
ttcttacctggagtgagtcagctcgagcgaattcaaccccgagtcgcgcccccaccctccaaacctccctcgtcgaccgtccgcgcgcgcgcgaccaccaccggagaggaggctaccgcgcgaggtcgccgacgagagacacagagagagaagaggagcacctcgccgcccgcgcctcccgcccttctcgccggccgcgcgctcgggggggaaggcgacgcggagtcgcctcgcctccgggggctcgcgcagcacaacgcagacggagaaggggggagagagagagagagaaagagagtagaggggagaggagaagagagagagagagaagcattagagggaggggggtaggggtatttccgtcactccacgggaaaaaccgccttcgacgcgggggttgtgaggggcagggatgtcattttggcggggagacggaggggggaggttgcgtgtcacggttggttagcaagcggggtgtgtggatggacggtccggatgagaggtttgtggtgatgggggtggcatctcggccgttgatgttatgggcgaccgtggtctgagtcatcggtccacgagcccatcacgtcaccggagagggacggagaaagggaaacgtggttacgcttcttctgtatctgtagcaaagtagtagaagtaatttcttttttcgaataagaaaagtaaaagtaatttcgctgcatgtttaaaggagtattattatactgtaatctgtgtgaacttcaccttaatctgtgtgtaattactgtgtactgcagctacggctccacttcactagatcgtgtgtattcgtgtgtggtatagtttaccctgacacgcatgcacgatccggcccaaatataagacggcccgcgcgactcgacggaatcacgcccaattatacagtgggcctcacgttggtcgctaataccgctccggcccagttaccgaaggccgcacgggtgccgtgatcccgttcaggcctatttagttgcgaggaaaaagtacaccaaatcaacttgtcatcgagctacaaaattatcccccaactaaaaaaaccagatatatctggttccggtatctggtttgtttagatgagggacgtccggtatctggttttatggttgggggatgattttgtaactcgatgacaagtttagggaccttcggtgtacttttttcttagttgcgatccagttccagcctatagttgctacgggccgaaacgttgcgtgtgtgggccaggctcccaggtcaacttcgtcaggcctttgttacgaggaaaattaccgttcctggttttaacagcgtttgtgcaatctagagatgtgataattgaaaatttttactcgtactcttaactatcacacatatctataaaattttcatattcaaatttattatactttagccataataaaataaaaaaataacagttttaagagtaaaattttattcaaatttagtcttgtgagctaaaatattataaatttgaagataaaat

SEQ ID NO: 42499 - DNA, 1501 bp, Oryza sativa
tttctctctaactgtgcaattagttttttcatttatctatatttaatgcttcatgcatatgtccaaagattcgatgtgatgtttttgggaaactaaacggggccacattgagcgcacatcacatccaatcaaaagaggagcctgaacagttgaagcaaagcttgctgtgaggaaatgcaacaaaagaaaatattcaacattgcagcaaaactgttagtacacaaaacatgctatggtacctatgattgtgcccacagatactgaactgtgagcggtactccgattaagacatctccccatcgcccacttcaagcatgccaggatctgcaattgatgttcaacagcatctgttgatcggttcgaagctctcaaatggttgagcagaacacattcatctcaaattcttaccgttccatccaccaggtccagcataggcaggcagcccatttgtcgttttcgtctgcacaagatgtcatactgaaataacagcgcaatcatgatcagtactacctccttttcacaatataagtcattctaacattttccacatttatattagtgttagtgaatctagatagatatatatgtttagatttattaatatcaatataaatatgagaaatgttagaatgacttacattgtgaaacgagggagtactgaaaaactcaagtattatgtaaatgatactacagagaagatgagcagaacctgccccagttgtcagtgatgtcatcagttgttctccggcttgttaaccatgtagcaagattttcttatcccctgtacagaaaaggcatggggccctagggaatcaacaatgcttcgttgttccttcgacccagccaatgattttacagcaagccaaacatttacagagtgacaacataatattactgtaggtcttcatggcatttctcattctagtgtactattcattagacatgaaaacatttagccagcagtacgatgcataaggctcacaaagttttgcagcacacgtattgcttctataaacaaatgtacaaaagaatggaatctttactctttcctccactaaaaagtccttgattgtataaccaagggagagtgatatctactacaatatgaaaaaaagcaccaaaccacactgcgttggcacatgaagaaaagaacaataccgcagaagattcacacttctgaggtatttgaagattaatcaaaatgaatagatgaatggcaaaagcgcagagaaaaacagcattatagaagaagctgctctgaatgagatacggccacatgaggcgatataattgaaatgtttttcaaacataattcgaataggatcacacaaaaagagaattaacgagatcaggaaggtaacaagtcataaatagtagaaatccgaatcgcttttagcacaaacagagagtaacatgaagcgttcgggttagctagccaagatcattcacatttaggatcacaactactatgacaagtactatgccaatcagaatcaaatca

SEQ ID NO: 42500 - DNA, 1501 bp, Oryza sativa
agcaatcccctctaatgtaccatcttctattatatactaaaagtcgtccatgaaacttcctacaaacgctctcaaaccgccacgtggcgctctaataaaatagagaaaatcctagaaattctaaaaaaaaaatcaaaacatctatcccttgattttcatttaaattggtgggtccaatattatacaccgttagataaaattgatcttaaaacaaactaaataccatgggtcccacctatcctcccctcccacacattggcaggtggagtatatacgtacttacacgtacgcttccacccccccccccctctttccttttttcttcttttttccatttatatatataatggatatattttttaaataatcataattttacaaacaaaaaatctaccatcatataacttaagccgatgtactcattactttactattattttcaaataatgcactattttaaaataagttttacacaattatatcgtgtacctatcaaataaacaatatctatattaactaatttatacgggcactccattatataaatcatcagatctactttttattacattggtctattattctcatgtaatgcactgtttcaaaataaagcctacaccattatattgtgtacccattaaattaacaatttaaaaagtacacgatgtaatcatcggatctattatttgctaataaataaagcgtcaaaaattctctttttgcccgttgcataatgcacgtctgcacttttacctttcgcacgtgtgacaaagcatagtgtctgagacatttaaggtgatcacaaccgctatagcactaccgctttgccacatatcaaatcatatatggagatgattaattttgttaataacatgaaaagaaaattaaaggtgtgatgcagcgagagaataattaagcaccatgtgttgtgtttttctcaacactaattagctctgtttaagttgaaaccgagagttgattacataacaattataatgtatttgtgttatgtcgtatttagattttgtactatttgttcgtacatgtgaaaggaatcattatgttataaatgtgagcgcaatattaacgaatatcaatagaactcttactacgacaagggtgataaagggagtttaaggccctctcttttttttccgattccatattttggatttttgtttgcactctttccaagtttctaaatggtgtcttctttacacaacattctaactttttagaagtcaattcattcatttataccctcaaatagctatcacataaattatataattcatcaatttcaactgtcctaaaccttaagtactacatatttttttcatgcgagccatggtgatcagtaaattggtgatcaacggatcatcaaagtcgtaagatgaatatataagagttactctgaacaattgtaaataggtgtcaaaattaattgctattaattagacatctaatggcttgctagccacaaaattaatttctctctaca

SEQ ID NO: 42501 - DNA, 1501 bp, Oryza sativa
aatggagcagttttacaatatttaaactaaaatataaaaagctcggcgaaatttctgcgtttcaaaaagcgtcccatttctttaaatttcaagaattgaaccctaaaaacaactatttaagatatattcagggctggtttggtttgaggcataaattaggcttaccaatatttaacaattttaatagcgtttagtgtctatttggtttgaagccaaattttagcatgcctaagaaaataggccatttcaatagtgaacttaggctattttggcttcaatccaaacacaactttaccttaccaaaattagtcatgacaaaacttgccaaaatttgacactgataaaatttggtaaggcctatttaggccacaaaccaaaccacccctcaaccatttttgacctttagctgcgaggtttaacaatttaccatctgaatatacatatcccagacatattaaaaatctcaaattgaacatttcatccatggaaacggaaggagccttctagaaccaagggcgcatcgagattcgtgctcaaacggaaaggacgcgatccaacctccatggcccaaaaatagacgggcgagatgaacagcaaccaattcacaccccccttaattgcccgccacgtcaccgattaattgcgcccttaattgggtttaattaagatccagcgagcaaacgccagccatatataatactatatattaaaaaaaaaagacacaaacacacacacacacacacgcagaccacgcacgcgtcctaacctcctctcctcactcccctcctcctcctcgtccgcgacccaccacccaaagatctcgccctcctctcgaaaatctcccactctcctggccctccggggattcgcgcgcgcgctgcttcgctcgatttggtttctggctggattggatccggggaggaggaggtggggttcggtttcgtgccgccattttccccaatttgggtgctgcgcgcgtccgttttcttggctgttcttgggtgggtgaggtggggcggtcggatcttgccgggatgggcgagctttgggcgggatttgatcggctcggagcgtagggcgcggcgggcattggccatttttcctcttttgcccgatttttgatttttgttttttttgggttcttgggagaggctcgcgcggctgcgtccctggaagaaatcttgtgcccatttcgtcgtgctttgtggtgtccctccaagatcgctagatccaattctctgggagcattttcgtttcttcccctcgattcgagagactgtcactatcaatcgctgtcatctcatctcccaaccttttttttcttaccctcgcggaaatctaatccttttttttttcaatttcgatttagttgctgttcgtcctcctccaccaagaatcacccacccgcgagatccaatccaatcctctcgcttgcattttctgctgctgcgtgcgcgtgctgagatttcattcggatttgttgggggttcgctgagatcgg

SEQ ID NO: 42502 - DNA, 289 bp, Oryza sativa
gttcagcatgaatggtcatcccatctcgctgcaaattttaaaaggtgcttatcacatataaaaatgatctgagaggactgtgaacacaaacaacattgaacttaactgaaaatgaacgttcttgccaagagattttactacgaacatatatcataatctgtgactcgtgtcaagcatctcttaatcagaagagaaggaatcagttaccaacaaattacttgggatatattgtctgaaaaactaaaatgtaaattgtgggtaagtgatgccttcattatttcaaaacagc

SEQ ID NO: 42503 - DNA, 1501 bp, Oryza sativa
tagatgagggatgttacagacatgtgtgggacacacataggtgccatgtaggataaaccacttaaggattgatttttgagaaaaatataaaaaccacatctataagtcactttaagtttgacattctaccctataaatcattttattgtaaatacctatccacttactcagttttattgcaaaaaccaacgtttgtgcatacatgtttaaccgaattaatatattttcataaagtgtgagccgtaaggtgttctttactaaaattaaatattgcaaagtgtagttttgacaatttttttttaagatttcacaaatagaattatgttgagagtttaaatgttgccatattgagttttgctgtatgaaaaaaaaaagttcaatcaaatatgaaaaataagtctaatgcacgcatttggataagattggcttggctaacttagcatgtggtgactctagctcagtgataacgaattgattcggttaagcacgtgtgcaatgaggtggtttttttaagtaaaactgaataagtgggtgggtatctgtcgctttgcttcgcccgcctgcgcgtcatcaccctactccgtcgtcgctcgcctgctccgccgttctcctcgtcgcccaatgctgcggcgcctgcccgtgtggggctgcatcaccggcggcggcgacacagtgccgtccacgccattcgcgaccagccaccgtcctcgccttctcctgtgtcgcagccgacgtcgccgcctcttctcccgcctcaccccgacggcctcctccctagcagcgccggccagccaccgtcctcgccttctcccgtgttgcagccgtcattgctgcttcctctcccgcctcaccccggcggcctcctccccagcagcgccggtcggcttgcctagagaagagaagaatgagatagaggaggagggggaatagggagggtgctgacgtggcatcttgacatgtggggtccacgtgtgtcccacgctgactcagccatcatgtagtgcaaaatcggggtcaaaatcaccgaaggacctaaagtgaatggtttgtgtaagttgagggatatcatatatctggttttgtggttggggacgattttgtaactcgatgacaagttgagggaccttcggtatactttttcctacttccaatgttgtcgagaaatttagcccacagaacgagcggccccaaaggttcagtcagaccgacccaggttcatgtcacagaaaagtcaacccacttagtttaacgcccaacagcgtcaagaagctcagcccaacccactaacgaccacgacggcccatcttacccacagcccaacaggaccagccctcaataatttcagcccgctaaactaaccggcccaccaacccacctcctttccccttcacctctcgcctccacctccatcgctgtcacccacgagctcgcctccctcaactcaaccacttctcctactacagccaacctcctcttgcctcgcctcgccacggatcgcgcc

SEQ ID NO: 42504 - DNA, 1501 bp, Oryza sativa
acgccatggttgacgctggtcaaacgctcgttttcttcaccctcgtcaacgtcccgtcttccatttcatcgttttgctccacagaccacagctgcatagagagttagagacccacctagttgtatcctcctgaaaaacctctacaatttctttctttttgccttttcaggcttttgctgcacggttctcactttataaaatggaggccagtttagggcaaagaagtgccaaaacctcactttaattacaaaaccgagtagtttctttatttactgctggcaaattttttaattgaaatgctttttttttccaaatctcactcaccttcttcccaaatcaaaattatatttcacaccaaatactctatttaaaagggtgtttagattcagggatgtaaagttttggcgtgtcacatcgagtattatatagcttatcgtataggatcaataattagtatttttattagtgcccaaacaccctgtgcgacactatatataatacccgatgtgacacgcccaaacttcacatctttggatctaaagcacccctcagtgttctaaacccccaaataaaccattagaaattcagaataagtcagccccgtacaactggtcgacgagcagcggcggtcagtgtagcacacacggtggtagctgcgtccagtggactcattctatgtaggcacccgatggccagtattttggctgtacgccggaccacgaaaaactgctatcgcctgcgcccactggtttctgccgtctgctggtttcaggatgcttcaggttcaggactttgcttgattgctttctgtttccgggagctgctactactcctgtgcccaaggagaaagaagttcactgtttgtgcagggaggtggagagggataactattctaatatcttgaaagaatattagggcctatttagttccaaataaaaattttcacgttgtcacattgaatatttgggcacatacataaagtattaaacgtagaaaaaataataattacacggttcgtcaggaaactgcgagacgaatcttttaagcctaattgcgtcatgagttgacaatgtggtgctatagtaaacatttgctaatgatgtattaattaggcttaatagattcgtctcgtagttttctggcggaatctgtaatttgttttgttattagagtgcatttaatacttcaaatgtgtgtccgtatattcgatgtgagatgaaactaaatatgcccttgattccttcgttgtttacatgtcatggttcaatattacggaaatcggcatgtattggggaatgattgaattgaaatttccgggaatttcgatagagaaattgaagtttgaatagatcttagctgaatttgaacaagcttttagcaaatttatcatttaaaaaaaatctaattagctgaaagaatatccaggcggagggaaccaaccgacttgaaaattttcagtcagaaatatgggacatatatactagagatggacatatagagt

SEQ ID NO: 42505 - DNA, 1501 bp, Oryza sativa
atttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatgttaggatagggaagaaagaacttatagaccttaatgaaagtccactcatagaatcacccattagctgtcacgaactgtcagagaggtgtagtaggaaggaagaattgattgaggaagacgtggaggggggcgagggagtaaatgatatggcggatgtggaggtcagggaagagaatgacccggtaagggaggaagtcatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggattgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactatggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcag

SEQ ID NO: 42506 - DNA, 1501 bp, Oryza sativa
aagaaggagaaggagaagaggaggcgcaagcacaagcccgacgaggcgaaggaggagatggtggtggacgccatacccaaggaggaggagaatctcaagtcccccgaaaagggatcaccgaagaagaaggagaagaggaggcacaagcacaagcacaagcccaagcccgacgggacacaagccgtactcaaggaggaggaggagagcaacagcaagtccaaggccccggcggagggcgagaagaagaggaagaagaagaagctggtgacggtgaagctgagcgacgagctgatgggatacctgcggaccaaggaggtgatggcctacctcgcgcgcgagacgcctcgcccgctcccgatcgatccgggcgtcgcgcagcacatgttcgtcgaccaagaactcaggcaggaaatcgccgcccaggttcacgagaacagggaattcgacgccttcgtcctctaccagtaccgcaccaagggctacgccgagatccagcaggaggtcaccgacgacgacgacgacgacgacgaggtgtagctagaatcttgcagggaatcaataatggttggtggtaaggagcaatgatctgtgatccagctaaatatactagagtgcttctgctcattaatcattattaggatattactatgtctaatggtgttattattattgcccgtatctttgctacttgtaactaaacgtgtgggaatcacaagtaactgctttcgtagttaaaccgagtgaattgctaacgtattggaatgaatgggattgcaactgtgatttgattctgattggcatagtacttgtcatagtagttgtgatcctaaatgtgaatgatcttggctagctaacccgaacgcttcatgttactctctgtttgtgctaaaagcgattcggatttctactatttatgacttgttaccttcctgatctcgttaattctctttttgtgtgatcctattcgaattatgtttgaaaaacatttcaattatatcgcctcatgtggccgtatctcattcagagcagcttcttctataatgctgtttttctctgcgcttttgccattcatctattcattttgattaatcttcaaatacctcagaagtgtgaatcttctgcggtattgttcttttcttcatgtgccaacgcagtgtggtttggtgctttttttcatattgtagtagatatcactctcccttggttatacaatcaaggactttttagtggaggaaagagtaaagattccattcttttgtacatttgtttatagaagcaatacgtgtgctgcaaaactttgtgagccttatgcatcgtactgctggctaaatgttttcatgtctaatgaatagtacactagaatgagaaatgccatgaagacctacagtaatattatgttgtcactctgtaaatgtttggcttgctgtaaaatcattggctgggtcgaaggaacaacgaagcattgttgattccctagggccccatgccttttctgtacagg

SEQ ID NO: 42507 - DNA, 1501 bp, Oryza sativa
aattattggtcaaagtaactctctctctctctctctctatatatatatatatatatatatatataaggaagggatattaaacaaaatatactcccatcatcttaaaataacttctatcagcaatcatttatctaaaacaagttcattggggatcatggtctcacgatgtcacgcacaacctgcaaaggtcatggttacctcgaccatgcctcagctcaggagctaggaacccatagctcggggccacgtgttgggcaagtttgaagccctgtgatatgcttggtgaaaaagagatttcgggcgaggaggatttgccatggtcatcgccgctcaccgccaccaaggactgtcatgcaagtcatcgccgctcgccaccatggtcatcaccactctccacagcaaatccagcgagctcgcggcgagatctgataagctcacattcggatccagtgagctatttgattcaacggaggagaagggagaagagacggcactgacgtcaacgaagaagggagggttgcatgatggtggatggggagagggagagaggcagagatgggcaatgaagtagcgttgtagtggcgaagtcgtcagcctcttcgaagaaaatagaatctatacgaaaatatagagagagaggagtgagggagaggaaaaaaattaaggtggtggagtcgtcggtgtctttgaagaaaaatggccatggtgggaagacattgggggagggagaggaaatagataaagtaggagaggctcggatgggtcatgtaaagataaggtcacataaaagactaattgcacgtaagatctaaaatagatacatggttattgtaaggtttagggtctaaaatataaaagtttcagtggatacattgttattttaggtttaagatctaaatataaaatataaaagttccagttaattaataataagaaattattctactttctcgtttttcttcgtaagaacattttctaaactggtttaagggtgtgtttttcaaaacggaagttttaaatttgttctccttccattttatattataagttgtttgatttttttttctaaaattatagcgaaacatagtagcattttcaataaaaacaaaattttattaaaatatatttattataatttaatggaactaatttaatactccctctgtttcataatgtaacactttcgacaatgctataaagtcatctatattttcaacaatgctataaagtcatctatattaattggataaagtcatctatattaatgtggataatactataaaatcaaaagaaaaaagtatcataaatcttattattttttttatataaattggattaaaaaaactttaattaaaaaataaacaacttattaataacttaactctggtagtgtggttatagactccgaattgcagcttctaccgagcaaaatacgtaaaattgttttgaggtataaaaattttgggattcaagatttgttgggctttaccctccccgaaga

SEQ ID NO: 42508 - DNA, 1501 bp, Oryza sativa
tacaaaattgacaatataaatattggagatgttgaactaaaataataagcgatatctcttcctttatcaaaaaactcaatttgaggggttttttatataccggtaaatattcgctaccgtattagttccgtctcgtattcgctccgtatctgtattcgataatattcgatttcattttcgtatccgagttttcgattccgaaaaaaaatatgaaaacgaatatgataaaactagtttccgtccgttttcgatccgttttcacccctatatgcttcagttgtatgctttcagctgtcatgctctgtttcatgacttgattttgtgcactgtggtttattcggtatcaccacaaaaatacaaacatgtgttctactcctctagtacttagtaattaactaatcatatcttcaaactaactggtgcacgaaatccaatacagtaggtgctcctttttttaatagaaattttacaaattaaacttaattatagtgaaaaatattatgtaattaatatttcaatacgtttcaagggagcttagaatttaagccaggctattgcagtgccatttagaatgaactcgatcgctgtcattgagcggtttctactgtagatgtgcgttgtgagttgtgacgcaccatagatacagacacgagtcgcctgatcatcaaccctagacgcagaaagatttgacatccataacatagtaccaccacccagatggaacaaccccttacgccaatctgcctaacccaactgtctaagagaccgatcgcactcgcaccagtcactgtcacgttcagctgtatcacctgcacttacgtaccgagtcatttgctccagctgctcaagcattagtagtcgctaacaacgaataacgatcggcagtagcggccgtggcaacagatgtacatattgcatcgcatcgcatgggcagtatcgtcgtgtctgcaggaattctagaggccgagacagctagcgggagcaatgcatcccttatcaacggaggggaaatggccagtccagcgactgatagcgagacgtgcgtgcagctgttgtgtgcttctagtgcggccagatgagagtttggtacgcgcgccgaatgggtcgatggctgtcatacacctctaattctgattctcatgtagtcatgtctctggcttttatgctgaaactgcgtgactgtattattttgtcttaatccgtttggccttgtctggggcgccagtttttgaaaattatgtgaagaaaagaactcatagtactaaatcatttgaatttggaagtaactgacaatttcaggggcaactgctcccaatttgtctttgagcctttgactagcggttatcatcggcgcggctcgaggctaccaaaccaaaccacttaaagggtgtgtctgagaagaaggggattgagtagattaggaagatacgcaaaacgatgtgagccattaactcatgattaattaagtattaactattttaaattttaaaaatagattaat

SEQ ID NO: 42509 - DNA, 245 bp, Oryza sativa
catctagataaaatattgtggctagattaccattgtgattagcctaatgacctacttggcttagttatttatgccttgtttgatatctagcatgatagaatttatgagtttttcttgtcctatcatgtcgcaagtaggttatgcttgctgtatatgctttcaaataataatgcttggaataaaattaatggcttagtatgtattatttccaacattccagaaacctttagaaccattggtcatgg

SEQ ID NO: 42510 - DNA, 1501 bp, Oryza sativa
accaagaagtgatcggccgtcggtagacaccgaaaggaaggccgtgtcggtattgatcttgatgatttgaatgaggacactccatcgaatgagggatcttgtgaagaaaaaaggcaagcactgcacaccatcaacaacattgtacccatgataatcaactaatcatcaacacgacaagcatcagataggtaatattggattttttttttgcctgaaatttctatatgaatgtaatttgttcagataatgtaacttgttttagttctgggttctttaattggtaagactactatctgcacgagggcagaactatactgttgagaaatctagctactatcactgaattaacggttggaaatacctgttgagattcatggttttggaaggagtagtactggggatatacatgagggcagacgacactttgagctttcaccttcgacatatagtgtgatatgattaggctgtaagcggaatgaacactacggaggcgccccactggagaaaccggagtgccggatggcggcaccggtggccgtatgtgataagcgccacctgcagcacggcgaggacgccggtggaagccattaaaagagagacgatgaggtactgaccgtggatgaatacgcttagatccatgatgatgatcagcagctacaataaatggctagttagctaagtggctttgcaagctcgaccttaagctagctcattccgcttccagatcgaacaggttggtatgtgtactgtttgaggggaggctgagcctgatattccttctgtccgttcacgcggaccacgcctttctctcgatgaacactccaaaatagtactatagtttccaggaaacttactttacaaatgtcatgatgcatctcctaatcgccagtaaataaatagagtttaggcccctttgattcaaaggaaattcataggaattttagatgatctcattcctatagaaaattttcctatatagccatttgaatcaaaggaatggatcttatagaatctgtggagattatggataccccatacctacacggcatgtatagtccgactgggtatggggtgccatgtatagatagaatatctttaagagaactcgggttaaattctaaacttgtatgtcaaggaaatatccgagatcctagtcggtcatgattgtattttatttgtaactacatattccgttagggatatggacggtattttgtaatacggaccccttcccctatataaggaggggtctgagtgcctctaggggcacgatttcctcccagatcatacgatcaataatacactcggtggatcaatccccggacaggagtagggtattacttcttgattaagaaggcctgaacctgtataaaattccttgtctctaaacccatccgcttttccagcttgatagccaccccttttagtattgccgaaatcttgtttcgacagttggcgcgccaggtaggggtagcgtcaagttcttcgccgactagtgcga

SEQ ID NO: 42511 - DNA, 1501 bp, Oryza sativa
ggaagaaatcaagagtgaaaccgaggagtgcatttgtgcaacctcgtgagtaaagggttgaaatagacccggcccttgtggcccctcaacggagacgtaggatccgtagatccgaacttcgggaaacaaatcaacgtgtctcctctcttggttgctcgttcttgccatctcctatattgtgcttgagtttgtttttacccgatctacttgcatgcttaattaatatagttagtgaccttatatcttgcttaaataccttatttgtcaccttttgattcatatacattttctttattcgagctacaagttcatagctagtgttttattccgttatccgctgaacctttcggttgagacaagaacttccaatcccataccggaagttcctatttgaaccgaaagttctcatctctctaatatgctatgaagttgtgataatttttaggaacgcctattacccctctctaggcgacatcaaggtcctttcagtttccaaggattcagtattcatttttttctctcatagatattttttattctctttgcacaaagagcaattacaaagctatttgagaaataacaattcaataaagcatatatataaagcatttataaatcaaatcatatgctagcatcaatattgcatattttcttaattcaagtatagaatttaagtgtcatgcattatctcccttaaaagaaaaatctaagtctcataaaaagactagaatacatacaagcttctagagacaaataaaccttcatagtattgctagcatgcacaagaaaataccatatgtataaaacaaatatctcttttctcaatttttcttattgtcatatttttgcttgttaaaaccatgaggtacaaaactccccctcaaatcatgccaaaaggctttattaaaaagcactaactccccctcaaaataacctcaattctcccccaagaaaaataaaaaagaaatcaaagattttgaaaaagacatccaattgccaatgatatcaccaaaattcttatgaattgacatatatccacttatattaaccaaaacaactacctcaaactctagcatatgaaaagctaataaacgagagagtagaacggaattatgtcaattcaaaaataaattgatgttattttgaaaagcaattgtcatctcaacactgaacactcatggggagtatgccaccaaaatacctacaaacaagaagatgtcgaggcctctgtgttgggattagaaataagaaattttggaatccaacactgagtcacacaaccagtagaaccagtaggtacatatgcactaataaaatcagaaccagacttacctaaataattaccttgtcgctccacaaaagtccgatctgaattttgtgcaaaatcaccacgaggccagtctgaccgctagccggtctgaccgactggccagtgtcggtctggctgtgctcctcgaaccaaaacccaatttttgccatcgtcgtttcgcaaaagcaattt

SEQ ID NO: 42512 - DNA, 1501 bp, Oryza sativa
cgaccgatctgagttgaaaaacatctttgaatcatgcgttgataggttgctcgtgcgttcttcaatccaaagggcatggtgatgtagcagtaggccccaaatggcgtaataaacgaggtcttcaagcagtcggactctcttagtcggatctgatgatatcccgagtagcagtccaaaaaactgagtaactcgcagccggctattgagtcaaccacctggtcaatgcaaggtaacccaaaagggtcttaaggcaagacttgttgaggttggtgtaatcgacacacatgcgccattgccccgtctttttccgaaccaagactgggttagccagccagtcgggatgaaggacctccttgatgaagcccgctgctaacagcttggttaattcctccttgatcgcatccttcctgtcctgtgcaaaacggcggagtcgttgcttgatgggtttggcgtcttccttaacatgtaaagagtgctcaatcacctctctaggaatacccggcatatcggatggtttccatgcaaagatatctttattattttgaagaaaggtgatgagcgcgctttcctatttacaatctaactcggcgcttattacaacagttttggtaggatcggagggatctagtgaaatcttcttagttttgtcattgccttcttcggtctttgacagcttggtcgcaggcacctctccttcgcttgccgtggtggcagccagtcggatttcttcgcgagcgagagtgatctcgtgggtttgggccatctcgcaactttctttgtcacatgtgacggcttgcttgatgtcgctccgtagtgatatgaccccttgaggaccaggcatcttcatcatcatgtaggtgtagtgtgggacggccatgaatttggctagagccggtcgtccgagtatagcatggtatgctgtcttgaaatcagcaacttcaaaacaaacgttttctgtgcgaaaattctcccgagtgccgaaggtaactagaagagtgatctggccgagtggtatagctgacaatcctgggatgacaccgtggaagggtgcattactcggctttaattccgtgcgaggaatctgcatatcgtccagggtcttagcgaaaaggatgttgagtgcactgccaccatcgatgagagtccgtcggagcttgacattgcgaaccactgggtctagtaccagggggtaccgccccgggtggaccactcggtcgggatgattcgagcggtcgaacttaattgctatctctgatcaccgaaggtattggggcgtgttaggctgaaccgcattgatctcccgttctgttagcttctgctttctcttagattcataagccaggggtccgccgaagatgtgattgagttctttgcgatgatcttgaaaaccagtcgaggcatcgtcttcatcatctttgttcttcgatgtgccttgatctccgtctgagggcaatgtccgcgacggtcagatatcatgcgggatacttaggctagagttcaa

SEQ ID NO: 42513 - DNA, 1501 bp, Oryza sativa
gctgttatttcagtatgacatcttgtgcagacgaaaacgacaaatgggctgcctgcctatgctggacctggtggatggaacggtaagaatttgagatgaatgtgttctgctcaaccatttgagagcttcgaaccgatcaacagatgctgttgaacatcaattgcagatcctggcatgcttgaagtgggcgatggggagatgtcttaatcggagtaccgctcacagttcagtatctgtgggcacaatcataggtaccatagcatgttttgtgtactaacagttttgctgcaatgttgaatattttcttttgttgcatttcctcacagcaagctttgcttcaactgttcaggctcctcttttgattggatgtgatgtgcgctcaatgtggccccgtttagtttcccaaaaacatcacatcgaatctttggacatatgcatgaagcattaaatatagataaatgaaaaaactaattgcacagttagagagaaaatcgcgagacgaatcttttcagcctaattagtctatgattagccataagtgctacagtaatccacatgtgctaatgacggattaattaggctcaaaagattcgtctcgcggtttccaggcgagttatgaaattatttttttcattcgtgtccgaaaaacccttccgacattcggtcaaacatcctatgtgacacaaaaaaattttctttttggaaactaaacaggcccgagccagcagatgaaagacatactcagcaactgggaggtcatcgttgtgaaccaaggcaagccttctctttcacatgcttagatctagccatattctttgatatttcaccatactcatataacaactttgtgcagacagactaggtgtccaaggaaagaaaatgcaagctgacaatggattggaggtaatccctgttcatctgcatcagtggttttcaagtttcagccttgtctttgttccatgctctgaagctggcaatactgtgttaatttgtcgataggtttgggccaggtcactcagcaacaacaggaaggatgtggtactctggaacaggccatcactgcgcattggtcgagcattggactcactgggtcagtggctgtcactgctcgtgatctatgggcggtaaacttgctttcttcagagctcaaagtacaacatcactcttcagaattcagagttcataacatttctctcttgcgatttgcaaggattggtagagatggaaatggatgccatttggttatatatatgcagaaataagctgtaagcctgtgcatgtaaggtgccgtcaaatgcggtgtattgctgaagtttgttgtgaaagttgcagcaacaaagcggcattcctgccactatcttataaagaaatatactcgcctgaagacaaatctgtggcaaaagccttcacagtaaagagttgagacattgcaagacatcacaactagacagaatgcaaaacacattgtggatcaaaacaatatcagctacaactaaggatt

SEQ ID NO: 42514 - DNA, 1501 bp, Oryza sativa
ctagctatagtataaatattatctattacctccgttctaaaatataaatatttctggatccaaatatttgtttcacaaactatgagtatgtttagttgccaaccacacttggtgtccatgtaccaacaaaagtcatcacactgtgtaagctgaggcggtcaatttcattatcacacctagcaagcataagggaatctttccatacttttttttttactcattgatacgtgaaatctaatttgttgaaagaaaatattgccacaactatggcacccagctaccaagttaattaaactcgtctaaccttacacatggtaaactgtggtcggcaaccaaacaccctctactacttatccaatcaaccactttccctttaatttcttcccatcctacctcaagcattcacacatctctaaccttccctcatttatcgagggacaccaaattcttttcttcttaatcctaatttccactaaacaatttagaaatgtttatagttttggaatggggggtgcaaatgttaacaaatagcattgccccctgcgccttgaaactccaaaacaattacatgtacatatcaagaaaaaaatatctaaagttgataaacacttaggaagaagcaagaactaactattttttctttagaaattaagaaaaataaattaagttgaaaaggacccaaatctaggaggtgtggtgtaacatccacccctcccatacaactactcaccaatgaagctaagatgaacccttaaaaaattttaaaggcgacgcattcatcgagagcgaggcgtttgtggttacttcatcaattttaagattcgtcgataaccctgtctctcagaggtgctaatgcgaatagggagtacatgcgtacgtgtatgcgattgcactaaatttcgaaaaaataatcaaacccaacttgccaagttcatagactggcagataaatgcatgtgcatggggtgaatattcccattcttaatgttgtgtgctgaaatgatgtatgttttcttcattattaaaacatattatttgctccacactttgaaaaacatgttttcttaaaaaaaatattttataaaatatttttaaaaacatattttataatttatttaaatcacttatttaagctatttgttaaatttgtttcttaaaatatttaatttacttttataatcaaatcgataatctgttgtaataatctattatcattctaaatgagagtatgtcgatgtcctagttgtcatagtcttaagaaagaatggacatgcgctaccaaaatctaaatttttggaccaggcagttaggttttaattatgggtgcatatggacagattctccggaagattagctgttggaatcaaaactcagtagtaggaccaacgagccattggaaaagtctccaggagatacagtcttttgtttctctggtggatgctcggatggcttgaagttggatcttctgtcccacagcttcttggagtgtagaaaaaaaaagt

SEQ ID NO: 42515 - DNA, 1501 bp, Oryza sativa
tgttgtgccgccaaacagttcacatacttaagtccagatctcttcatgtgatcaggaccgtttgtaaatctttacaagctgtgttcatcggcacgatgtaaggccttccagtttcagtaaaaaggaataacatttcatcaagagcttaatgtgtaaaatacgaaggcaaataattctttcctgaacatttagatgtgcaactatgtcatcagctaccaagtgatactatcatttaacttccaacattgacacttatgtagttctgttaacattacgacaatactgtgtctcaggccttttattgacttgtgccatgatgttctgcagggaggttcatgaggaagtaagtgaggcaaggcagaaggcttcaacaatgaaatcccgacgacaagagcaggaggctgctcgtagagagaaactcaagcaggcttatttgaagaaacgcctggagaagttacttgctgagaaacgggccacttcagcaaccgacgaccaaccagctagctagtccaggttttgtatgtcctcacttatgtcctgtagcagccttagtagtttcatggcaattcatcatgagttttcctttgaaagtggttctttgatttagcagaaccaaattcagaaaacgttgtcatgtaaagttgtttctacagtttgattcaaacaatgttgtttctacagcatgtaattgtacaaatctacacaattgaaaggcatcttcatcttcatgtgatttaccaggtcttactgtgagtccctgggtgattcctctcttgtatgcaaccataatccctttaattagggggaagcatggtggtatggagccatggtggtgaagtagtgggtgcatgactttacccaccagagttcaaatcctagagcccacgaatattacaggcctgtttggcacaacttcagcttcagctctacctctcttggagctggagctcagcctaatattttcagctttatctataatgggagcggagctaggtggagcactctcacaaaatgaactagagatgtgaagctgagtttagactgttccacaactctactctagatgtaactcgtagagctaaatttaggagttagaactctaccaaatagaccttacacatatgcaggtttgctttcaacagaattttagtgaggttaggaatatgccactagtttgtttataggctagtcatttaaactgactcacagacaaactgtttgtttgtttgggcttcggtttcttagtcaggtgtaattctgccattgtaaccatttgagaagcttctcgtggggcatatatcccttctgcgctgtactgtaattcggtgcatgcatatgcatagctaactcaaaagctggccaacgtcacgaccaaaatctcgttggttgtaggtgccaactttaaaatggtaccagtgcacaaccgagaggagaaagaagcaggttccatattctatattccttttgtttggatgaaagagaaccgctggtgttaaagaaa

SEQ ID NO: 42516 - DNA, 1501 bp, Oryza sativa
atgaacagcatgaatactcctattacaactacaataacggtctttaatccaagcaagttagacatgctacatttaaataaatagctaacactccagtgggcagtggctgatgcatttgcatagtaatgcattgcgaagtagaataaaggaaaagaagtcaagaaaaaaagacagacacccaaggaataaacagcagtgcaatcatttgttggttacacaaaacaatcagtcattcctctatctgtaattaccagaccagtaggacactaaaaaccaaagcaaccacaacagtactccaatatacccatttggttttctttcataggtgaggagggttacaagcactagaacaatgatggtaatggcatattgtaaggagcccaaacatttactacaccaatacagaacatttaatatccaggtattgccacataatctgtgttgggcactcagaagagtagttgtgcaacaagcatgtgacaacgacatgtcaacaacagcacttgtgtggcatccgccgaaccaactctggtaaaccatctactcttttgcaattttgctcactcttcaagatttgtcatgttctgacagaggaagacaaaaaacagtagaatatccacctatcaagctggctctaaacactagaaacaaaaaaaaggaaaaaagttgaagacagacaaaacaatcattactccagacttagtcgatcagaacaagtacttgctacataattacacgatacaaaatcttggtgaataccataacttactgtttcgcagctctctgcattttgtgccttttcttgtttttctgcattccgggccttttcttgctttcttataccaaccagtgatttaaaccacttcgatgaaatacccatgacaaacaacctttttatatagttcaatgacctgcatttcagaatattgaaatgcttaccatacaaatgagcaatcgtaccttctgcttaagacttatgaaaaggaacaaatagtgtgtatagtaaaggaacttgctgatagtcaacatcacaattgccagaacttcaagcaacggatagcaatagtagaggaagagctaacacacacaacttgttgaaacaagaaaccaaaatattcaagagccttcacataatcacatgaaccatgaaaagaaaaaaagcatagctacaagaaattatgaaataaaatgattaacaaataaaatgattaacggcgatgcaatacagaatctaagtggtttactaaatctcatcgaagcagacagaaaatcactgaatctaaatgattttttttgatcggactgaatctaaatgattaagtggtttactggaagtagtcatccttctgctgtttctcgttgtcactgagaacttacaagtacacagtaccatctagactggcatgaaactcgtaatgaaaatgttgataccaaatgctataattgctaaccgttagcttaattattgtccgtgcacaaactattgtgcgcatcagattga

SEQ ID NO: 42517 - DNA, 1501 bp, Oryza sativa
tttttatcttcccgtaaattcctgaatattaattttgtgctctatccaaagttttaaacaatcattattgtactttcttcctgtgtattataatcccacgtttatacttttgttctttctactcctgcattttcttgagcatgcgtttaaaatggggttacggattttggattatagattgttggcttcctaagcgactaaacggtatttaagaaacattttttcggtatttcttagaaactttttccattaacctttaccagtacattttttcctttattcaaacaatcattatcatatttttcaagtgttttgtaatctttttgtctatactcgtgtttctaacttgatgaaactccacgcgttgctttaaaagtttagtatgataatagtagaaacatgtaatatagctagacgtcttaagcttatagaatttgtatatttgatcgatccttgcaaaggccataacaattaagttgatgtggtttatgataatttaaatggtatatagattgataatttaaaagtaaaagtaaggtgatgtaactttataagagaagaaaatgaggaaaataatttgcactatagattaataatcaaaaggctaaaagcaattgagatgatatggtttaatgagagaatatagaaacattaactaaataagaatgaactatatatgggatattgtagaaaatgataaagagatatatgttgaaatattatgtaaattatgtgggatgatgatttaacatacttatatttttaaagttttaacgtataataaagtatagatgatatagtatgcttgtataatgtttaagatgtaacaatttctaatggatgattatatggtatttttgcatgttgagatttaagatgtagtgggttgtaactttatagatagtatagataaaatcttgtgtttttcctacttcaacgttttcttcagcatgcagtttaaaggcggttctgggttaagtattataaactatcacgtgcatgtttcacaagatactaaacggcgtagtttttatttaaagaaatcgttgtcaatatttcttagaaagctttaattcaacgtcctaatatttaatccgtttgtttaatatacccttaaataattatcataaactcattttcatccatcacccgtcatcccacagctaaaaaaccatgccttaagtttgctggaagtcccccaaacaaatgccatgaatagagaggtgaaaactggagagaaactcccaagcaactcccaaagtctcaatctgctcaacggacatgttccaatgattcacttgttcgttattaattgttacattttctttgtttatatatacgcacatgtaaggatgcaggaagacgatcgatcaaggttcacctcggaaaagaaaaaagaacagaaagaaagacgatctagagggagccaaagattgcaagatcgatcgcaaggtaacgtacacgtacaggtgagaggaatcgatgccggccgacgcgcgag

SEQ ID NO: 42518 - DNA, 1501 bp, Oryza sativa
tcgagctagagcactgcatccgtcccctcagctgagcttcacgtgccctacagccaccgctccagcgagctgctggcggcgatagatgcagctagcttgggctgctccatcatcgatggagggaaggaggagaggtggcgtgacatgtgggaccctttttttttacacgtggcatattatttaccaaaaccaccctacaaactgccgggggtgtaatgtgtctagtattggtagtttgaggatatggaatacccggttttaaagttcaagggtgtactttagacaaagcatagagttagggggtgtaaaatggacttttccctaaagtttatcttcatctaactctgtatgaaaaaagttatgtatatatacgtgttttttctaaaatttgatccatgtctgcggatatccaaacaaaatttctggatagtttccaatcatttcccttattgtatttgtttttgtttccgactaaaaaaatccgaattcatttccgaatccgagaatttccagataattccgacctatctgaatttgaaaaatggtccggacggacaaaaactatccagtttcaaccctacaagtagatgggacttgcagttgactcgctgagaacatgtccacgcttgaggcaaatgcctataaactaccggcaaattgggaaaaaaaaagaagaaaagaagaaaaattgaacttgcacactcacttgatgaagatacacgagttgttttctgaggcactgcatatcttttgacttaggagtagtaattaattatacttcaccaaatatgcatactgaaatcaattgggccatccaccatcaaggcatcaacattatctctgcagatgcatcagacggcaataaggcatactcctatgtactgctacgtgcgtcccccaatgtccctagtagcggttttcagtcagagcgctcttttcccggcatgtcgcacgctttgctgctctctcattctcctccccacagccactgcagataaggtggtatgttctgctacaaacaggccttgtatggtcgagctagcagcagattaaattctctctcttcttgcaagttcgactagattttcaggtggtttgatgtggactgtagaatggatagaatcttaaaacgtgcttgctttggaggatatttcgtgatgtcgtcaccacacgtcgcaaagaaagggacgtcgcttgcagagaccatagtaaaacacatcacctctacagtgatcttatttgtcgataatattttactatcagtattctcttcggtgaaaactatatcaaccattgtttttattataaatatgttactaataattaatgtggtagtataaatagatacgattcattaaattaaaaatacaatcaacctagattaattcttttataagtaaagatcatcataaagcaccacctttcgcatcgatttttaaccttaagcattgtaaaaggtcagttcggataaggtgctagttcctcaagttgagttgcggta

SEQ ID NO: 42519 - DNA, 591 bp, Oryza sativa
tggaagatctgcacaggagctaagcctctttcttcaggatatctttcagctgacaagcagatagatgatatgatagccatacggcgatatttcgcccaaatactcatcttttttccttggaacagatagacagctatagagaaagatatagataggaaacatacaggtcatccttggcaaatgtacagcaaattcttgtaccatccggtttgcaatcaaatactagtcaacaaaaattcaaaaatctctgcaagttcagagttatataattacagggcaacagtactgcaacaaagcaggtaccaaatatagtttttcttttcccatcagtcgtcagatattgctccttaccaccttgcgagcactatttagttgattgtaagtgtaatgagctattagagagagagagagagagagagagagaagtccactgctgctatagcatctccaggaaatgggaaatgagataaagtccaaaaacgttttaataggttaatgaattctgacgtttcaacatgtaaagattacaccaactgtacaatggcattaaatcatccagagtaacaatcacacaaacatcatgaaaacttc

SEQ ID NO: 42520 - DNA, 1501 bp, Oryza sativa
acgtgtccgctccctccgccgctgcccctgccgccggcgaagacgacgacgccgccgccgcctgctcgtacgtcgtgaccgtggtggcgcccccgagcgcgctctcgacatcgtcgtcgtcgtcgcccacctgcgccctcttcctccaccgggcggccgggaacgcggcggcgcaaccgcacgcccccgaggcggcggcggcgaggaggaagacgaccgcccccacggccaccaccccgacgaccacgaggtgaaccgcctcctcggtgtccatgacgtccatcatcccgccacaccggcgtacgcgagcaaacctgcagggcgcgttcgcgccgcggccgccgcgtcgtctccgtgtggggcgcgcgctccgcgttcgcggtcgcggcgaggcagaggcttctgggcgtggcgcactcgcggcgagcgccttcttaataagctcgagaagagttgtgataggctagcttcttcttggccaagtcagctgcccgcgacgcgaccacgagcgagagagaaagcgcgggggcggttggggttggggtttctcagaatctttcttggaaagccttgttttttttatgttttttttttctttttggacactgcctagccttgttgccgtggatggggaagctaaataaggtctcgtttgaatcgcacgaataaaaaaaaggaaaaggctacacgtacgaaacttcttttacgaagcatgtacgaagaaaaggtacgggccgtgcagcctaccttttcaggctatacacggtaatcctcttacgagtattaagcacataaacaatacagacgtggtttcgctattttccaaatgatatttttattttgctacaaatttatgatactgagaaaaatttatacatagcatgtatgtgtccaatctcaaaacgagcaaatcaaattatttcattctcatagtacgtaccatcgactactacacaactaaccattgtcctttgcaacatcgaagtgaataggtagtatatcaagcaagtatatatatcgtattgtggttttagctgagcgtatagtggccacctccgcgatggctacgtccaatcgatattttctcctgcggtcctgcctaaatgggcataggtttgattgagattattctatccttgctctctacacctttgctcaagctaagctacgaacgagcagcatgatactgaatgtgtctattttggaatgggtatttgttttttttccccctactagaagaatccagtgtgcttattgataatggggtgtggcctttggtaggcttttagtggtgtggtcaccaaagtcacgtacgtaaggtagttttcgtacaagcttcgtatgaatttcttcgtgtgtatagcaaggtttaaaaaaacgaatgaatcggaaaaacacatgattccaacaggaatggaaatataaaacagaacttgcaaaacacagaaaaaagacagcaatgaccgtttgattagactatagaaaaaacacaaaaatcgga

SEQ ID NO: 42521 - DNA, 1501 bp, Oryza sativa
gttgtaaggatgccatcgtgagttgtccggccattgccggcagcagagacagcagtgcaggcttgcagcaaattgggggatgacctctctacatgatctcctagggtataatgtgtacggcatgagaagtggaaatttttaccctggaagtttttgacgggataccgacagccgggtcgtgcctgggctgcaccctcggcacggtgggctggcccagcatggcccgatcaaataaaaaaaatatagagatgcaaaatagacttaaatagtcgtctaaggcaaggcccaagacaagaggtatacaaaatagacttattttccagccatttaaacacaccccacagagttgagggaccaaaaatagactttttctctgaggaagcacgatggaccatcgtgccttcgggccggcccgtcacggcccgagtagtattgggccgtgtatgccgccggtggggtggcacgacacggcctagtgtgtcggtcgagccgtgccggcccgacaagcctcagcccaggcatgaccgggcctgggccatgccatgctgggcagcccagatggccatctatactctcatgtcatggaaaagaaatggctgtcttttttttatgaagaggttggtacatgtactttcactgttagaaaactaaccctgttaagtttcctatgacaatcccaaatctttttttattaattttatatactccctttattccacaattagttcatatttccctcccatttgttccaaaataggtgcattttgagtaattattacaccaaagtttatgcaattaggaataattgcattggaaataaataaaatgaaaaataatcacataatatttgataaagtaggagtattctaatttttgttttggtttgtattggtaatgaacttattttaggacaaatggattagttcagggtaaccaaagtccaatgattttagttccaaacaaaataaaatatatacatatttaagtcaattgtgtccgacacccctattttcaactacaattacgactctaaccctattttttttataaaaaaataggcatgtttggtacggctccaactctagcttcaactcttatggagctaaagcccagccaaacagtttcaactccacctaaaatatgagttgagctgagtttagattgctcaacaactccactatagatccaacttctagagctaaagagttggagctctgccaaacaagcccaaaatggttaaattttgccgaaagccttttttacattctagcaggccaaagtgcagcccaaaaggcccaaactcggcaacgaaaggccccaacgaaaggaggaagcaagcaaacaaacaaaatcccccacccaactggagagaagagaagcggcaagaaaccctagcgacatgctccagattcgcctcagcaagatcggctcgtcggactccggcgccgccgcgtccggcgcggcggccggggccggcggcggggtcggaggcggcggcgta

SEQ ID NO: 42522 - DNA, 1501 bp, Oryza sativa
cacacgtctccttgcaagttcgcaataatttgatttgtgcccactaataatatatacgtccaataaaaccatttccaccacaccggaaaaaagagaagataaaccatgatgattgccttcatggcttcatcaatcatacatgccgactcatccccaaagatcacgactcctcacttttgtttttcagttttgagtgtattttcttgattacctaatccatgaaggacgcaagcagatttaaaagatctcgctagttttgatttaagagtacacgcgtgttcattttattggggaaaaatataaaagaaatgatgactaatcttttttctcctattcggcaaagattactacgacatttcttttttatttgggtatgtctcttaaatctcttttgcttaggttatgatgatgtagtggataaatagagggaaataaaatatagcgggtgacaatttctttatcaaataaaactgcttgactcgttcaatttacaacttacaaaaaaaattgcaaaaaaaagaaagaaaataattgtttctagtgcttggttcgaggcctattcaaattttgatagggttttaagaggaaaattttagaattattagaatttagcaggggttgcgttggtaatggcgtatttgctatgttgcctctttaaatttcgacaatgaaaaacttggtaatgttaaaaataacaataaattaatctactttcacatatgaacaacaaacatgattttacccaaaaaagaactagtacaattttagccactgtaaatgcttggcaaatgagcccaataagccaatcaacctggttattttttttgtcagtctggttgtgtggtgcagtgcagtggcaacacaaaataagagaggctagctagagacattttacatagacttgcctttgaagaagggaaagaagggtccacgataaccagagagcaacggtaggcgtgtagtacaaagtagtagcattagcacctaatctaatctcacctgcggtttaggtaacaagagcatcgatcgatcactggccgaaagaacacagaggagacttctcaaaagtaaagtgatacccacgttattttcttagaggagactaatcacagggaatcgaagaaactttagacccttttttttctttgaaatatggatacttttcctatccgtacaattttcatccaattggaaaaagtaaaaaaaaaactgcaaactgaattgtaaaaatgagttgaagagagtcataaattagggggggggggtagcagttacgaggaatgaaaaaaatttcagcattcagtgaaaggctcaaataaataattcgaagatatttctacctgttttgaatatttcttctttttttaaaaaaaaagagaggagagagaaagggagagactagctagagagagagagagagagagagagagagagtgaagaaggaagaagggtcaataaagaggcgttgagctccttcctttccccattctcactctcggcc

SEQ ID NO: 42523 - DNA, 1501 bp, Oryza sativa
gcaatggtaaatcgtagaagttaaacaaaagtcgatggtatattgtagaacgtgacaaacgatagtaaatcgtagacgtgggacaagatcagtggcatatactagattctctctagaatctagtagcaggaggtgtcatgtaaaaagaaacaatgaaataataaaaggtttgttacgtaaccctttaggaaaacatttttctagccaatcaaacaaagatatacatatttaattggatttacaaattgataaggacatcataagtatttctccccactacaaaaatgcatgagaatggctagaaataacgttttcgagggtatttaattggtattttttttgttagttatattttagtgagaaatgctttgtcattataatgtctataaaattggtcgaagttgggtataggtgttaataaattaggcgtgtaagtagagaaattaaataagaggggtatgatcggttgagataagtgagtagatactcaattgctatattctgagttaaatgaacaacttattgaagttggcctaatcctgcgaaatattttaaaatatatatgtccatacacgtaagcacagcctaaaaagagcgtgccaattggcgcgacgattctctagtggagatataaaaccataccattttaaaatcactaaatattgtataatgatactctgtacttatcgtgaaacgtatgcgatttggattccaacataaaagcaacattctttgaaatccaattcttaaaatgatgtaatgcacgcatcagtctaaaaagtactcaaacggtccaaccccggtattgttctagtagaaatatgcagtactccaatacacagcagggcctgaataattggtttagacatcagcagtttgtattaacttttcacatcaaaaattgcaagcaactaatatattaagtggggagggggatttttcgatcgatgtattataaaccttaggctgaattgtacagggcatttggcttttataacttatttgacatattttctaaattgttaaatgatacacttttaaaatcattttatataaagtttcttcaaaaatttagatagatatgttttttaagtttataataattaatgcttaatcaattctgcattaatgacttggcttgtttcatgaactatcattttagttaacaaaaacactagttcgaactgcaggtccttagccaacttctactcctagaaaataagatcaaatatgagccacaaaattgatgaaatgattcctattacttttaaaattaaatcatattatctctccgtctcaaaatataataacctagcattaaataagatatatcccaatactatatattaaaacgtatcttatttagtactaaattttatattttattttaagacggatggctgggcagtaaaatttgaagtcccaggcataacttttcggaaaaagtacgaattaccccccgaactatcgcggtcgtctgaattaccccccaaaaccataa

SEQ ID NO: 42524 - DNA, 1501 bp, Oryza sativa
attggagatggatgaagtcgggtgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaattttgctcaacaactaaaatatggaatggttggcctgggttggcttgggacgagctggaacccaggtcgggttgccagttcggtccaaatcatcgtaggccttgggttaaggcaggttcgtgagggttcacgaccttgtttaataatactgtgtagctctaggatcgtctttacaaaatggctttgggcaactaagtgacttttaaatgctgtttactgcaaaacctaacccctattattatccccttgtacccccccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcccttgtaataatgtaaatattatcgatgtaataaagatgtgtcttttatatcatgtttgtatggtgtaccccggcttttcctgggacggggattaatacactagcgttcgggagaaggcaattttcccggtcgcgacataaagcctggtgacaggtgggaccggtctccatggttgggcaaaaaacccaacggtctcaaaccatgcacaccggtaatggtaatttggctgtcaataatgggcggtctcttcaagactgccacatcacctgagcggcgcacgaatctgggcgagccgatttgcctcgcctggtgatacggtaatgttgcttcggtcggcgagcgtaattaacgcgcgcacgatacgatctatctcgactgccgcaaccgcatatccatctcacgcaccgcaagcgggcgaatgggattagtggaagcgtgggcgcgagaaacgagggggcgaaataatgggcgcgagaaacgaggagccgggcacagcgttggcaagggtataaaggcactgaggatgggatttgtctccttcctttcgccatcatttcctttgccttcgccgcttgcgtcctaactccttcttccctgcgcccttctttcgccacacgcgctcgctcttcatcttctcttcgtccggtgcca

SEQ ID NO: 42525 - DNA, 686 bp, Oryza sativa
ttcttcttggtgaggactaagtgcctcttaagtaagtatttatcagtttagttattatgatggatttgtatattaaattgtcagtttgtgtacctcggctgattcctggacgaggattttatgcacaaatcagttcggaaattactagtgaatttccgggcgtgacaagttggtatcagagccatcttgactgtaggataagccaaatggtcaaaccttaaggactaattttccgaaaacataatttgtgaaaattttcctttcttccttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataataagatgatagtcgaatcttaagtgttcagatagagtgaagtttggaacctatcttagaacctatgccgccaaagtgtctttgaggaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctct

SEQ ID NO: 42526 - DNA, 1501 bp, Oryza sativa
tgacttttaactttgcacattttaattgttggaggctttcacacggattttaattattctaggcataatttagaggatgtattttagagtcgttttgggacgtgacagtacaccatcaatgaacgtttctctctccactcatatgaagtccacaaatcacctctcacatattccactttcatatccacatgagactaggcaaagaaatgcttataaaaacattagtctcatataattggatttgtcattactcaccaaaaccaaattaatgacacttgcactttcagaaacagtcttgacgacaaggacgtattcgatgtgagcaaaaataatgggtgtcgaatccttcaaaacagtcttgacgacaaggacgtaccaggaataattgagagaaaaaatataagtaaaaaggctcaagaaaaatataagttaaaaattctctaggttgttttgtgctaaaagctaatttgagaaagagtgataaatgcaataggtatatatgtatagtgtttatttttcaacctatgtgcttgtaaagatgttgcattataaatcgtatgaaattatgaattttgattgttgatttgatcttaattgtaaaatctttggttcatgattatactttaatgcatgcttgctatattatagatgggttcatcttctttttattgaaacacatgacttgatatgctatatgtatgctaagctcttgaacattatgaacataattcctatgcttgatgaaatcattgtcaaaagggggagaagcaataagttttttcggagaagagaagaatttttggaaagtttttgagaagagcatgttttttggttcaaggggaatttcattcttttcaaaagtgagagaagttttcttttggattttgagcacgatgtgtacatttgtatgaaatgtgctttttaccacttatgtttttatttttccaaacaccaaaatatttttgatgggtttgccaatgtgttcatcaagggggagattgtaaaatcaaaggtgttttttattattattatgtgatggacagttggcatctgagattattggttttgatatttgaaatttatttacgaagtggttttggagatgattggaatttgcaagtgaataggaactgctgcttttgatgtggtccggtcagaccgggcatgtgctgccggtcagaccggcgtgtattacgcagtcagaccagcgcgggcgactctgtgtcggttttggtttcaggttgtttatttggaaatccatgattgtttcatgattatggcttctagatggatactatgcatatgtaatactgtagtttgctaccaatgaatcaagttggagatagcttggtctcggaatatggtttctttgtttgtttcacgtgtaggtgacttgatgcctcgggatagtattgccggtgatggatcgggagtcgactggatggtaaggcgatgtccgtgatggtcagatatcatgcggaatacttaggcttgagttcaa

SEQ ID NO: 42527 - DNA, 451 bp, Oryza sativa
catcatccttgagcatattgaatcccagtttataaaattattttgatttaaattaatgcattatcgctttatttaaattatccccttatcactgttttatctagccatgcctatttacctttgttatgaccttatcattgttgttattgttactattacgttgttcaccctaggataaacaaaaccccaactagtgggtactctattcatggttccactagtatgaatttaggtagatgcttcgctgattaattaggcaacattaggtggtttttataactttagactttgggaattctcatatcatttggacactatggaatggttggcttatggtggaattggacatacccctctcttcctctttcaaaacccctaaaacctgttttccggtggggtttgggtgcatgccagttgtgggaagtagcaccccggccaatataaggattaa

SEQ ID NO: 42528 - DNA, 1339 bp, Oryza sativa
gtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgcttaatcttttccccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaaggcaattttctcggtcgcgacaagctggtatcagagccatctcgactgtaggataagccaagtggataaaacctaaggacatattttataaatgaaactatttccgaaaggccctttttcctcctttcccctgtgctatttgcaaaatatttactctttcttccttcttcaaatttcaaccagtactagatggttagttttgcgaagaagaagatgtcgccaattgtctgccgaagctccggaagaccgcagggtccgctagcgaagcgaaggaagcaatgaagccagctgtgaagcaggagtgaagatcttggagaaccagtcgcagaacctaagccgtcctctaggatagtgttgttagtcgtgtgtttccttgcttgtgtgtgtagtgcgtggtctgcatcggtgggttgtgatgtgaccatgctaggttgtttgcttaatcaacctgcagaataagtgaaacaaacaacacatcaacaaaaagagttagttcctttaaggtcttgtccctagttctggtctattctttccttgtatgcttcccctctcaacctctaccttgtgacagatggataacactggtaacaaaggctatgggaa

SEQ ID NO: 42529 - DNA, 1501 bp, Oryza sativa
tttgagaaatccaatagcctctgtcaactgccctgaagagcaatatccgtgcacaatactattatatgtcctgcaattaggcatgacaccattcttaaccatggtgttaagtacctccatggccttgtccatagcttgagccttgcataaggcagcgataatagagctgtaagtcacaacatctggcaaaatcccctggtcaaacatttcatggtatgtagcgtaagctttgtccggatccccctctttgaagaagccattgatgacggtgttgtacaacaccacatcaggtgggcagtcacctccatcatcaggcatcatttggagcagctcgagagcttcttggcttctgttctcatcacacagacccttgagaagaatggtgcaggagaagacatttggtatgcagccgagctgggtcattctgcagagcactatgtccattgcgtcgctcgtcctcttgtcggcacagaggcccttgagcagaggagtgaaggtgatggcttccactctaaatcccttcttaatgacattgcccaaggccgcgaaaccgaggtccaagcggcccgcccggcagcagcaaccgatgagaacgctgtaggtgtacaagttgggagttacctcgtcggcgccggctcgggccatgcggttgtagcgggacacggcggccgcggggctgtgacgcgcgacgtcgtcgagggcgcggttcaagccgtagatcgtggcgcccttgccacgccgaagcaattcgtcgaacacgtggcgtgcgtcctcggcgccattgccccccgcgcggccccctcgcccttggatcgagccctccgagccaacagcgcgggaagcggcgcggcgcgccatgcccgccctagctgacaggtgcagcagcagcagcagcagcagcggcggctgcgaggcctgactcccacacacaggcacacgtgcccagtgcgaagctcgccgatccgcgccgtcctctgatctgcgccgcccagatcgaggccgccgcgggcgcctggggaatctcaacccaaccccagccccagcaggaatctcaacgtgacacctcccccggtgacgcggcgaagcaaatcctcttcctcctcactaggagtatgcccgtgctaacgctacggtgacaactaatattacaaatgaaacaaccaaatgacagcgacacaatatatgcttcatcaatggtacatagaacagatagttaggaaaagagcgatagagttattagaaaaaaattaatcaacatgcatccacaatatcatctaagaacaagccgtcccttgctatgctataataaagtacaggtattgctcctctcaaatacacaaaataataaatatctaaaattagcttgacttaagccatccatttcgcctccttctgcagcatctcttcggtctgaacaagtaattcgttcgccgccgatgacatggcggccgccggagggaagagatcggggcggcggcgttggagtgctttgcggcgaagg

SEQ ID NO: 42530 - DNA, 1339 bp, Oryza sativa
ccaaccgggactaaagataaaaaaaaaactctatccttttgaaccgggactaaagatatctttagtcccggtttttattgcaaccgggactattgtgtattttggccgaccgaccaaagatggtttctccaccagtgatatatatatatatatatatatatatatatatatatatatatatatatatatatatatatatatatatattagtagtatatatgttgttaagggactgctaaattaaaaggggacaggagaaggcctagagattaccacatcaataaagaaagaaagatctatactatttgatcatgatggtgatcaggttcgtattatatataatttaatacaaaataggggtatgttggtactccctctagttctataataattgacgttttggacaaggttgaggtcaaacttttataactttgaccatcaataacttaaaaaatatttagtttaaagaaactaggacaacatatatagatttgtctttcaaagcactataataaaagtaaacatgtatttatttattgtgtatattataatagaaaaataaggtcaaagatatattttgtagaccgtgccatgcattgtccaaaacgttaattaaaatgaaaccggaggaagtatctttcatgtcactgagacttccccaaatctcagtcaccttctctcagctaggggtgggcatttggtctgactgcaaattcagtctcggtctttgttcttttagaaaacttcggtcctgtaatactgaagaccgatcgatttgcattgcaaaataatgaacgccgaaattcggtctcagtctcggtcatgaccaaaatttaagcagatccaaaaaacacatagatcacatataaacagcatgtccaaaaaatcacacaaaataaaaaaaaatgtcaaatcggccagcggcttggtatgtgcatgtgggacatggggatttagtgcttcctctctgggcctattgggctaaactcattcaattcggtcatcttgattagctgaggcctatgaccgaattgaccaagcaaaattcagttagttgagtatgaagaccgaaattcattgcctcgattagttcggtctcagtctcggttatttcggttcggtcttttctgtccacccctactctcagccaacaacaagggagtcatcttcgacatctagccaagggagaggttaggaaaagcgggattcacatgaaggactcactagcaatggcgatgacaacttcatggtggtggcaacaatatcgaaactctaatagattagggtttcaggatcagaaggtggtgcaggaaggtagggccagacgactttagaagga

SEQ ID NO: 42531 - DNA, 1204 bp, Oryza sativa
cctccccccctggattcatccttatatagatggagggaaggacccaacctaatcctatccaaccaactgagctaccgtaagacgagggaaggcctcgacctctcggcccactgcccatgacactttatttgattacgtattagtagggcagcaacaaggcggcaagtgtacagtcatcaatttggcatctcatgttctgcattcagtagcttattcaggagctagttattgccgttattgaccaggcgatggcctgatgccttgatggagtgtaattattttgtcatttctttccatttatggagttgctgcacgtcacgtacgttaggatgacttttgcttctaatgtgatgctctatacatgtgactaatgatttgtatgctgaccctgttattataaattcaagtcctacctgtccagttgcctagcagccacctgtagatctctacgaaaggatgtttggcgccattatacatagtccttttattttactttctgtgaaatgctttagtggaacatctccattaaattcatttaatgacaggatgccctttgtgtctgttgcttgtcattttcttaatctgtttactccaataatgtgcaactgcgcattaatctgccatggtattcctttttggacacgctggcctgatatcagcattttgcctttaaaaaacctactgtgagtttgcacgactcgagtactttacaaatattgatacttggatcttgagccgtgcgttataaaattcactacctttcttggatcaattaagatcatgccacagtgagactaaactagatagtggtaaatgtttgtttgaaggaatacaataggtggaactgtggaagcactgtatagatacatctttagaaaatatgacaaggtatatatttagttactgtggcgtgtgttcagtgaggtgactttaaagtttagatgtatagcctttgcctgttattattgttcctgcaaacagctacgagtaattccataggcccaaagtatccacataagcatttaatggcaacttttttccatgttgagttatgcaaaagttacaaggtcatgcatgttgccatcatggaacatttctcatacttctatcgtgcgccatgtccattatttgtgtgttgcctgtgtcctacattatgtctaattctcatttatgttgatggacttttccttatgcaggcaaaggt

SEQ ID NO: 42532 - DNA, 161 bp, Oryza sativa
agagagtaagaggggcttcgtatgacatgtgggtcccactttttttaaaaaaaaaaagaaaatgctgactggattgctacgtgtacgccacgtaggacaaaaccgctctggattggatcgagggggtaattcgtccggtattgaaagtttgggatgaaaaa

SEQ ID NO: 42533 - DNA, 266 bp, Oryza sativa
  unsure (1)..(266): unsure at all n locations
gctggtgnnntttgattgactgtccctccgngcagnagntcatcaccgccgccgccctcccaccaatggatccgccaccaccgagccccccgccgccgctgtcgtcgagcccgccgccgccgccgtcgtcgagcccaccggcgccaccgtcgcccgagccatctaccgccgccgtcgccgagccccccaccgccgccgttgccgagcccaccgccgccgtcgccgagcccgccgccgtctcccgaggaagagcgcgcgagcaaagc

SEQ ID NO: 42534 - DNA, 1501 bp, Oryza sativa
acttcgcttgtttcagtagctatgtttgttggagttgcagcttgaaactaggacctttaacattacgattggtgcgttgcttgaagttggcagaaaggatgaagccaaggatttgtttgcttctctctcagctaatggtttagtgccagatgattggatgtacaagtaaatggaagtgttatagaacaggggttgctaggaaaaatggataaatgctacagttaggaagctacttcacaaagggcaggtaggcagggctggggtttacctatcctaaagtgatcatattggtcttttattgattatgttgatattgtgtgtttacactacttcaagtctcagccctatattatgataggttaggggtctttttttggtattgtattatcttgctgataatcatgtcggtgacttctgtttacgtttaaaatctcatgctttaaattatgattgttctacatatggtcctactctgcatactaggaaatataaaatattcatgtttttatatttgaatttagtcttcttgcgggcagttctctttcttccttttcacggaactatctcctgatgaagtgcaaccctgattatttttactgcattttgctggcaattaaattagtttacaagggcttgtccatttatcttctcagtagatgtgatgtgcagaaaacatgacagcatcttttgtttgcctctataggccaatgttttttggtgcatggtctttgacctacagattatagctgtaaatcttatatagaagggttgttgcaatgattctgattaactgattgtatctatgaagttgaatgctagtggaagctcctttggccatgttatattttgtgtctgcaaagaacagatcatttctttctttttaaaaaaattgtgttaaatgcactgttgaagaatgcctaacaatttctctcggcagagagtgaagggaatgtttatttggtactgttctagatctacagataaaattcttattctactgtttctttgcttgaaattttcatgcagtggatatccagttgacctgttgcattgatggagaaaggaatcaatcagctctgaattgcctgtaacttctgcagttcctgtgtgaagtgatctatgtatgtccgcggtttgagaagacgcatcatgttctttccgtgtggaaggtttgccacagcgacgagatctggatgtatatgatttcagaacacttatgttagttgttttgagttttctagctcaatttgatgcatcgttttggtctgctcccttgtacatcgatgcagagcagaagaagcggcctgaagacttcttttttttttttaagactttgaagcggcttgaagactgatttccctgaaagcactgggaatgacagattgattcggtgcattgcacttgaccttttctctttcaatttactgctggtgattgttgtcactatttaacttgtactcctgatgttctagaccatttatattatgtatgtgtttattta

SEQ ID NO: 42535 - DNA, 1501 bp, Oryza sativa; identical to SEQ ID NO: 42534

SEQ ID NO: 42536 - DNA, 1501 bp, Oryza sativa
cagaacagtcatagatgtactctgcaagctaggcagagtatacgatgcagtgcttaccttaaagcagatgatcaatgaaggactaacccctgacatcattgtatatacccccctaattcatggtttttgtacctgtgacaaatgggagaaggctgaggagttaattttttaaatgttggatcaaggcatctgtccagacaccattttctttagtagaataatttataatttttgcaaagaagggagagttatagaatctgaaaaactctttgacttgatggcacatactggtgttaagcctgatgtcattacatacaatgcactcatcagtggatattgcctagccggtgttgacgtaaaacacgaggcctgggagatctgcttaactccagtgcaggtccaaaactcgccttcgggtatgcttagcgtgccaattgatttgatcctgcaatcaacaagaaacaaagacaaagaaaccgcggttaaatccataaacgatagacgatcggctaggtgccgatgacatatcatttatctttgagccgatgtcatatgtgcatcgatcggcagtcattaataaataagaagggactaaatctattcgatcggctgtagatattaacaatatatagtccttatatcgatatatacttaaatcaagtgattgggatagatcggactccatgccgagacagtatgaatcacttagatcgaaatatatattaataatgagattatatacgttcatagcatagccgatcagatggatctagcatgtatcggttgatactccgatactactctatattaagatattaaagcaagtagaatatactaaacaaaagcctaatatacttaaatgcagcaatatcttaatataaagggcagatttaacatgtcaatcgagcatataggataaaagtagttaaatcaggtaagatcggctgaaaccccgatactaccctaatcggcaaccaaagacagactagagattgagattctaattacgactcataagatcaaactcaactgatgcagctataagtatgaaaagaaggataatatctagacaatcaagccgttggatatgtcatagagtggtggatatcctatataatctaagtcaacgtcggtatttaacctaatcggctgccttctagtaacagacgttagccgattagaggttagataacgatattgccaaagattatgtaagatatatgataactcgacgaattacataaacaagattagagtgtcataaagatggaagcactaatcccgagaacgcaagccgccataacaagttttacctcttgttaaagatcgaaaccgatgcagctcaacccgaaagcaagaactcgtcgaaataaaactaaagcaaaaaagggtggcgatgcgctgagattgttattgaacgtgtgttatcgattacatagggttcgggtctatttatacccgagaattacaagatatgtccataccggacacgactcttatc

SEQ ID NO: 42537 - DNA, 1501 bp, Oryza sativa
aagcttaattaacctttgcccgtgctgtcgcagtaatttgttgcatgcccagtattgatccagtccaaaccatttctccatgtactcatctaggcttgcatgctctgtggcaaccggaattcactaataaactggtaagttgttcctttagagtttagacaatacatcgaaagtgcttgcacattactaatgcacgacattttacatatttaggtgtcatgaataaaaatgtaaaccaaatttgactttttaaagggaaaaattgtcactgcatgcacaaatcagaactttccgtgtgtgtgcaagcatgccattcattaatatatgcaaagacaaacttaaacgacacaaggtaaactacagtatgaatacaagtggttcaatagagcacaattccagaattgaggtatataaccttcggtacacatcacagaataatgtatacaacggaaagtaaaagaagctctcaatattggcatcatgatttagataattaaattcttctttttaatttggatgtcaatttggatggtgatctctaaagagagcacacaacatgtgtatcaatttaattggtttcctgggctatgttgctgaccaagcaattaatgaagttcaaaagaaattatctgaattttcagatataaacatcccaataataacttaccttgttgcagtgcgaggccgatgccggggttgagaaatccgaccgcggggacttggaatgtcggactcacacacggccggaggaaggggctggtgccgggatcgaccgcgaaaatcgggcggcaacacttaggccagatcggagcaaggagggaggagcgccaaaaatcaaatggaagacatcaaacccaaaaatcggttgtgatctgtcgacgaatctggcttgtcggtccttactgatctgtctcttgattccaatccccatctctctaattctttttgttcgctctaattctttttgttcgtcctttgagcaatagggatttggtggagagtgcgttggtgacggccgcaagaggaatgcagtagggggaggaggagcgacggcgacgatgtgaaggcagtacggcgaggaggaggggatggaggcgccggagaggcagtgcgatgattagggtttgctcgggggagtacgtgggggaggcacgccggttgggcgaaggagggagcgagcgggcgaggcggcgaggggagcgggttttggggagagaacacgcacgcgggggaggaggagtgatctggaccgttagatgatcgggagatattctggtccgttggatttgatgaatgagtaacgtaggtgtaagagtgagttggtgaattatagggtagatagatagatagattagaagatcacacaacacaaacgactgactactcctaccgcgacggcttccaacttcccccaatttttttctcctctttttttttggaaaaagtacgaattacccccctgaacttgtgcggtcgatcgaattacacccgcgaacccgaa

SEQ ID NO: 42538 - DNA, 248 bp, Oryza sativa
tgttggctgatttgtatggacttgtttgctgatggtcatttgaatggatgagctagttggttgaatttaatttgtatggttaaatatgctgttgatggtcatttttcttcactttatgtgtgaatttcatttaaatggacaacttgtttgctgaaaggtatttttatggtcattggtttattatttctgtaccatatcatgcttgctgaacttaattttcatttctaaatattatggcttgtaggaaa

SEQ ID NO: 42539 - DNA, 1501 bp, Oryza sativa
gctcatagctgatatgtgctcttgattgttgctcagtttaattaccggcaaatttaacgagagtaaattcatcccatcagtgtttgtaatttcagcccaaatgcacctgtgagttaggcccaaagtggtcccaaaatctgcctaaacctggcacaaattcggtcggtagtgtcgcacagtttcacttatcgcgcggcggttatcgcgcttaccgcgggggtacggtaggagaaaccggcgatatggtttagatgaattttgaccaaattcaaaattctggaaaaaaaaaattggaaaaaaaatcatggatatagttcttgatttgtacttgctaatggtgaagaaattttttgaaatagagtaagctaaattcaaatttaaggacaaaactgaaaatagtttacaaattggaaaaaggaagacaatattaggccttaagtatcctacatattcttccaattattctcaatttttagttttctacacatattcaaccgtattttcgatttttttcctatttattttttatttacatgatttcagctacacagctcgcgataaccgtgcgaatatcgtggtaaaccgtgcggtaaccacggtgaaatcccgaaaccgccaagttctgaattcgaaattttggatgtgatttttgtacgattttagacggttaccgcactaccgcagggtgacggtaaccccggcccaaacgataaggtaaaccctggtcgcacaaatttggcccaaaaccgaccagttatcgcgctaccgcgggatgcctcagtaggaccttaggtcctaggttcgactccccatgggagcgaattttccagtatttaacggcattgtactttcagcggtagacgacataccggtcaacagcgaggcgtctgtggagacttcgtcaatttcaaggatgatttgccggcccagtcttcgaagatgctcataggggtaggatttgcacgcgtactttcatagggatgagtgtgcgtgcgttgtgagtgtctgcgttgtactgtgtaattctcaaaaaaaaaaatcatcctataactttcgacccgaaaacggacgtcaatttgacccaaaagtgcgtctaaagttatcccatttcacatccacggtaaatttaaagtttatacattaatgtgatttaaaatttaaattatttgaaatgtgtataaaataaattatctaaatattatcaaggtagtcatagatatatatcatgaatttatgttgctagaaatatccagcttataaaaaaatcctagatacatagctgtagcaaaagagatttagattttatctcgatttccgttagaatttttttcaattaataatttgtcaagtttgtaataacttaaacttaatcaattatgtgctaatgaatttctcgttttacgttacatctatttaatcttcatcttcatcttcattagtttcaaacaccaccttagagcaggtagaatattagattataagtcagctataaacacatatc

SEQ ID NO: 42540 - DNA, 1501 bp, Oryza sativa
cgttcgaatcgtgcccgcattcgtcgccggcgccatcaatggcggccgaaatccccgcggccggtttccttcctcctcggccgccctctctccctcccgttgctataaaatcgtccctcgtgctccgctcttccgtttccaccgctcgccgctcgctctcgccgtcggattcgtgctcgcgccgtgctccgctctctccgccatcgccgccgagctccgttccgccgccgccgccgctccggacttcctccttactcggcgacacctccgtccgcttcgccgtgtcgccgtcaacctcgtccgcgcctccgtttcgctcgtcgaccgtcggagcgccgccgtcatcgtcatcccgagccgcgccgccgtcttcctccgctccgtccgccgtttccgccgccttcgctgtctcggggtgagccgtggaccgtccccttcgtttcccccttccctcctctctctcgggtgccgctccgccgcgccggtggtcgccggcggcgaccatcggggcgcgggtgcgcgtccccctcccgtcggccgtgccggcgaggccgccttcgggcgtgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattggtattgatattaataccttgttcaccctagattaaacaaaaccccatctagtggacactctatttatggttccactagtatgaatttaggtagatgcttcgctgattcattaggcaacattaggtggttttataattttagactttgggaattctcatatcatttggacactttggaatggttggcttatgttggaattggacacacacctctcttcctctttcaaaacccctaaaacctgttttcggtggggtttgggtgcatgccagttgcgggaagtagcaccccggccactataaggattaa

SEQ ID NO: 42541 - DNA, 1501 bp, Oryza sativa
tttatgtgaggacttcggcatcaaaatttattatgccttcgtagcgcaccccatgagcaatggacaagtcgaacgtgccaatggtatggtacttcaaggaataaaagcacgggttttcgaccgactgcatccctatgccggcaagtgggtagaacagctgccatctgtactttggtccctacgcaccactcccagtcgggccacgggccagtcgccgtttttcctagtttatggagcggaagcaatatttgccagtgaggtggaatttgaatccctacgtttttgcaacttcagcgaggagcgctacggagaagaccgagtagatgatctcaaccgactggaagaagcccgtgaagcagctttaattcagtcggctcagtacttgcaaggcatgcgccgttatcataatcgtaatgttcaatcacgagcttttttagtcggcgacctggttctgagaaaaattcagactacacgggatcggcacaagttatctcccttataggaaggaccattcataatttccgaagtcactcggccaggttcttaccgactcaagcgtgaagatggtactcatattgacaactcttggaatattgaacatcttcgtcatttttatgcttaggcattacgtttgtatttccctctttgactgctaacatcaagtttttccttgaagttatcagtcgggggctactacaataataatggagtgtgatttttatcaattcaatttgcttacttgatttatcattgccttgcttgatttcttggcttagtcaatgaggactgaaagttttttaataatttttgcgggttttaggctcaataagttttgacaaaagcttttaagaaatcaggagctaagtttggaatatcaagcacaacataaattcatcagtattgtacaagttgtgcctccatcatcatcatcattgttatgatacaaacatcaatcagtatcagttttttcatcatcggaattagtagatccagtcggccggaggtcgttgtcctggaatctttcaactacatcaacggctatcttatcggcggctttctgcgcatcgttgatgaggtcaagggcggcttcttcgctcgtcccgtctgcaaagccatcaacggcgtcaatgtcaatcttcgggtacaaagacttggtcattgccaatgctaggctcgctcccatacttccagcttccttgatattcttgaaatatgtatccggagcaattctcagcttgtcaaagatttcggaagcgtcaaatgtactcggaccattgttattgaagaacatcgcttggacaagtagtgtagcgacgttggcaacttcatctctagcttcctcaagccttttaattttgttgaccaagacatcaaattgagcctgagatttgatcttgcgatctacataaatagatttatatcaatgagtgggcataaagaaaggaatggtttttaaagtataggttacccgcaccttcaacatatttcagagccgaatccc

SEQ ID NO: 42542 - DNA, 483 bp, Oryza sativa
tagacatgtgaaagtacggtagtgctttcaacagaggcccgagcttaatccttatagtggccggggtgctccttcccgcaactggcatgcacccaaaccccaccgaaaacaggttttaggggttttgaaagaggaagagaggtgtgtgtccaattccaacataagccaaccattccaaagtgtccaaatgatatgagaattcccaaagtctaaagttataaaaccacctaatgttgtcctatttaatcagcgaagcatctacctaaattcaaactagtggaaccaggaatagagtgtccactagttggggttttgtttaatctagggtgaacaaggtaataataataacaataacaataataatatggtcataacaaaggtaaataggcatggctaaataaaacagtgataacgcgggaatttaaataaagcgataatgcaataatttaaattaaaataattttgtaaactgggatttcaata

SEQ ID NO: 42543 - DNA, 332 bp, Oryza sativa
ctgtttatttttattgtcaggcttgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttactcttttcttccttcttcaaatttcaattagt

SEQ ID NO: 42544 - DNA, 1501 bp, Oryza sativa
ggaaacaacatttatcgttttcgtttttatattttttttcggaatcggaaaccccggatataaaaatggaatcaaatattgtcgaagccgaaaacggagcgaaaacggaccggcgttgatatggtaacgaaaatttatcggaattcaaaaatccctcaaactatgttttaaactatgtcaaatccaattcccaagtctcaaattttgggatggccggggtgggggggaattatagactatggtatgggcctttataattccgataaatttttcggaaagtttccgaccgattttgagttccgatggaaactgcccttatcatattcgattctgtttccaagaaaatgtttccaattcgttttcgtttccgtttccgtttccgaaaaaaaatccgatcgacagattccgtttccaaactaggggctagcccaatccagcccatttttggctggcggccacctcttctattgctcacttcagacttgtgaattttggcccaattaatcgtgtcatttctgcgttcttggctcatttattgataagtctgattctcgatatcatccgattgattgatcgcctattttgatgtcaattctcctccgttttatgtttattctctgcaagagcttagtaatcctagtgctagtagaatatttattattttaacataaatatgcattgcaagtataactagttctcctttattttggtaatattgacgggcgaaactgatcgcagacgaccatcaacagtgtcctgatcaagcgtcctgatatctctatataagctaagcggagatcgtacgtcgtgcaggagtcctgatcaagcgtcctgatatctctatataagctaagcggagatcgtgcaggcgccctgatatctctatataagctgagtggagatcgtgcaggcgtcctgatcaagttcggaacctccgccttcgacgttcagcaccaggagaaggcggcaataaggttttcgggaagcgcttcgcacgactgctccctgttcatgctttattgtctagtttatatgtgtagatctaatgatgcgtttatgctagtttaaatctgcaatgtcatgatttatatatggaataaattaaatcgttataggcttataaattcaacaattttaaggcttcaaagcttcatattgaaatagagcagctcaatcgactaaactcaaagaagtgaagttaatttcattcaacaaaatcacacagcaccgggcaaatcagacagttacaaagtgattgataaaaataaaaactccgggccagctgatgttcatcagcaaatattttacaagaaaaaaaaaggttctggattattaagacaaggcttttagataaccacagatatattgtgctccagggttcgatctatcggaaagggaaaaattctgaaattccgatccgaaattgtgaatcctgttagagcctctagatatcaaaaccgcattatgtaacggccccagaatgggaaatcgatcaggtagc

SEQ ID NO: 42545 - DNA, 240 bp, Oryza sativa
cgaccaccgccacccccacgccaacgagcactccgcccgccgccgcgccgacttcctcgccgccaaccgcgcctgtcgcgcccgccgttgccggtcgcgccgccgcccacctcctgccaccgcgctgtgtgagagagagagagtgaagagagagaggatgagggaatccgtatgacatgtgggtcccacaattaaaaaaaaagaaaatgctgctggattgccacgtgtacgccacgtagg

SEQ ID NO: 42546 - DNA, 1501 bp, Oryza sativa
catgtttaattaattccatgctactcttaattactccctctagttctatattaattgacgttttggacaagattgagattaaatttttataactttgaccatcaataactttaaaaatatttagtttaaagaaactagaaaaacatatatatatttgtctttcaaaacactataataaaagtaaacatgcatttatttattgtatatattataataaaaaataagaacaaaggtatatcttgtagagcatgtcattgtccaaaacgtcaattaaaataaaaccggagggagtagagatttgcgggctaaattcaacggatttaacttttactcctagaagccagttaatgatgttttgcatgtcacttttacctttggaccagagatcatgcaaatttggtgcaagacaaatatgaaatttgatcattgatgtgccaaccaattccaatgttgtgccacaccagttttcacgtgcgatggttaaatcgttcaaggaatcttataatcaaggcaaagtattcaactattcattatccaaacaaggaccctctttgtccaacaattttggtaaaagggaatgtatcaattaaatttgtaaccgaacgtctatgcttttgtgttctggaaagttattttcctcccgagatatccaacatatctaacccagcgtaggttacacactaggattttagagaacacaaggacttcacgaggaaaaaaattcctatactccgaacacgatatactctatccagttaaaaatattttatgattagaacaaaattcagttaaacttttaatgacacttcaaccatcaataatttattaaaaacaaaataaatgatatatgtagattttgcctcgaaaaattactactactatcatatatatcacaagctcactagattttataaagagaaaatttcttatgtgcacatgagttttcacttaatcccttctatacctctgaattttatctcatcctgttttcaaatttacgatcaagtaactatattatgtttgtttttttaaaaataaatcatttttttgttaagggctgtctttttcaatcaacttgcacacaagtacactaacagacaagggtaatatggatatttttacaaaaatctaatggtttaactatcgactcacggaatagacatggaggggatcaaaataaataaaaactcaaggctatataggggatgaggctaaatttaggggcacataagggaattggcgaaaattcgtggacataaggaattttatattttataaaacttattgtaatatattattttttttagaattttaaaagcttaactgaatcttgacctaaacattaaatatttatctcattctaatcgatgttaacaatttctcaacttttgctataaaatcttaatcgcacgtaaatgataggcaccattgcactaggtgtaaaataaaaaccttatcctctactccctcggccccaaaataagtttattttcacccatct

SEQ ID NO: 42547 - DNA, 1501 bp, Oryza sativa
ataataagttggttgtgtttggcagtgttttttcccttttgtaattgaataacctgttaactaaaaactaaaacctaaaaaccatagagttcacgcggtattaacaagatgcatgttttattgaagacaaatcctcaatatgatttacacaatcatagcaataccattgatgtacctaacgagcggtcatatatttttggttaattaacatagacatatatggcagatacagatatagattgaacatgacttgattagtacatgcaagtgaagtgaaattacgtagataaatattaattacctttcatgctccagataggctcgtatgtcgtcgatgagttgttgcacgtcgtcgcaagcttgagacgtgccccctatgtcaagcttggattggatgctactgaggatccttgttatgtcaggtttgtgggatactgagacgaatgccgtgcaatcgaattgatgcccgatcttgtcgtacacatattttgcaagagttgttttaccgagacctccaaatcccacgacggacaccactttgagttgtcgttgatcggtatcacgatctaacgacaacagctggattagttcttggcttgggccatcaatacccacaagactcccggcattttggtagagcgatgttatccgtggatctatagcaggattggcagaaacaccatgtttgttgttacagtcatcaagcctgtatctcacgcgacgctcatttgcctcgaccacacgagccttgagctcattgatctggctggctatgcgatgacgcacccgcaatgccctgagacggcgagctatcttgcggattaaccctgcatctgaggaagagtaacgatgatcaagatgacttgtgaagtaatcatcaatgcagtcttccatgtcataggccatctccctgacgtggttcctccagtccttggccagaggatcgagctcaccatcatcatcatcatccatgagcgcgagcttctcgaggaaagcgctcatggtggtgagctcatccttgaggaaggagacctgcttcctgagccccttgagcttcttgtactcgtcgcccatgagcgtggtgagctttgccatcagcgggttcatcacccccatggatgcactcaccaccatcttaatttctttggtctctctgctggctgatcgatcgggttaatttcctctcctggtttgatcagtcagtacctagctagtggctagtgtgaccttacgtacgtgtgagaggtagctagctactccagctacaacaagcctgcaactgagcaaccgatcgagttttcctgtatatatatactatatacaattagccccaattagtgcagccatttgttgggggcaaacatttttcttcccttgagatttgcgcaaccactagttaaaatagagagattacagtaatgatcttactagcttcgagatccacgccgactctctctcgttctcaaattgatcatcatataataattttgttaaattgatc

SEQ ID NO: 42548 - DNA, 1501 bp, Oryza sativa
gagagaaaatctagggagagaagctagagagagaaggagatcaggtgcagaagtaatgaggggtgtaggggtttgacctagggtcaaggtagctagctctagagagttggaggagtagaagcagcagcagcatgcatgcaatatgcaagcatgcaatggagatgaatggcatgtcataagggggggctagtagctgtttggtgtgatctagaagcaatgcattgtgcatatgcatatgcaatgcaagcacaagagaaagggcatgtttaattcaagaaaagaaatgtttgggtgtcacatcggatgtttgactggatatcggtaggggttttcggacacgaatgaaaaaactaatttcataacttgcctgaaaatcgcaagacgaatcttttgagcttaattaatccgtcattagcgtatgtgggttactgtagcacttacggctaataatggacttattaggctcaaaagattcgtctcgtgatttccgcctaactatgcaattagttttttttattatatatttaatgctacatgcatgtcttcaaagattcgatatgatgttttgggactaaaccaggccaaagagagagaatagattggtagagatgaaggaaattctctgacttagctgtatgtgcaattgagccactgacatgcgggtcataacgaaagtggaatatacatgtcagtggctcaaccgctggattcttggccatgtaatgcatgcactggattgcaagttgttgggttgtgaacagccatatggtatctcatcactatcatgcatgcaatgcagccacacacggtttaggttctttctgctgcacaaatgctatcccgaccatggtttcttgttatagtttttttttttcatttgcaaaagagagtattccctctttcagaataatatcatttatggtttattttcagttatcctaaaataagagaaatgcccagggttttccagctagctccacaaggtggtgtgggctagacgacctgggttcgaagcctcaccccttctaattatttgataataggtccttccctgatattcgtgtttttaattatcctaaaataagtttatttttagctatcattaaatcaaagtttctgaaagcagtggataaatgcattgggggtggataaagagagaaataattgcattgagatttgataaggtgggggtattatattattattattattattattattattattattattattattattattattattattattattactattattatatatgagatgggtgaaaataaacttattttggggccgagggagtagaggataaggtttttattttacacctagtgcaatggtgcctatcatttacgtgcgattaagattttatagcaaaagttgagaaattgttaacatcgattagaatgagataaatatttaatgtttaggtcaagattcagttaagcttttaaaattctaaaaaaaataatatattacaataagtttt

SEQ ID NO: 42549 - DNA, 1501 bp, Oryza sativa
gttgtgtatgtaatggtttggttgatcctgaagctttttggaggtcttatttcagtcgaggacaagcatgagagtcaaggaagaaagtggatcttcattttgtcagacaattgtgacagtcatggagcatgtaagtagtactagtatatagtttgagtgtatgactaaccctgaatattcattcctatagtaaatagtactcctatatcatattagagattctgtggttggattaataagtagtgtagctatatctccagatgatgaatttatatgtgtccttgatatgaattaatgatatttgtggtgagtgttgacctctatattaacaaatgcatgaacatgagaggatttgcacggcaggatacggaggcctgcctgcctaactgtagaggatttgcattatgtactgcttactccgtcccaaaataagtgcagccatggtttttcgcgtccaactttgatcactcgtcttatttgaaaattttttgaaaaaaattaaaaacataattcacgagtaaagtagtattcatgttttattatcttataacaacaaaattactaattataaaaaaaatttaaataagacggacgatcaaagttgggtgctgaaacttatggctgcacttattttgggagtgaggtactagccgctactgtcaggagtaggcatgtggttggcttctggaaccgtacgtgttgcgtttttcactcagaacaatagtgtattttttttatttagataaagctgaacaatagagtagtatgcttttattttgctgaaaatcaattggactcgtttgaccgtttgatttatgactccatattttactgaaatggaagcatggattcctaaaacagttggctggtgcgtcgatttatattaattaagaagtaagtcatggcagaaaaattctcaaactagttatttgcataaaatttgagaggtgtgagcacatggaaccagtcgtacgacgagtagactcacggcaaaggtaagagagttgcagacttgatggatggtgccacgtttttcaaagaaagggaaagaaagaagccgggaaatcaaatcacacgcgagagagagagagagagacacgtactatgctagactagacaacacccaaaggcaaagagagggagggaatcatctgctcacaccaaccgaactcgcaacctaaacacctccctcttcgattcacttcatcttcctcttctcttctcgtctcttgtagtagtatatatttataaagcccccaaacaaaagagaagacaactgaattagttcgatcgatgcaggcaggcaggccttctagttctacaaagatgcctctaatggatcgttttcctttcctatcgatggcttgattgatacaaagccggttttttcactcctcgggcgtgcgtttcttgacaccggccggattgatctatcatccatccatcgagtcgagtcgagatcgatcttgatctcgatctcgatcgatggaggaagccaaga

SEQ ID NO: 42550 - DNA, 309 bp, Oryza sativa
gtttaagggctccaacaatagcatcctcattcccatccaaggacataataggcctagaaatactcggtagtgcagactctatctgcaatatataatagcaatatgtaacagaccaaatatgaaaaaaaaaagagtgtaggattgaataacatcattgaaattcataatgaagcatatcaagaaagacaagttgaagaaaaaaaaaacaagaacactatctagtataatgtatttttaactctcaccggtcttctgtcaagaatagatatcaatggatagctctccttcaaacctcgctcaatctgagaa

SEQ ID NO: 42551 - DNA, 1501 bp, Oryza sativa
tcacgcgaagcagctcaagaggctccaggagaaggttcgtctccgtcctcgccgtctcctacgattcgcgcacccttctcccaagcttatattgcttactattattacttgttactagtaagcatcaaaagtagcatctgaattgctcggctccattccatatgtaatgcctatgttgatttagctttgggctgtttatactaggattggggattctggtatgtgttttttattctggtatgtgttattctggtatgtgttttttattcttatatttatactaggactgagcacgcaaggcagtgaatgttagaaggtatattgcatgcttaataggtggatattggctcgctctcgtatgcatttggtaaacttgtctggttggcccttgttgattgattttattgattttggaaatggactgcaatcttccgagttttacacgcggaagtttgtgcagagtactgaatagtgacgtggttgctgcaaataagtactataagcaaggcatacaagttccttaacaaatataatgatatattttagccattctgatcattttgaagaaggtgatggtaaactaaatctcaagttctgattgtgcatttggtaatcagggcaagtactataagcccctatttattgcccataaatttgccacataggattagatgatgagttggaggagagaagttaggagagagagaatgagccatccctcatgcaaggggcaacctccacacaatctccaagaaaaatgtaagatgacgtgagagtaaactaatattggggtttgtgtactagatgtgacatgttgtatttgttacctcttaagtaatgagaagatgacatggtttaaattagatgtggcactcacctccactataaaacttgccctcaggaagctagttgtaatgtcatagggattgctggtatgtaaagagtacttttgatatctagaattacgtagctcagtactgttatgatttttttctgcttacgttggatttatagctgtttatacataaaggtagttctacagttctacttgcacttttagtgtggaataacctatggctctggtttagcggccctggcattgcaattgggacagatgaaactgaagaaatcatatgtgttaagcacatccagattccagtttaagtactttcagattagttgcttgcactttgaactagccctcttttttggaataaagaacatgttattgactcgacttttggacagtcttattctaaaaataattgatactttttgtttcctggtagtgaccattagacggctttttacaaatttagatgataattatcattgttcaatttattgctgaaattcttatctgtatgcatcattgttaacactgcaacaaccaggaagtttttcttgagctaatcatttcttccatccctagttcttgtcatatctgtgctgctgtattctgtcagctgcttacgatggctgcaaaactcttatttgtagg

SEQ ID NO: 42552 - DNA, 1501 bp, Oryza sativa
gatccagatcggttgtcttatagagcatgttcacttagataacattttcaatcttaccaaattttggcaaagttgccaaaaaaaagtggttacatttagtttgctgccaaactttaataaatatataagaaatcctgccaagatttttacaatattgccaacataccaaaattttgcaatgccaaaattggtaaggtttattttggctacaatttgaacaagcccctaatatgtgccaagcgagcaagtcttgcttcttcagtcaatcccccctctctctctccaaaaacgatcgtattttatagagagagactagaggacgggataccgttagaatgagatacttagagtgactcatccccttttttttatagctgagcttccacgtcttttctccttgtcttgctagccatatcaacggaaggaaagggaggaagcacgttgaggagggaaaggaatgagaggacatatggcagcaagaggttcattggccgggcacgacgacgatggcatgcgctccctcttcacacctggtacatatggatgttctggctggtatctggtacctcggataccagctggtatctaggtatcagaccttggtacctggcactatatattatcagaaacctctattctcctctttaaagaaaatatcatatttttagataaaaaatatctattttcagtgatatttctagaagaaagaagtgaaaaatcctcactttgttttgagtttggagggagagagagtagaggaaggaaacctccctccggatccaggaaatcctcatccatcctcatgacttccgacgagctcgccggtgagggtgaggtcgacggcgcggagctgatcctgtcgctgccggaggacgtgctcgggctcatctccgcccacctccgcccgcgcgacctcctcgccctctccgccgcctcccgcagcctccgcaacgccgtctccaccgccgacaaggcgtggctcgcccagtgccgccgcctcctccccaccgcctcccacctcctcgcctggcgcaccgccctcgcccactcctccctcgccgtctgccgcttcctccactccgccgccccgctcctcggcctctgggcccaccagaaccccgagctcggcaacctcgtcctcgccctccctggcttcctctccctcgtcgccgtccgctccatcccccaggagctctccccgcgcctcctctgggcccccgtcttcgagctcctcgccgaccaccgcggccaccccgccttcctcttcctccacggcgccgcccacgactccctcttccccggcctcctctcctcctccctccaccccctcgccaacaccctcttcctcgaggcccacacctccacctccacctcccacttctcccgcctcgccttcgccgaccgccgccgcctcctcaacgccctcgtcgccgcctcccgcctcaccctcccccccgatgtcgccactgccccgctcttcgcgcgctccgacgccgacctc

SEQ ID NO: 42553 - DNA, 1501 bp, Oryza sativa
atgtaattgactgaaagacacaacaaaaatgtgaaactgtcgatgaaaactacaaaagttgtgtaattagttgtaggacacccggaggcattattttataatttccgggctgaaagagaggagataaatttcgtaatgacgggaataccccccactactccttcctttcttctcgatgcagcggacatgtaggcccgcgcacagtgttgtccttcctcctcttgccagcgctccactccaaatcctctatcatccatggcccaaccgactgctaccttcacatcttcaccctcaccgcccctgtcctttgccttctcatctcgctccggcctcagtggtgacgctagcggtcgccttcgtcgtcgtatcctatgccgccctccttctgctgttcgcatgcctctgcgtctacgagcggcgccggcgagggcgtggctcacgtgtgcggtatgggcagcctccatgctactcaccaccatgttcgtatggaaggtcgcggcgctcatgctgtggcccgtggttgccgtggtgtgggggctctccatagtcaccgtgctcgacatggtttaccacagaactttactcaaatccgagcgattttgatcgagatttcaaaatggaatcttgagggcaatcgaagagtaaagtgagagcatcaaatcccctcagcctattctggaaaaatgcgagggaatcgattggattttagaagggatgcaacggcgttggtcggcgttggacgatggcgagaagaggacgacgatactgtacgcgggcccacatatcagctgcatccagaagatagaaaaaagtagagggggcattcccgtcatttcgaaatttctctccccataattcctcccctatcgttttttccttctttttttccaggtagagcagagggaacagaggagcggggcactggtgctccggtggctgggaggtggcgacgtcggcggccgaatgtgttcccgagcgccgcgctggagagccccgagctgcgacggcatcacgccgactaccggccgtgggcggcgcacatggaggcaaagccggtctacttcgcgtcgaggcgtgcctccgggcggcccgagctgcagcagcagctcgtccggcccaccccaatctgggccgattgggccgatctcagcctcccggagcggagaccgatctgggccgtccatccgcgccgcccagccaatcggacggtgggtgtattactgtactgccaggtcggtgaccgtacaagccggaatattcagtagcgtcgttcgctccctggcttctccatttcttcagctccgccgccggcggcggcggcggcggcggcaggcatggcgcgccgtgtcaccacccttacccgcgcccgcacccgcgcccgcggcggcggcgtccccagcgcgcagggtggtacgacccaagacctagggcgcgcggggggcagtggcaccgagggcgcacgccacgtgctcgacgaattgccgctacggggctggggcgc

SEQ ID NO: 42554 - DNA, 1501 bp, Oryza sativa
gatgcataaggctgcgccttgtatcattattcgtggactaattaataactagagtcatgcatcgatcgatcacacagcttgtttatatgtacaatcagtaacagtagatgcaatgatcggcagcctttttctcctagcatcgcggaacatttcatcagagcaagtttaatagtatagcccagtactagcttcaaatcatctataaccaatgtaatagctaatacatacaatagttgcttacgtataattaacacctagtccaacctgtcatacacacgttacgttttagagtccgtgctgtagctggctacagatctgtagcctgctgctcttctctctcttcctttatctctttaaaatatgttatagctggcttatagcctgctattgtacctgctctcatcaccatggtcgatcttcgtcgtatactactccatgtatgtgcatgcatataatatatatatatatatatatatatatatatatatatataacactttttattttaggttataagaatttctaacattatcagtaccgatgttagatcgatcgattgccagcgacggcgcatttcagggagaagctcatgcctagtatactccgtagctaattaattgaccatactgcatgcatcgatctgcttttatataatcctatatgtacgccaaatactaagcaaattaaagtggtgttcttttctcttgaagatgaagataaagattaatgcttttatgcaaaacgagatagtattaacgtatcattgattgagttttaattattacaaatttaaaaaatagattaatatggtatttttaaagtaacttttatatagaaagtttttgcacgaaacgtaccgtttagtaatttaaaaaacgtgctacgaaaattttaatcttcatcaactcttgttggagaaaagaacgccaaagcccggcagagtcttcaagctgctgagacttgtactaccagctgcttgcggagtgagtatgagtattatatgcaacacacttcagcaatctgttcccaaggccagcagtacatttttccttcatcccaatttgcttttgacatgataggatctttaattggctgcatacataattaaggaaaaaaaatcaaaaaggcaagcatatgcaagctagtcaaaagatgattgctactagcgtcttgttccaatgagcagcaggcacagccgtaacaacgcctttatgatgatcgaaatgagagagatggtatatatgagaatgatgcacatggaggaacaacatataagcactcgatcgaatctctgaggtaaggctgaaaagtgtcttatgttgatggcgcccatggattgattgtatttccccttctttttggaacacaacaagcagctgctaccaagcacatttatatcgatagagtagcatagtatccttctctacatatgtggatgggtagcgtcacgtcttatatagtacttcatccgtcgtataatataagagattttggagagaca

SEQ ID NO: 42555 - DNA, 1501 bp, Oryza sativa
gattaccacgtagaaccaaaaccacccatattaggctaagagtatattagttagtttgattaaatagtttaggaggataatttatcaatttctatagttaagagggtaaatcttaccttttctttactatagttgatgaggtaaattagacttaacccttgtatgtatgctcccgtaggtaggtatgaaggaacacatatgtaggtacgtacggtgaggatcctgcagatgcacttctttccacggtcgtcggagtgagttgtaaagatgatgtgcatggaggtactacgactgcaaagttggctcactttcacaactcatcttttgcagcaggatcttatatttgcttctccatcatgcatgtttgctgctgcctagctatatatacgtacgtaccctacctctaattatattgcatgggctgctttctggagacagaaaatggatgagcaacttctttgggggcatatgctgtctgcaaactcatatattccagctcccaatctttggatgcattttgatttctgcctgctgcagggctgcttgatttcaggggcacctttctttcttcagacattccagcttggcttccaaaagatgtttgcctatgaatcgatataatgcttcttctctgctggtgcagaaactaacaaagcatatgcatatactcgatcagtgactggtaatatgtgtcgttgtgcgttctgagaagaggtgatcaattgcacgggtagcaatttcatttttgtcccactataaacagacagacaacattttcttcaattgtaaaaaaagtagcttccaaggttacaaccttatagagttataatcttgtaatttttcttctgctctatcaatagaacttcgcaccgccttatgcgagtcgttaaaaaaaaagtagctaccatggctagcagtaagggtattatgtctttctcatgtaggtcactagtcagattgctaccatttgtagcaatcctaagtatgagtaaaatgattttaaaaatataggacaattaccagtggtagtggtccgaaacagggaccgaaatgaaaaatacctggtcaagacaggattaaaatattaaaaaagatgtcgagccattatcaatgttatggtccaaacagagaccgatcaatatgaaaagtaaccaggagctgaattgcaaatgttcccgtactgggctccttgggccggaacggccgtaagtggtctgggcacaggctttgatgcatctcttttgtccttgttgttcttacttccattccattgtatagattttaattgttcttaaaaacaatagcaaatgtacagactataatacttaagttttttttatgcagttcctttctgtattgaacatgttgcgcaattccttactcctttacagtaggacactttgttattgagaaacacaaacaaaagaacaaaacagaggcgccagaatgataaaaacaatagtatagtttggatggagcaataacataataataatatcta

SEQ ID NO: 42556 - DNA, 1501 bp, Oryza sativa
caactcaaaagtttcaaggtcccaaaacttaactgtcttatcagctgaacctgcaaatatttttgaaacaagaaagcaatgtataggctgtcaagtctagatgacacaaataagcatcagtcaacaatgatccatgccagaaataataatattcataatagcataattttggaggaaaacatgtcatcaaactgccagctagtacactacagtgaatgcatctactacaagtgttataataaaggatcatctatctaacctgtagccaataagaactcatgggggtgaaaatctaagcagttaattgggccttcatgattcctaaagtcatgcaagagctttccagctgtcaaatcccagatctagcaagatgatcagaaaacaatttcagtgacccgagagatacatatgacagcttaatggttcgaataatcagcatagcatgttatttcttttccagtgctgtgattgtgtttgccttgtattaatagacatattcagaattgtacctttacagagttatcagatccaccagagacaatccaccggccatcaggagtgaatctaagcacatcaatccgccgtgtgtgacctttatatgtgtgaatgcatccctttttccgcatatcccatattttcatgttagtgtctgaagacccagaagcgaagaattctccaaaaggatggaaatcaagggacgcacaactcgatctatgtccagtaaaagtacgaacgactgagcaaaaaaaaattaacaaagttatagttgtgtgatacaactacagtttatacttcggtttaaatgcagcgaagtgtttctttaaatgaataatgcagcaaattgttatccatattagttcgtaccttttgcttcatctacatcccatatctttattgtcccacttgatgctccagcacctatcatagcttcagatgagtcaaagctcactgactcaactggactcgtaaggcctgacaggctctgcaattcatagtgacattaacttgtaagaagagatgtaactttcaaactgactaataaagaccccataaaactgagtaacaaagacaaggaagaaaaaaaagaagtattacacatgaacgattgacctttcagaggccagtggaatattaccaagatggaactgggtttccctatggcccaaagattgaccttttggtcctccccaccagtgatgaggattcttgatgtcttcctcccaaacttgacacagttgacatcggaagcatgcgcaacaaactcctctggccattgtcaaggaaacatggttggctgttgtagattaccatttggcatttgggcaattttcagtgttgcttcagaaaatcacttttttggaagggtatttcaaaatatacatttcaacaaggtaacgcaatttactgacataacaatgcttttcgggttaaaccatgttcatttcagtgaatgtattatccatgatatctcaccatctaaattcttaaagaaaagagctac

SEQ ID NO: 42557 - DNA, 1501 bp, Oryza sativa
tgttatatgccaaaatgctttcagtccctctattatagcagaagccaagcctgaacattttagctttccccattgagggttagggtttccgtacacggtagattcggctcatcgcactgagcggcgggggcggtctcaggtccggcgtgcacctcgtcgccgtcgtctttccagccggtatgcggcggggtgaggggccgcaagcctgttgccggctaggtctgggacagatataggcaaggtaggtggatcgatccggtggggggagagcttggggatggagattcgtccatccgcgacgatctgccagaagccaatggtgggccggctaaatacagtacaaagttgaaaatgatccgccaaaacagtgcactttcacatcgatgtgtaaggactttattcaatttggttcacaagttggacaagtttggacgttacacaccaaaccataggttaaaggtgatcggatctgagccgcaatttgattccaagttgaaacaacacgtgcttaaactattaccgccattattacagctataagtaacaaaaaaaaggaagaagagagagattaggagccactgactttgactggctgtcgtcgtcggagtcaacggggatattcttcctttttaccggtcagggcggccgggcccactgcaaagtgacgtatcgacagctctgcttatgccagccactctactgttctgtgcacaaaaaaagtgagaccacgtcaaatatactagcatccattctcttcaaattactagtactagagaatctgctgatgatgctggatgctcctctttcttccgacaaattacattactcatcatattgtactttgactattactaaattgctaacacagctcacatatatccagactaaatgaaaaggtaagttaattaaaaatgatttgaaaaaaggacaactatcaacagtctagctgctccataccaaatggagaattacagatctccaaatgtgaagattaaaacaaggaggtttgagtataaattgcttaatgcatactccttccgtaaaaaaaaagacaacctaggatgattgtccagattcgctatactatactgtatcacattccattctatgttgtatttttttttaaaaaaggagggagtagtgtcgatgaagattctttcacatacgtcgtaggacatgtgcttttaatatctaggcccactagggtggacctcacgtgtttgtgacccacattatgttgaatttacgttagaggatctatttccatacaatgtaatgtgatagattttctttgagcttatataggtttaaaatcaacactctaattaaaacaaatgagagtaaaatataatacttagaaaagttctaccatgtataatatttttgggcaatctcagcttgccatcagggcgctgcttaattagcttcccctccattttttgaaataattaagttttcttttactaatctatttttggcataagttttctaaaagggtcaa

SEQ ID NO: 42558 - DNA, 1501 bp, Oryza sativa
ggcagcagcgagacggcggccgacgccatgcgcgacaaccagccccagcctgcggccgtgccttcctccgcttcgtcgcgggcgctgcctccgttgcaaagaggggataggccggcggcggtagagaggtggccggcgagcccaatcgagcttcgccgcctcgagggccttgtgttgacgaaaaaatcgaacacaccggcctgggagatctgcttaactccagtgcaggtccaaaggttgatgagatgcgggcgtgccagtcagtttgatcctgcaactgacaagatatgcaaatagtagatcaaaacagccgatcggctgacaagcggatggagtagttccagccgatagccgataatagccgatgccaataccagccgatagcgatagggtgtaagcaatcggctatatgtccaatgtagataatgatataaaggcaatcggctgatgatgatgtaataagataacaatataatccagtataaaccaatcggctgataataatatgatggaataagcattgatccgaaggttaaagcatacatcggcaggaggtccgatgccataaaatccaaaagattatattaaacaattaaatctttattgccatcggctaaatccaacttatatgtatatgcaatccttacaagccaatgcaacgtccagataactcaccggttgaaaccccgatgaaacccctattggcagtcaaaaagcaggctagagattatggttctaatctagcaacacgatttagctgataccggcagaaaccctaaagcgagaagcagccgatagaggtaaattgatatgctaagactatattaacagaggcatatgataaataggtagacaaatatatcatccaaaccggagcgatccaagaggtctaatgtactgatgcagccttaaacgacgccgatgtagatgagacaattgcctggaccgacggaacattggacttaccccttagccggagatcgaacactgatgcagccccgcgtcaggtgccaagtcccgccgaacgataaaataaagtagaaaaggtaaaaggtggcgatgtgccgaattgtattgatcgtgaagatagattacatagaccccgggtgtacatatttatacccatgggttgatacaagtccttgtcggacaagaaagaaactaacctaaagataaaaggaaaacataaagtccttacacactttcctaaagataaaaggaaactaacaaactattcctaattaatagataaactgccatgccgcatcctctttaaactcggtcacttagggataagcttcctttagtagattgatttccttaaccgaatatagtaggaatccgactattggcgacttgataactcccatcggctgattccgagatgctgcagccgatatgattctaagccgatgatgtctttgccgattaccaaatttcactgttaacaccttgcaacgggaggagggagagggggagaggggaggtggacaacgaaaga

SEQ ID NO: 42559 - DNA, 1501 bp, Oryza sativa
gacattatttgacctagtcaatgcagccatcatggttttaaatccattgtaatagccatggttaaaaccattaatcaaccttattgcaaggaaatgaatcaaccttattgctacctttagaataagaattgatgtattacactaatgcctagaattaactaggtttgtaatctccctatttataaagagaccttaagatcaacgagaatatgggcaaattcatgaatcactgtttctacttttagttttctaacacgttgtcagcagctctaagatactgagcaacaaaggtgaagaactcaccggtaactcaaagggtaagattgctcgccattttcccattcctcttgacgctggatctcctcttcatcgcaaccttcgtgctcgccatctacgttgcctcatgcatcaacaactcgacaagcttcttcgggctcttgtgcgccgttctcgacgtgacaggggctgtggtgctggctttgccggccgtggcccccggtctcctccctctggcttcgccagacatggaggaaacgccgcgacgatggaccaactgcctgcagaaccaccagagctgatagccctaactccagcaccctcgcgactcgctatgggcctccagtgatgcctgacacctgcaccacgccataacacattctggtggagtcgccgcgccactgcaagtcccatcgatggatggcaagggtgcggctacagcccgacgggctaccgcaggaggtgccagacatggtgacgtcatactgtcctcaccacggctggacaaaccacgctcgccacatcatatcaccgtcaccttcaccggagtactcaccaacgacgccgctgtacactccaatacgggctgaaccgccgaagctcctccttagaggcaccatcgtcgcgcgttgcggagccccttccttctacatagcagtaggtggctccagcggttccgtgctcgcacctccatctccaccacaggccccttcgttccccggccgcccgactgtagccgcggcagcaaacgcgcgccccggcctccaccgcatcatcaagaccggacatgtccctgcagagacgagtggcggcaacacaaatcggcagcaacggtgtactgtcggcagcagcagttcaagtgggaggatggggtggcgccaactaatggcccctatgcgcccgcgcctcccctcccgacttcctggaccgaaagcagcggcgggtcgaaaccgagattgtatcggctcatcgcccatttatttttatttttccagaattttcattctagctcctgatctttggtcaatttactttccgcaaataatcagagactatacatttgctttcagcaccccgtaactctctgttattataaatatgagtttgattcagcactctatgcatttccatgtcctttatttttacacgcactttattttttacaaattcacataaaatggcataaatatgccataatttctcaaaaattttggctatcacaatg

SEQ ID NO: 42560 - DNA, 1501 bp, Oryza sativa
caaggacagctaccgttaatggctgagaatcaatgataacctgcaatggagatttcagttgaaaacatggccatcagttcaattgacaaaaaatgggggcagtatcaatggcttgctcgaggtatgaggaggtgaagaacagcagtgagaattcagcttacgcttccgagcccagccgatgtcttctgcaatccctccgcgagaaatccctgcgagatgagacgaatgcttttagctcaggaacagcacagccacacgctagagctaagaagcgaacaccttgcagctatggcgggggggagcacctggaagcaggcggcgtcgacgaggccgaaggcggcgacggcgacccaggcggcccagccggagggctgcctcctgccgcgcgcggcggcgaaggcgacgagcagcgcgccggcggggaggaggcggagcgcggcgacgaagaaggggcccgtcttgggtatgacccccttcatcgccaccatggccgtgccccagaagaagaagggcgacaccagcgacgcccactcccaccactccctccccacgagcgccgccgccgaggccgagacgccatcctcctcctcctcggagacccgcgcgaggaggggctccgcgcctacgcctgcgcctgcgcctgggccgtcgacgaagcactcgacgtccgtgcccgtgccgacgcagtcgaccgcgtcctgcggggagggcggcggcgtcgcctcgcggcggatgggccccacttccgcgcctgggcggtcgtcgacgtagcactcgacgtcggcgcccgtgccgacgcagtcgaccgcgtccaccgggttaggcggcgtgtcgcggcgcgcggcatgtcgcacgccacggccgcggcgcgcgaggacaggggcggctcggcgcgtcctgcaaccgggaggagggagtggcgggaggacgagcacgtggagggacgcggctgcggcgggccacatctcgctcgccggtgcgctccgcaccggcgacgaggcgggcggcgggcggtaggtgttcgacgagcgccgcggcggcggcgagagacggcggcgagaggggagagggggagtggcgggggtgcgggcgagtcgagggacgtggatcttttgcgcgcgccacgtgtctctctttcacacatttttttccactatcctcttctggactctgggagactgacagtccaaaaaaaatcacctcgagctaatcaaaacccacaacggttactagaaaaaaaattgaaagtaaaatgtttatatatttgttccaacttccaagtcatttgcttgaaaataaactatgttaaaaatcgaaatcaactctaaaattaatatttaaaatataaattttggttcgagctgataagttcaggaaccaatcagaacatcgagtgatatcaacttgctgcacaaataatggagaaaaaaatatcaaacatatcacaggctcatttggaacacgggaattcaaactctttctgttgagatttctgcaaaat

SEQ ID NO: 42561 - DNA, 1501 bp, Oryza sativa
tgttttcctttattaaacttcaccgatgatcaccttagttctgtttttgaactgcaacgcgttgcggtaatgatgttcttggcactaattttgaaccgtgctgacctgtattttccgcctcatccacagattacgcgctcgagagcatggccaacgggaagcgaaacgacgagacggagaagaaggtcagcaagactcatcttgctccgttcgggctcgcggcgcacaagctgcagggttctctctggaccaacccgagaacaggggaccgtgacaggatggtctccctcttcggcgccgcggattcctggctcaagcagctcggagtccagcaccatgactacaactacttcatcactcaccccatgtgatctgaacagctgatctgtgtcatctgagaagagtaggttgcaacttgcaaagaaaccccatggctgcagactttggagaggaggcatcagatttttacttaccccagcgacaatggtagcaaacgttttaccgttttgtcaaaatgacactgacatttgccggatagagttttataccgcttgagacttgagacttgagagtttacctgcagctgaatatataccgaatatatcaggacttataggttttgtgtttttcttggctgaagatgtaaaccgaccgtgtacagaaagttttggaactattttgatatccaatatatgtcgtggttggaattggattcatactgtattttacctgccttgtagttaaagttgatgaatttggaattgcagtagattttgataatctcgatttggtggtggtactgcttttagccgttttggtatttggaaaactatgtttcaaacgacaatattactagttctcaaaatgcaaaatataaaatgtttattttaaaaaaaattaaaatataaaataattgtaaaatatatcacagttggaaaacatatacacgtatatatacatgcaccatcaactacagtttcacagttcccttttttctcacaaaagggacatgcttcgtatttatcagggaaagtgtctgaacttagatcgatagacgaagcttgtgctcaacatatacagctgcttcctttcgatcaactatttttttatgctccaaactacttgtacaaaggggcaacttccctcaatttgatatccacaacacagttcatagcaactatgttttaaccatctgatgacactcaagttttatccatttcagaatgcaagccgaaatgaagtagatgactaacttgggaacctcggaagtatgcactgatgcccaaattaccagtctaactatgttcagaggttataccaccatatccctgtcttctttcacagttcaagctgtgtgagatgttgggaccgtgggatgtactttaaatcttcacattgctgttttgcgccaatgaaatgttacaggtgcttcagtacagcattcatctgtgccagtgtctccagaagaatcttgcaacggccttttacttctcgcctacga

SEQ ID NO: 42562 - DNA, 1501 bp, Oryza sativa
tctgctgtaaaagttgtaatcccaccggtttcatagttcttgatatttcaaacacgtgaaaaagctgttcttagagtagacataaaggaattagggtgtgtttggttgtcggtcacactttgccacaactaacattagccaagttgtggcagctataaaagtgttgctagccacaaagtgtggcaaaattggcacgaaaattaagtctataacatgtgggagatgctattgaaaaaatatggcaagccatgattgtggcagtgaaccaaacacatgcctaacaaactgtgacagccacagaattagtgtagcaaagtgtaaccatgaaccaaacgcccacgttctcacttggcaaatgtgcactcactaagatgtctactctaaaaaattaaacaaatatgtaaaatgctatatgttaagtccatgtattactcgttatccctgagtgagtgctatattggacctaattaacttgtcttttttttttttggaaaactaattgagattctcctagctaagttcgtttatcatattttgatttcgacttaaagaaaagttatgtcctggtgacgacaggtgtctctttcggccgagctcttttgttggagttaccaatatatatatgaaggctcgggcccgatggcccggcccatgcatgacgcgaggttttggctcggcccagatacggcatgacccgactgatgtcgagcccatgccggtccgacccatatgtttggtcgtgtctggacctctatcttggcacggtgggctggcctgacccagtacagttcaataattagggaggcaaaataaatgagggacgaaaaatagacttactttagtcatataagacatggccaaaagagacgagggatgcgaaatggatttattctagccatataagacaaggtcgaaagagatgagggagcaaatagacttattgcaacaacgagcacgatagactttgttccttctagccgacccagcacggccgagtcttattgggtcgtgtttgggtcgttagtgcagcccatagacaggcctggcctgacccagcatgaaattaatatagtatttaataaaactaatttagtattgtaaacgtagctaattttttctataataaaaataaagtcaaaagacttgagaatacggattgttcccatatgaatataatgtggtataggaggagtatattatactgtaattcttcagaaagtaatgctgatcagacttcttgcgtaaaacgattcttttactccaacctcgtgggacagagaccaatcaaatgactctgttttaatctggagatctgttcaagtcaatatacattattttttgaccttcaaaagggataacatatccaagtaggcaggtcgtcatcgtcatgtatatttaggtggcatggtagcctaagggcctcatctttttttttcttaagcttatcagccaaaatttaaattttcaattttaaatttggaattgattttgaggttttttc

SEQ ID NO: 42563 - DNA, 1501 bp, Oryza sativa
atcttataaatagtagaagtgcataaccaacaccaataactaaacaagtatgtagggacaggtagccaggaaaacctgaagttctggtgccctatgtgcatgaccataccactcagcgtactcattgatatcacgcaaacggaaatcctgtaaagatggtcaattagacgtagtaagaatggatattagatagcatgaaagacaatatctatgcaaataaactgttagccttgtgaagcataccgcagaaagatcaacaatcttcagttgcttcggtaaacctttaataatttcctgataaaaatattgcaagcaggtatcgctttaaaaattcctccaatatgcagaatagtgtaattgtgacctctaaatgattcaggaattggtaggaagaatttcagagaagggcatggcaataatagacaacctgggttgttccatgtggcaagcaacaaaaaaccgcatcaacatttgaaaaatctgcatcttttattgcaactaaatttgggaggtcctgcatatcaaaagataaccagcagagtcttacaattttgatcagcaaaatgactacaatatggcccagaaattctaataaaaataaatgtactaccaaaaggttcaaccgattcttgatgtgccaaggataaaaaaaactcaggtcatttcttccttttaattttttgaagaaacaagtgtaggcaatctcgggtaccaaggagcatggatcaagaaaaaatcttacctgcgttatcaaatgaggaaatacagatccgaactgttcgctagcttttctatctgcggtcatcactttgatatgaaactgagggtggtttgccagaagccgaacaatctgtcaatgcaagcgtacttcaataattaacaaacagaaacaaaaaagaagtcgaagatctccatataggatatagtcatagaaaataaatgcggagccggatagaagaaacataagaacagaattacaagtacattcgttgaaaggaacccacttgtataagataacaacaacaaacgcaattggaaataacacgataaaatggaactacctcagctccagtataaccactggcccctagaaccgcaatctgcacctcctcccctgatttaacttgtgttgtcttagaagagtatagtttctgtggtgaagagacagatgccctcacacggagcgaagggcatccgacctacattgcagaaccatttgtattagtattcagggcactacacttattattttgaaaaatgggatgaaaaacatatcacctttggagtcgttttgagcatgaaaccactgcatgacttcaaattaagcccacagactcccttctacagaatgacaggaaaaaaaactcatttgattataattaaaacatatgtaatgaagaaatggcacgtataagttggaacaaggatgactctttatgaccaaccagatgcaagatgcagtggtggtggcagattactaagtcaaacttcttcaagttca

SEQ ID NO: 42564 - DNA, 1501 bp, Oryza sativa
cttgacgctaattctctcatcgatggacttattgaactactgtacaatacagcaaattaacgtgcgtgcacttaatttattagctaattcaatacagatcgattgcttcagtgatctggagaaacaggcaatgaacaggtagctaaattgattatccgatctgatcctcttaatttgcaactgagctgattgggcccatcttgagttcagttcggttaatgcaggccttgcccctctaacttaatttaagtcgcagcagaccgaaggcccatttcaaaaggaggttgggcttcctttaagcccattacaccgcctccttactcaattccggccgctctagctcaaccccttctaatctccagtctaatcgatgctgatttaaaaacttaagggtgtgtttggataatgggaaatgaagagtaggattgtgattgggaaatgaataaagggttaggattaaatggaagagggagaatgaatggttagtatttaaagataccttttgatgggtgggaaatcattttccaatcccattatccaaacaatacctaagggttttgataagagtataagtgcaaaacagagaaatataaaaaacatgtgaaaaatataagaatggcaactttgactagacaattgtaggaaaagaacaccgtaattagaggaggaaataaagactataaaacctcatattaacattcctcagtttttttgtcttcatttcaaagcacgaattacatagaaacatttttatatagcattttcttgtctgttgtagcattcaattcctgtggaagaccacggcaacaatacatggatcgaatgtatatatatacttgatgttgctttgttcccaattctaaaagcaagacatgcatatgtgccacacaattaatgaacagtctctgtcatagggccgggctacatgtgtattatgctatatatctgccagctgccacgtcttacttatattttcgtcatctatcgattcggttgctgcaacttgcaagcaacgacgatcgagtaattaactttgttcaacataatcatgcatgtttacactcacctcatcttcattaattattattaacaacacgttttgttcacgatcgatcgatcaaaggaggattagctatgacgtacgttgcaaattgggtatcagttcttgactttacgccttcccaaaacaatgtgtgattcgtcctgctacgcctacgcgttttgcattgcatgctgctgtcgtcgtcgtcgttgcttctcaattccatcagcacctagcagttgatctcttcaagccacattattttccttctcttttttttcttttttgttcgatacaacaataacatatatgcttttctatttcttccagcgcatgcatgtccatgtccattccttcacgccttgcacaatctccattgatcaccaattcaccggagcaaattaattgagctatctagctagctgcctgtccaagaacaatccagtgatcgatcgatca

SEQ ID NO: 42565 - DNA, 174 bp, Oryza sativa
gtccatcacaaaacatctaaaaaactcttgtactattttctcaaacattttttttcactaaacatagttactaggaaaatggtaatggtcaatgttgcacaaaatggacagacaccatcagggaccaaacaaataaatttgagtagctagaacctagaagggagcagaggacca

SEQ ID NO: 42566 - DNA, 1501 bp, Oryza sativa
ctacgtttacaatactaaattagttttattaaatactatattaatttcatgctgggtcaggccaggcctgtctatgggctgcactaacgacccaaacacgacccaataagactcggccgtgctgggtcggctagaaggaacaaagtctatcgtgctcgttgttgcaataagtctatttgctccctcatctctttcgaccttgtcttatatggctagaataaatccatttcgcatccctcgtctcttttggccatgtcttatatgactaaagtaagtctatttttcgtccctcatttattttgcctccctaattattgaactgtactgggtcaggccagcccaccgtgccaagatagaggtccagacacgaccaaacatatgggtcggaccggcatgggctcgacatcagtcgggtcatgccgtatctgggccgagccaaaacctcgcgtcatgcatgggccgggccatcgggcccgagccttcatatatatattggtaactccaacaaaagagctcggccgaaagagacacctgtcgtcaccaggacataacttttctttaagtcgaaatcaaaatatgataaacgaacttagctaggagaatctcaattagttttccaaaaaaaaaaaagacaagttaattaggtccaatatagcactcactcagggataacgagtaatacatggacttaacatatagcattttacatatttgtttaattttttagagtagacatcttagtgagtgcacatttgccaagtgagaacgtgggcgtttggttcatggttacactttgctacactaattctgtggctgtcacagtttgttaggcatgtgtttggttcactgccacaatcatggcttgccatattttttcaatagcatctcccacatgttatagacttaattttcgtgccaattttgccacactttgtggctagcaacacttttatagctgccacaacttggctaatgttagttgtggcaaagtgtgaccgacaaccaaacacaccctaattcctttatgtctactctaagaacagctttttcacgtgtttgaaatatcaagaactatgaaaccggtgggattacaacttttacagcagaaagggaacacacgcagagcaatatcgatagagattgggatcaggacgagatgagtcgtcgataacgtcaataataaatgaatgggccagaaatcttcccgtgttttttggctggttacacaaagcaacggccatggagctcacacaccagtcagctatagtggcttctaacgcaaacaagcgaagcgtccgaagagacgcgacgcgtggcacagtactctagctagctaccgcctcccaaggaagaggagaaatcgaaggcatccaaccattcgtcatgcatctagcttccacaaactttcgatcgatttcactacaagaagaaccctagttagttagcaagtataattagctcactagctagtactagcagccatggttgttcaattgatgct

SEQ ID NO: 42567 - DNA, 1501 bp, Oryza sativa
cggtattgttcttttgttcatgtgccaatgcagtgtgatttggtgcgctctttttttcatattttagtagatagcactctcccttggttatacaatcaagggctttttagtggatggaaagaataaagaattccatgcttttgtacatttgtttagagaaacaatatacatgtgtttgcaaaactgtgagctttatgcatcgtactgctgactaaaagattatcttctcactctgttgagttggtttcacaaccctatcgaaccactttgaaaaaagtctgaaacaacggattgggtttgcaccagccaattcacctgcatctgttgcttaaacagaaataaaataaaataaattctcatgcatcttcatgacgattattggccagagctaatcatagatctttttcagtgatctcagtgacagaaaagatagcagggatttgtatgcccgtggttcgagggaggggtccatatatttattgggccgtaactgaattctgacctacgtgcagcccatattagttcggcctgaaaggacattccgatttattgcagcccattttgttgtcgggctggaacggcggtatcaccctagttgggctggacgtgaggcccaataactgatgcttaccagttgggccgacccgagatggatgaccccgttattgggcctcgtatcgccgccggcccatcccatcgctagtgctcgcggaggccggagcggaggaggagacggacgcggcggcggcgccaccggcgacggcctctccttcgtctcgttctccgctctgcttgacgggaggcggctcctccgcgcgtccccctctccgccgcggtgaccggccgaggggtgctccgccctccgcttctcccaaccccggacggggcgccgccgagccagtgctccccgacggcggcggcggcggcgaggaacccgtccccgacagccgaaactcggatcccaactaggaggagctgcagaaagccggcgtctcctacctccaacggtgggaaatctcaaatctctcaagtctcatctactgatttagttttgttcattctctatttctgctatttctgttgttattagttctcaaatgcctagatggatagattgaagaaattacagactaattgaaaatcatcaaaactttagctactgaatgagatgggtgatgaaatggctcaaccatcacatggtgagccaaagacatgtgcaacagccaacagtgcaagcattgaaaaaaagggaagatattttttcttctaacatgtaagaacccgaaagatgaagcttcctctcactattttaatttctcgttaagatgcgattttgtgattcatttatatccgtaggatcaagatggtgacagtgaagaagaagaaatctttgcctgctctggctcacaatacttattttcgtactgaagcttgttcattattgttaaattgagcaatcatttcctgactctcattcaggcttcgacttgactgcaaaata

SEQ ID NO: 42568 - DNA, 1501 bp, Oryza sativa
agcagatgtcaatatgtacgtttgttaagaaatttatgttgaattaagtacaggtacatactctgtttaaatgcgcatggaagattcttttcggtcattatataaaaaaagattatttttggtaccttatatactgtaatctctcttcacctctatatcgttgcaacctgatggtgacagccgaaagaaagtggctctaaggtgtgaaaagaatagaaattaataagtaacagcaacaaattcataagaatttgatgaggttggtagccaatttcagtcacaaaacagtagtgtacataacgctgatattctggagcaagagtcagattttgttgatattctgctcgatcatcaacaagagtacaatctcaccagacacaatatccatgccatcttgatgttaatcacatatacacttctaaatttttctttctttttactattaattcactcatttagtttaatccaaaatcaggtaattgagttttctgttcatgctcaatgttgccaaggaaaaaaaaatagaaacatacaaagtattaaaatccatctcttatatggttttatagactgtaagagagaaataaattttgtaaacaacgttactattactttatcggatgaagaaataaccaaagtaaaagttatagatattgatgagctatacaactttgttgtttatgactttttcagttgaaatcacttagtatttgaaaatgttgtttgaagttgttataatttgaaattcaaattcaaatttcaaagtcatatagcaaaaagaccaaaacaaaagttgtagatgagttatacaactttgttgtggatgactttttcagttgaaatcatttagtatttaaaaatattgtttgaagttttcataattttaaattcaaattcaaattattgaaacaaagtcatatagcaaaatgaccaaaacaaaagttgtagatcttgataagttatataactttcttgttgacaattttttcatttaaaattatttactacccaaaaaattatttaaattgagaggagggaggcctaatagactttgcgtcgagggaggagcgaaagagctgggccggcggcccgaagagggaggagggaaaggggaagccagcccaaggagggagagagaggctgagagctgagggagggagagagtaacacttgggccgaaaaaggcccaattacagagataaggattttaattagttttctatttattttaataggttaaatgaatattatggtattaaaattatttattgagcttcgacaattcacagaaaatttcaaagaataatttagaccatgtataatattaaataatatttccggccatgatttttaaaggaaaaaattgtttccttattaattcacttgattaaattgcttctagaaatacatatataaatctatgacgtttgctttttcccctcatgacaaattaatattcgtcacaatctctcattgaaatactttatgacgatttgtagtt

SEQ ID NO: 42569 - DNA, 1501 bp, Oryza sativa
aagtctgcaacatcaactggaatatgaatgctcagatcaacctataactttcaactctgtaatggttctatcagattatgtatgttgatgtgattacagctgattgtcattccccctgttctttggatagttttgtttgtttttgcaattctgaaaagcctggcattacaccatgtaaaatgctaatattcacataattacagcacatgataattggtggccttcctttgttggttatatctgttctcaatcatgatcctgcgctgaatgggcatcttcaagaacttacactgaatgatgtattagcacttctctatacatctatatttggcagtgctatcagctatggtgtgtacttctacaatgctacaagaggtaagatcacttcccactcatgtttagcatttactggtattgtccacaaatatattcttttaggattcccatatgattatgttctttgcaggtagcttgaccacacttagttctctcactttcttaactcctatgtttgcttccatttttgggtaagattctttccccaacatgtcaagctaaacatacatgacaattgacaaacatgtagcacttgttttctaattgctcttctgcctcacctttccttctcaggttcctctatctgggagagaccttctcgcctgtacagcttggtggcgcgcttctaacattggtcgccatctatatggttaactacaaaagcatcgtaggcgagaagtaaaaggccgttgcaagattcttctggagacactggcacagatgaatgctgtactgaagcacctgtaacatttcattggcgcaaaacagcaatgtgaagatttaaagtacatcccacggtcccaacatctcacacagcttgaactgtgaaagaagacagggatatggtggtataacctctgaacatagttagactggtaatttgggcatcagtgcatacttccgaggttcccaagttagtcatctacttcatttcggcttgcattctgaaatggataaaacttgagtgtcatcagatggttaaaacatagttgctatgaactgtgttgtggatatcaaattgagggaagttgcccctttgtacaagtagtttggagcataaaaaaatagttgatcgaaaggaagcagctgtatatgttgagcacaagcttcgtctatcgatctaagttcagacactttccctgataaatacgaagcatgtcccttttgtgagaaaaaagggaactgtgaaactgtagttgatggtgcatgtatatatacgtgtatatgttttccaactgtgatatattttacaattattttatattttaattttttttaaaataaacattttatattttgcattttgagaactagtaatattgtcgtttgaaacatagttttccaaataccaaaacggctaaaagcagtaccaccaccaaatcgagattatcaaaatctactgcaattccaaattcatcaactttaactacaaggcaggtaaaat

SEQ ID NO: 42570 - DNA, 1501 bp, Oryza sativa
gagagaaagtgacatgacaagaggtggaacaagggaccaacgtgggcaaatgtattttttccatgtggcaaacttaaattttatcagcaaactaaactaacgcgtatcgcagtcacgaaatggctagtgacacttaagagacagtattatataatatgcatttgacaattctcattctatgcaggtgagtagttttcatctatatagatattcaaggaattgatggccacggcccacgggatgctcgatcttctgtcaggtgaagataactatcgatttggcagaaacttgactcatgatccggtttctgatcaacacgatccaaatcctgcaatcgcagtaccatgtctcttttggttatcaaccatgccgaaacccgatttacctcgccgagaaggctaatcgctacgagtgaatcgtagagcacaaccaagaataagagagacaacaactcaattgcactcttgtagatgaatgattaactaagaactcaaagttggggttacacaaaccgaactagcagcgatactgcgatggcagaaataatctaagcaaaattcaaccttaactcaatgacgactacagaatatataggttatagggtatatcttggacccttggacacgtccctattatactacatcataatacacggcccaacaatcccaaagacggtgacgcggaacccgaacatattctgagccgcctcccgcccgctcctggccgccgcctcggcggcagcagtgagcagagcgcctccagcgccccgtgcacttggtggggagtggaagagaggagagagagaggagtggtggggaggggaggggaggggaggagaggaaaggcagagagagaggagtgatcgagggagaacaaaaggggaaaggaaaagagaaggtgaaaaatttgaagtgaaggagagggaaaaaaaggaagagatattttcgcgtgcggtccactggagaggtccgcacgtaaaaatcgatttttccgtacgggtctcttaaggatccgcgtgaaaatagaaggctaattttttatagacgaacatgaaagaggtccgtataggaaaatgggagctccttgtgtaggaaaatttttttgtgtactagtgacaatgaatttaacgggaaagctgacaaaaagaatatatgtataataagggtatagaaatctgttttaaaattatttaacctggactatggtgtaaaagcaagttttttttttgacaattcaaaagagttaagagttccattgattcagaacaagtatatggtacggcacgggctttttttttaaaaaaaaagtatggtacgacacgtattgttaagtttcgcaacaaagcaagcctattgcactgcagggcacgacaagcaagctactagctagctagaatgctctactagatcgttagctagcagccggctgcgacgtcgactcgacaatattctagacaaattaatgagcatatatatatcaggaggatcatatctgtgccaag

SEQ ID NO: 42571 - DNA, 1501 bp, Oryza sativa
gctaggagcattattattgttccaagacagcctgatgagcaccatgacaaggatgtcatactctctcctgctccccatcttgtgccctcttatcctcctactcctcttccgttgctatgcctatgcaacaaggtccggcgggatgctcgacaagctcccctcgccgccgggtaggcttccacttatcgggcacatgcacctcatcggttttttcccacacatgtcactccgcgaccttgcgactgacctgatgctcctccaccttggcacggtgccgaccctagtggtatcatcctctcgtatggcgcaggtcatcttgcgcacgcacgatcgtgtgttcgcgtcacggtagcaatctgctataaccgacatccttttttagggtgcaacagatgtcgcattctcaccgtatggtgactattggcggcaaataaagaagattgtcacaacgaatctcttgaccatcaagaagatccgctcctatagccagacacggcaacaggaggtgcgtctggtaatggccaagatcgtcgaggaggcggcgacacatatggcaatagacttgactgagctgctcagctgctactccaacaacatggtgtgccatgctgtgtctggcatgtttttttgcgaagaaggccggaaccaactattcaaggagctgatctagatcaactcgtcgctccttggtggcttcaacattgaggattacttccctagcttggcaaggctacctgtcaggagactgctctatgccaaggcctatgatgtcaagaagagatgggaccagttgcttgacaaactcattgatgaccactctagcaagcatagatcctccttgcttgacaataatgatgtggagagtgatttcatcgatgttctactctctattcaacaagagtatggcctcactaaggataacatcaaagcaaacttggctatcatgttcgaggctggaacagatacatcattcatagagctagagtattccatggcagagctaatgtagaagccccagatgatagccaagctacaggctgaggtgaggggtgtggtatcaaaagggcaggacatcgttaccgaggagcatctaggtaggatgccctacctaaaggcggtgatcaaggagacactccgactacaccctgcagcgccacttcttgcgccccatgtctccgtggttgactgtaatgtcgagggctatactataccctcaggcactcgtgtcatcgtcaatgcatgggctattgccagggaccctagctattgggaaaatgccgaggagttcatgccagagaggttccttagcaacacaatggctgactacaatggaaataatttcaatttcttgccattcaggactggtcgaaggatatgcccaggtataaacttcgcgatcaccaccatcgagatcatgctagcaagccttgtgtatcgcttcgattggaagctattcacctcaaggatcgatatgacagagactttcggggcaactattcac

SEQ ID NO: 42572 - DNA, 1501 bp, Oryza sativa
tgggtttctcttgggatgactcatcaacagcttcttgtagcccttggagcatttggtcgaacacctgttgagcgccacccattttaggcagaaattggagtttagcttttgtgccatgactagtgtggcctttcccgaggatgctattccttctggcgcgccaagcaatagtgagtacgcaaccccagcctggacagtaccggtgttgacgttggggcccaacatcaaatggcttgggtgcatcaccttgggaaggtgagtggtgtcagtgcaagttgctttctcgtcaaccatcaactccatggactgacttgatatcggaacgaccttgaacacacccatcctactttggaacgcaatcacacctctatcagtgacaccgttgacatcggggccgaacaacaaacacttggtgtgcgtctccttggaacaaacacgggggtcaatgatggtggtgccggttgcgccatcggtggctaccaactctttggagtccacggcagtgttggaacatgtaaccaccgcagccacggtgaaatcaggctcgacgtcgaggcttgagcattttgtcaaacacatgataggcgtcaactcgggaaggtccttgctaatgatgaagggcatgcgatccttcccctcaccatccccaacctccaggatgatcgtcggagtagccccctcgtcgtcgtagatggatctcgctattgtgctcgggctgctgccattggagcactccatcgaacaggtggtgggcgtcaccttggactgctcatcctcaacaaaaaactgaaggtcttcagctttcttctattcttggggcatccacgagtctattgctgccttgagagacaggaaatctgctctccttctttggtctgcctcctcccgccttcgctcgcactcctcgagcatcctcaaaaagcatgtcaaacttgtcctcacttcccatggcagcttgcttgatgagcttcgtggggattggctctgataccaaattgttagagacccactcaacaatataatttcagaaatagcagtgccaaatccaacacagggaacaaccaagtctgttacaatagtggagtggttttgaggtggaagatggaaggatacaagggctagaaggttctagtagcttctagactagtagagaagaagggagatagaggagagatcgacaaagaggccagccagcctctaggtcgccgccgctgctgttcgccgccttggccaaatgaatctgttcgatcgatctcctgtaagctgctgctgctcatatatcttttagcttgggcttgcttgggcttcttggcgatgggctgaccaacccgtggtgtagccagcggcccatgtgcagcccacccgagtccctgacatgggacagcggccgttatgtctccgcggctcacgccggacctgcatggggtggtcgacggcgctcggtggcggcgccgcggctccggcccccaaggtggtggtgacgatgctctttctttcttct

SEQ ID NO: 42573 - DNA, 1501 bp, Oryza sativa
caacctgaagtccggctgttcaaccggaactagaggttggcacggtttggtcaaatagaaagaccggacatgcaactgttcaacctgaaccggctggttttgtgttgaatcgggcaataaactgctttcggtcggaccggacttgtgttagacttgtccgcgggcttgatatttttagcacaaattgaaggaaatgcgcgcgcttgtggggagtcgacccctggtcgattgtttgcaagccaattcccgtagccatcctaccatacagatctttgtgcttgtatgcaaacacatatgctacatgtagttagtgaaccgtggttcgaccagccggttcacggttggaccgtcaaaccggtgaaccagcagggtgaccgggtcgtctaccggtccggttttggtgtgcatggccttttcttcgatttctctatgactggcaagtgggccccgctccttacttgaaagccatttcagttgggccggaccagtatcgcggagcacgtgccaacatgggctgtaacgtcgctgcggaacacgcgcagcccataaactagttgggccatcagcccataagtgcggaacggtaacaatggcgtgcgcgcggcccagattcaattgcgttttaatgtgattctgtcaattattagcagtataatttttttcgcaaacacataaaaggattagccgtagaaataatccttaccccattagcattggcgttctgcgatacaattctcacctcaacgaatgacgagcgagctttgcttaacgtaggaactagtttacaaaattaagttaatgcacgtagtaaaattgatacgaccacgtccaagatttacacccacagacccacttgaatcatcacattcacgatgatacgcaaaatacaaaaacccagtcaaaaatgtcaaatcatgaagcagattgcatgtcaagtggcttaaaaattaagagagatcggacaaaggatcgcctcagtagagaagaaaattctgcacaaaattatagacttgttgtagccgtcagtatcgtacatatcttggtagtatggcaccgatgtcagcatgctcataatcttttcttaaaaattgtttgtatggataactcttcctcctaatctcattttttcgtacgtaccatttttctcaaacaaaaaaaatattcacgaaactcttacttactaataaaaatcttaactactttttccgtccaaattataagaaacctttgttttaaggaaaaactagtaattttttttactaatcattatactaacaataactatgctaagtattatgagtgttatatcactattttagtactttaaaatactttcacttatgttaactttatagttattgataacacaatataaaataaattagttatcaaagtatattattgaagaccgtgtaaaaaaaattataaaccttataatttacgatagagtgagtaataggtactcttgttatgaaaaatcatatcaatttctaaaatattt

SEQ ID NO: 42574 - DNA, 1501 bp, Oryza sativa
tgaaacgaagggagtacaaccgagtagctactacagatcctaccatatttaacgtacaatatatcacatcattaacaattattatatgttaaatataaacatgatacatcatctatatttttttcgttttagagctcaatgtaccacatcattttttaatatcttaacttatattaattcatcatttctaccgtatttcatataaaacgtggagtatcatctaaaaatatatattatctccatccatgaataagcccgataaagtacattttacagggaaaaaaagtagtatactaaaaatgcactttattttgggacaggacatagtaaatattcgaattggacttatctaaagagagtataaatgttcatttggtgaaaaaaatgattataaaactttcttttatacaaaagaaataattaacagtgtatgggtgttgcgacctctatcttcacaaaattagaattcaaattgagataaaggagaaattaatgggctattcatattgatgttatttttcaaccatatcattttttggcaagttgtcataaaagtgcttacatttagttttagtttattggcaaacttaagtaaatacataagaaatcctgccaaaattttgataatattgccaacttaccaaaatttacttcagctacaatctaaatagcctctaaacgactaatagcacaggcacggctacctttcatgaaaaatttgtcactttgtttctctaattaatgtgtacgatcaaaattaaaagtatgttaagggaaaatccgatatgactatggtttaatctatcacatgatgaaaccataaatttaaattcgatgtacataaccattagttctacatgaatatataatatattaaatattttccataattttacaaagatattaatatattttgattcctatttgatggttaagtttccagtatatctgaaaaagttataaatcaagtgtttgacgcgaggtcaaatatcggacacacccctcatcccacgatttctccaccactcaaccttgattctatcttatcctctcttcaaacctctcgaactgtcactctctccactctccctatttgtctatacttctctcacttatgacaagaatacactactacaaaaatgattttcctatttagattgtaggcggaccataactggtcgcgtatgagaaactaagctcattttcacgtgcggttcatttaagaggacagcactaaaaatttgatttttccatgcggtcctcttaaatgaaccgcacacgaaaataagcctattttttgcatgcggacatattaagagagccgcacacaaaaatacccactctctctttccctcctacccactttaaattttcccctcttcgtctcctctcctctctcctctccatctccttttcttctctcctctcctctttttctcctctcctctctcctctctatctctttttccccgtcctctcctctcctctcctcctgattgag

SEQ ID NO: 42575 - DNA, 1501 bp, Oryza sativa
tctcgcgttcaaacgggcggatttgcccccgcaaatttcgccggcgccattgatggcggccggacctcccgcgcctattccttccccgccggccactctctcccccttccaaccctatttaaaccctccccgcacctcctccgtccgtttccgcctctcgccgcccttcctcctcgccggaatcgagctcgcgccgtcgctctctctctccgccgtcgccgccgagctccggtccaccaccgtcgtcgccccaaaccacctcccacctcggcgccgcctccttcggcttcgctgcatgctcgccgacctcgtccacccctccgtttcgctcgtcgaccgccggagcgccgccgtccccgtcgacccgagccgctccgccgccttcctccgctccggctgccttttcgtcgtcgccgtcgacctagggtgagccgtggaccgccgcctcgtttccctctttccctcccctctctcggccgccgctccgatgtgcccatggccgccgccgacgaccataggggcgcgggcgcgccgcctcccgccggccgcgccgacgtggccgccttcgggcgcaccgagcggctgccgcgtggggcccggccgtcagccgcccgcgcccttgggtgcggctgacgcgtgggacccacggcgccggccggtgtgagcccgagtgcacccggtccaccgtggaccgtgaggctgccgcgtgggccccactcccgtggacccggtccgcgcgccccttcccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaggccttttcttttccgttggttgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatagtagcacctcggccatataaggaccggt

SEQ ID NO: 42576 - DNA, 1501 bp, Oryza sativa
caaggaaagaggattgttagaatccacgggctatacatgggccgattcagctgctactctaacaaaagcccagttatgcctatgagattaatacaaaaaggcagcagcagcaagcttctaggatcgatcgatcaatcaaccaaggcggcgaaatgcggcggtgtcctggtggctaggcttggcaccttggcgatcttcttcctccctatcttcctcctaccttcaaccctctactttagtttctagaaacttccataacattgtattactttgtttcctcctctccttttccccaaaaacactttgttccagttgtttatcatagcaatcgagttgagagatttaggtctctaacaatagcatgcctctatagtaacaatgaacttagaaaaaacaaatatggtggtcacagcccacttcatgttagaataattgggctaggcccaatttataatattaaatctcaaaggcccataataaatattgaggataataataccacctcaggatttaagcgagaaatatctcaacctaaatagggagttattggaggctccctattgaccagttgaggtgggggtcggaatgccacacgcgcgcgcgcgcgcgtcgggccgggccgtgggcgtgggcgtggcgtggctggcgtcttgcgtgcgtcacgtcacgtcgctatccttttgcagccactaacccacgttcccacgattccctccgcaacagcgcgtccacgttctttctcctgatagataaggaggccgcgagtccgatccgagtttgtcgcttctttcccggtgttagtttctccttctccgcgcctgagttgctctcgcttgcccacttctgatctcttgcgcgcacgagagattggaaggagcagtgcctccgaaaccacaccttcgcctgagatctgcaccgggtaggcaggtgatcaggtttttagggagtgcctcccgcgcacgacagctcatcgccatgtctggagttgccgccgccactgctggcggaggtggtgcgccgccgccgacaggagctagatctggatctggagctggtgcgccaggaggtgccgtgaacgacaacaacaacggaggcaattctgcctcaccatccagcggagggccattctcggggtataatcttctcctcctgctactgttgttagcgctatcgctatactatgtgcgctatgttcttgttcctgttctacatgatgcctctagcatgttatcgcgttactggtatgttcctgttcctgacatttatgatgcgcatagtatgctactggttatgttaagatcaccttacactgcttatgtcatgatcattgtttcaatttcttggattaaaatatgccgattaatgactatatttccaacaatccaaaaacctgataggtcattttcggttgttggctttgctgctgcactgaaaccacatgcttttgatggttcaaactataagagatggaaagcacgtgcactattgtggttgacagcga

SEQ ID NO: 42577 - DNA, 1501 bp, Oryza sativa
tattgttcttctccaagatttgttcactaagttgcaattgatagcacatttttacattttcttggcgcgtccatttgtgcctccacagctgcctcatatgctaccactaacatttcttattattcattcctatttcttagagaattgtatttatctatgcaaaattgcaactcgatgtactgaggattctataagcttttaaagattaccgtgaacacatagtgtactgtccagagaattactcagattcatttatgtctttaatggattggattccatgtaaattcagttgtaatcctttatatatatatatatatatatatatatatatatatatatatatatatatatatatatatatagtctgttcaaggtatataacttgaaatttagcatgtaccagaagatagattattatcagtagaccccaaaaaggtcacactccaattttgatttatcaagtgcatgacccttgataaatttactcatgtgtgtgacgtccgtgactgcttcccgaagcaccaaccaattttgttttgaggaaaacatcaactaactatgtatcacctaagagggtaatattcagaacttgtgatcttagaaaatgaaaccatattcttctatgccaatgcctaatggttagagaaaattcttttcaagtatacctgatagtctgatacattaaccatattcctttgtttagagaggaacattagccacattctatcctcttcatttgccagtcataaataacaggcgagatgctttaatgcatacattttttgccgttgcaacgcacgggcacccaactagttttgttttagttttattttgtgacctcaacgtcacatggaataaggaccaaattaaactagtcatatcatctaaaaccgccgttcaaaccgtcttcatacctcgtttaaattggtttcattgagacgaggaatatgttgcactggttttacgattgagtgacgcgattcaaactccacccttaggttgagttcgtttgcaggggttctcaaccttccctccctcgttttctctcgtgcatgtgtttccaaactgttaaaaggtatacttttttacaaaatttatatatgaaagtttctttaaaaaaaatatattaactcatcttttaagttttttaacctaatagttcctccgtttcatattgtaagactttctagcattgtccatattcatatagatgttaatgaaacggaagaagtacttaattaattgtatgctaatctattgcttcgttttccgtgcatgagatttaatagtttccacaccaaaggacacacccttagagcatcctaaaatttaactcctaaaaatcttggattgggaccatcccataggaaattgggcccaaaaatcacctcatacttaaagagtgcccctaattttgatttccaataactttaaactatgccacatcatctcaagtaaatcttgcttcaactgtttatgtctttccatttttccgataaga

SEQ ID NO: 42578 - DNA, 1501 bp, Oryza sativa; identical to SEQ ID NO: 32679

SEQ ID NO: 42579 - DNA, 1501 bp, Oryza sativa; identical to SEQ ID NO: 32678

SEQ ID NO: 42580 - DNA, 183 bp, Oryza sativa
acaacattggtcatcgtctcaacaaggacaaagaaatagagaggatgtccccagattgataccatacatatctccatgaggccagaacaactagcaacaacagatacaagaacattcattcacaactttccaactgaaatacctccagattgtttcctacagatcaagagaagaatgcaatga

SEQ ID NO: 42581 - DNA, 1501 bp, Oryza sativa
ggctttagaggtttaggtctagaacttgcctcatctagctagtgatgtataaaatgagtattttagttaactaatctaaccttagttcataggcttatggtctttattatcatggttcatattttataaactaggggagctctagtccatgttagcaatttattatatcaacctagaaattattacataagctaagtgccttaagttttggtggatgggaatggaactatgcattcactggtctaacaagttttatttgggtttcattatagctagagtgtatttctatgtacatttatatatatacatattgctcaatcgatactatgtgattagctcctatcctataaatttaaagtttagagctataacctgtacagaaggttccatattttattttactatgttgaagcccactgtttgctggttctatagatatttggttcacttcatttagactaaagatgaattttctacaaattttacattttaaggttgctctatgatggttattacttacataagtaagtatataattttattttataacttggaagtatatgttttggtgattatacagaacttgggtttattcaaaaaggatctaagatgagttttatataaacttctaaagttcatcttatgccaaactagttattttaaagataatagttttagaggcatttgatgtaaagtgtttatatgttttattttaatttatttttagagaacatgttggtggatctgtagaaactaagtttgctctaaaatgagttgaaatgaattttgtatgcattttataaatttgtgcgtgctttatgtgtgatttaacttggataaattttagaggctaaatttgtactgtgagtgcaagtttttattccataacatcaaatttcccaatttggtgagttcacagaaatttgaatcatcttaaaatgagctatatttaattttatatggattttacaagttttagttactgttcttttataattccagattttgtttccaaggggtccactgtcagtgagagatcaatatacaaaaagatccctgaggtttctaagaatcaacccgcagacctaggctcatatgtcagtgaattgaaaagttgcacattaaaccttatagttgtttaaattctcgaaacaaggtccctgacttcttttctcacgcagagaggcagaacagccatggctgagctcgatctcaagcttgccagcggcaaacggtggctcgtttgagggtgcgaccaaaagacaaaatgaagatcatgctattgcgattccattcctcttcttttcttggtcagtggacatcggagtaacgccggcggcgagtccgagcggcggctgtgcttaggctgctactgcatgttgagttggtgctcaattctaagtgaatgaaatgcatgaatgcaatcctatgggctcaagggtgctcaccgaaccttgaacgaggcgccggaaagtctggacagcggcagcggagaagaaga

SEQ ID NO: 42582 - DNA, 300 bp, Oryza sativa
ttgaccttgttacttgattttatttaccctgtctactaacttccgggcatttctacactgttttgacaattctttaatgattatgattagtatatcaagtattattcttactgtttattttaacttttcccatttatatatgttatttgctatcattgttcatttgataaagttttctactgatatgaattttttttaaagacgttcatgtgtaaaacatatcctttaattgcattttactgcatttgtgttacttcaatgcttcatctaattttattttttttaaattatcgttacaga

SEQ ID NO: 42583 - DNA, 1501 bp, Oryza sativa
atagttttgatgtggccaagtgtgataagattttttattattttttataagacaaacaaattagattacctaaagaccatatcataccatctcaagaagaattgaaacgtcgagcttattgtaaatggcatgattcccactctcattctactaatgattgcaatgtgtttcgacgacaggttcaatcagccataaatgaaggacgattgaagttcaccgatggttccaagatgaagcttgatcatgatccttttccggtgaatacaattaatttcaatgagaagaaggtgttgattcggccggagcaagccgaatctactaagggaaaaggagtgatcattggcgaatcgaggccgaagatgatagtgccaaagaagccggaggttggtgtttggaaggaaaataagagtgaagcttcaacttctaaagctcctaggaagaccaaaatgacccttgatatgcttttggagaagtatgaaaagcaaagtggtgagagaactcgcaacaaagggaaaagaccaagatcacctcctaggaagcgatttggtcactcaccaagacggtcgcattcacctccatatcatcattcacaagacatgtcatggggtccttatccaatgctgccgccgggttatctttatccttattacatgccatggggggcagcactgccaatgttcaaccatatgcctccaatgtaattcaaccaagggtgcggaggaccaaggaggccaatccatgagtgtttgtcttcaccaaacaatggccagttttatggtaagaaccgggccagtgaagaaaagagggaagggaagcgtattaaggtggaggcaaggacgtcgaaagtgattaccatcaaagtggggtctcatgatgtgccaataccttctggagatgaagttggagagtcttcaagcaacaaaaccgaagccggtaccagctcatcgcactcggccggtctgaccaggccctctggccggtctgacctcagccatacggccggtctgaccgggccatctggccggtctgaccgccgaccgaatgacggtctgaccgatgcctcaagccggtctgaccgccgacctaatgtcggtctgaccgatgcctcagaccggcgcatctggccggtctgaccggtggtctacgtccggtctgaccgggctccagcgccggtttgacaggaggttcacaaggagtaaagtgggggcttcatcgtcatcaagtaaactcaatagggggcactacttacctcctggaacagagccgaaacctaggtggatgcctaaggatttgacggctactcaaaggagaaggttgcaacgtcttcgggcccaagaaataagagagaaaaaggccgaagagcaaagagataaaaggttcaatgagttgtaaccaccaccggtatggaggcgtaaatccatagagaaggaagaaccggttgttgtagaggagaaggaagaacaatcagttgttaaagatgagtcatctccaaaagaagaca

SEQ ID NO: 42584 - DNA, 1501 bp, Oryza sativa
gtttaaagcaatgttctcaatttgcttgaaagcaaactgtcgaaactagatttcggcaataataaaagggggtggctatcaagctggagaagtgaatgggtttggagacaaaagatttatacaggttcaggccttcttattcaagaagtaataccctactcctgtccggggatgaatccgccgagtatcttattgattgtatgatttggagagaatcaacacatgcccctagaggcacccggaccccccttatatataggaaggagtccgtgttacagaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatccgaatgcttcaaacttttcatgccaaggcctgccgagtagcgaagacgaagactgtaaagggcgaaaagataaagaatatggtgcatcgaatagatgcacctaattaggtgtacctcccaactatgtgattagttaacaaactaaacatatagttgagaacaaaataatagcacaatcgtgcatcatatgacaaaagcatacacggcgcctaaagaggcattcttagccgactgctttttagccataattaaaaggaatccgagtggttaacactctaaaaggttcacgaatgaacacacttgacaggcatccgaatagaaaactctaaagattacccaccaaatattataaaaattatggtaatgaataagtctaatagcctaggctatgactatttaccataatgaaaacaggcatataacataccgaggaaatgactatggtaaaaacaagtcattccaagttaacccagacagcttttgtagcctaaaaaagcttacaaaaacagcataacacctttctgtcgggcaccttttaatttgcattgtaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaaacccattcgtacctccgatacccttaacaagaaatcccgagatccaagcgacacttcatctcccccgccggaactctcgccattttccccactccctgctacagtacagagctacgccggcaaactagggttcaccattccactcgaatccaccttcgaaaagttcatcaaaatccttcccgtgatccaccgcctcaatccttcacctctccctagccatccctcgaatcaaatcagcgcattcgaaaaaaaatcaa

SEQ ID NO: 42585 - DNA, 1501 bp, Oryza sativa
agtcaacataacaccacaaattacatgtctagattatatggccattaactgtcgaaacaagattttggcaataatgaaagggggtggctatcaagctaggaaagcggatgggtttggagacaaggaattttatacaagttcaggccttcttattcaagaagtaataccctactcctgtccggggatgattccgccgcgtgtattattgattgtataaaccggaaaaaagatcacgccccgagaggcacacggacccctccttatataggggaagaagtccgctttacaaaatacagtccatatcctaacggaatatgggattatagataaaatacaatcgtaaccgactaggatcccgggtatttccttgacgtacaagtttagaatctaacccgagtcctcatgaagatattctatctatatttggtaccgtatatctgactaaattataactgtcatgtagatatggggtatccataatctccacagtagcccccgagaccttcgcagttgacaaaatagccttctcgaaacaaaaaacagtaatccgagcgcttcaattcaacttgctctagcttaccgagtgctaaaatcaaagactgtgaagggcgaaaataaaacttggtgcatcgagtagatgcacctaattaggtgtagcccccgactatgtgattagttgaaaaactaaacatgtagtcaagaaccgagtggttttatagcgaagcatgcatggtactcagtaaaacactcagccaactgcttctcaacttgaacatatcaaggataaaaaatacgaaaagggccgagtgataaacactcaaaaggtccaaaaacagacatatttgataggaatccgagtaagaaactcttaaaatgatccaccaaacatgataaaaatcatggtaatcaacgagtctaatagcctaagctatgactctcaccataaccaaattaagcatataacatgctaagagaatgactcttaataaattagtcatctcaaatcaacccaaacagcttttgcagcctaataaggcttacaaaaatagtataacaccttcctgtcgggcaccttttgtttgcatcgtgttaattccaaagaattatcaaaccgcattaaaaaggattttaacaacattgggccacatcattgtgagcacaaattgccaaagcaaaaagcgcctaagtccctagggatcacaacgggccacgctgattataatactgggctgaagtactgtacaggcctaggcccattagtactcccgataccctaaaaacaccgaagaccaagcgtcacttcgtcttccccgccgagactttcgccatttccccactccctgctacagtacagaaccgcgccgacgaagctagggttcatcaatccgctccaatccatcctcaaaaactttacgaaatttctccccgcgtccaccgcttcgattccccatccccttccagccgtatctaggaccaaattaaactatccagttcacattca

SEQ ID NO: 42586 - DNA, 1501 bp, Oryza sativa
gatcagatgagagaaattcgacgagattcctctccctatcgcgcgcaaccggttcaaaaactgaatcaaaatcgaactacctagacaaaatcgctcaaaaaaacaaccggaggatgcaaaaaaaccaagcagcaacgaacgacacaaaactaaccgatcaaatctggagcagatgagagaaatccaatgagattcctctccttctcgagcgcgagagagaagaaaaagcctctcgccggagagaaagagaagaaaaaagcaaaaagagaggaggagagaagaaagaagaatggagaagataccggagaaagtaggagagataaagaggagctacggctacagacacggcgcggaaaacgaaatttgacagcgttcagaccgcgcattgactaataccataaatatcagcacgaatcttgaagagcagatcggacggcgcaaaaaacgtcagatatggggaagaaaatttgacatcagatttctagcaaaatcgtaaaggattcgtgtcgctagtgggaactcgagaggggaagggcaggggtcattcaccggttggcccaaggtggttaatttggactgggcccgctgagtaggaaagaaaaccctcaagaagctatctgctgcgttgaacacattgatcgaacggataagaataaaaagtgacgtggctaactgagaggacagcaaaatagttagtggggatcaactgtataagtatacaggattccacattaagtgagtattcgtgatttcttttgggtatttaatttttttaagtaagatatattctcactattatgggttcatcgtttaatatttatattaagtgctctagtaagactctagataaagaagaaacttcttgtgtgggggctagagaagtaatcgataacgtaagcgtgtgtctaggttaaaaattacctttgtttattgtgtgctccatgggttgtagagatacgcaacacgtggtgatagctccgttcatactttgtaatgattcacattcaggtacatcatagagctataggcctgattcgtttggcaaaccatggaaaagccagtgccctaagcaagtgatagagttttaccttaacttaattcaagattattaacccatctggatcctctctatccccctcctaccattaaattgttgtccctggatgaacctgtttccttgattttacacacttgttccctgagattcgatatggttaagtgctacagcagtatccgtgcgcttgcgtatttatctgtgagtaataaatatcaatataagaatttctggcggtgttactatggaacagttgttatattatcttcaaacctagtttgccttcttatcttatctttttatatttcttttcttttcttttccatcatggagcaactatctatatgaaatgtttccgaagggcgagttttgtgagccagcaacttcatcaaaacttattctcacatctggatatgaactctgtcctggctttatagccattcgaga

SEQ ID NO: 42587 - DNA, 1501 bp, Oryza sativa
attgtcatcacatatagagtccaactttaacaagtattgatcagctatttttgtcaattgaacaggtcaagtttgcaatacaaaatgatgcaaaatcacaacaatgtcaattgtcagcttcctacgactttcatatcatgtgcttaagaagtaattttgagatgtaattctttaatagagcaatcaagcacaatcaaaattcaatgaagaaaaataaagccatcccatgagtacaaatttatcaagttttttcagatttcacctcaattccaaaaaacaatactgctttatccaattgcacacagaaatctcaccaaaacaatactgctttaatcaggtgtagcagaaataatcaggtttatttattgatcctaaacaaaaactggagtgaatttggctggctaaactaatcaaaatcaacatcgaaagttttaaaaaatgcaagaacaaaagaattaacataccaaaacccaaatacatgtcatttggacatctacctagacctacaaaatgaacataacacagataataacaacaaaaggtacagaaactaaaaagaaaattatattactagtgaaccatgtcatacagaatcatttagattagcactaagtaattcgaaacacacataaacatgatacctgaactagccaaaccaattcatgtggagctttaactttaaaaatattggcatcatcattattatacagaaatggagaaagcatagaactaaatacaaacactatataagatatctcatggatctggaaatacaaaaataaacaaatcaaacatgaaaaaatctaaaaactaaaaactataatgataaatcaacatgagttgaatagccatcaccataaatcatagatcaaaacccatcaacatggaaaaaatcaaaaccaaaacctaatcagatctagaaaacaattcaggaaataaatgtctagaacctcagaagaagcagatcgacatatttcaaattaaaactacaactaaaaaaccaaaaacaagtataggccagatctaaaaaaaactaggaatcatcggcgacacctagatcagcataaaaaacttaggaatcatcggcgacacaggattctgactataaatccaaaaaggatttggattctaagaccacaaaatcaacacaaaaataattcaaaatcctgcctctcgcgcgcaaccgattcaaaatagaactacctagacgaaatcgctcaaataaaacgaccggaggatgaaacaaaaaacaagcaacaacaaacgacacaaaactaaccgatcaaatctggatcagatgagagaaattcgacgagattcctctccctatcgcgcgcaaccggttcaaaaactgaatcaaaatcgaactacctagacaaaatcgctcaaaaaaacaaccggaggatgcaaaaaaaccaagcagcaacgaacgacacaaaactaaccgatcaaatctggagcagatgagagaaatccaatgagattcctctccttctcgagc

SEQ ID NO: 42588 - DNA, 1501 bp, Oryza sativa
acccctacagtgttttcaggtgcttaaagtgacatgctcgcttgggggaaacgggagtagaagcacagctgcattccacactgccaccttaatctttaaagttgtcatgatttttataataaaggaattgtacccttgttaagttgcactagatgaatctgagagttcaaattagtttatttcatccctgaatgttcctttctccttttttttgtggatggctacttgcaatgctatacttatatttgacgcttccgcaatgcttatgttttagaggagttgctgtcaaaatttctccttcttcattaaatgtatttctatttagtagcatcccggtgtctttgtagtttctggggtgttacacatcacctcctacgtgttcctctgcggtcaagacaaagacaacccaaagaaaagaatcgacaaaagatcaaacaacggtagatagcaagcaagaatgaatgcgagattgatcacatcctgcaagtaaggcgaagtgcaacaatgcatcaaaaaacaagttgcatgtctgcacacttcaatcggagcccattctcggatgcgaagcgcatcctaaggcctggcggcgatgcacgcaatcactgtcttttggcgcaatttcattttcaaatcagacatagatttgctcttttttattctatgtgtgtggggtcaaattttcatttgattcttttttattttgtgtgaagtcctagacgacaacatcacctatgcacctgatttttcttttccagatttccaaattactttctagatgtgtattgtaacacttgagcggtgctctaggagggagcagtatccgtgatacattcttgtatgatggattgagtacgtgatacgtttgaggtttaggttgtgatggggaaatatgaagtgagaattctaacatagagtagatataagggtgcacacacggcagaacgaagaaacaccacggatgacagcgtaaaagaagaggtaccttcttcttgcacagagtagagtcgcccgagaacacatccatgcgggagtcggtgtcactgcagccttagcagctagcgggctcgtcaagtcaaagcagccactgctcaacgtcgagcttgcctttgcagccatcgccgccgcatccatgcagcccttggtagcttggtccacgtcgttgcggcaacaagcgcatgcgcttctgtccccctaaagcacatgtctaccgcaacaacaacatctttgtcaatgatgacacaaatgatgctcgcgttcagtggatcaagaacaccaattcgcagtgtgttccacagacctcctcatcccttcacctcgcagattcgaccaagcaccacctgatgctctagcgtccagctgctgccatcgtcgttaagggcaaatgagctgagcacgaaaggatccttctaaaacaactcgatgtagcgcaacctaccctcgctgaccaccaggcgccggtgcataccctgctcttgtattatatttgtgctgggctctaggc

SEQ ID NO: 42589 - DNA, 1501 bp, Oryza sativa
ctttctatttgtgacacatgatcttgttctgatatttttcctgggatcaataaatttatagaaagtaataagcatatcatattcattgctttaaataaaatacaaagaggttataggggactatggaggtatttctgctggcttgtgtgtatacagtatactgaacaagcagacattattaagtgcacactagcactgtataagagctttcccagcattgttgtcatcatgctgagcaattgtcattctttagtcctaaaatatcatgaactatcagactaaaatgaagcttgctatttcataacaaggatcatggtgtaaccttctgccgaatcaagggatgaatatcaaacaatagatatgtactgtaatactctgctgaatcaggacaccaataaaacataaaacactactccctccgtactcataaaggaagtcatttaggacaatgtttaagtcaaaccttgggaatataaatcgtaaataactctcaagttgttgagtttgaaaatgtaaaaattatatgaatagatttgtcttgaaaaatactttcataaaagtatacatatatcacttttttcaataaatatttttatagaaacaaaagtcaaagttgtgttttggagaccgtgtcactgtcctaaacgacttcctttatgagtatggagggagtatctttcaatttttgtgagtaaaacggactacatggattgtcgtagtttcctgttttcttgcgtttatattgaacactgtaaattgtatttttgtataccagtagttctcttcatataattattgacatgcatcctaatgttttctatttgatccaggttatgtaaagacgaactgacaggtgttttaatagaaagctaatgaatggtagcttggagaagtctcgttttgggtaacttggagaattatttgagtgtgttggccctctcagtttacctgctgtcttattttgtgagaaaccgttactgtttcatgttttctttttttggtggacggtttgtgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcctatatataaggggggtccggtgcctctaggggcatgtgttgattctctccaaatcatacaatcaataagatactcggcggattcatccccggacaggagtaggttattacttcttgaataagaaggcctgaacctgtataaatcttttgtctccaaacccattcacttctccagcttgatagccacccccttttattattgccgaaatctagtttcgacagttggcgcgccaggtaggggtccgtcaagcttttcgccgatcagtgcaa

SEQ ID NO: 42590 - DNA, 1501 bp, Oryza sativa
gtttgaagcattcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttctgtaacacggactccttcctatatataaggggggtccgggtgcctctaggggcatgtgttgattctctccaaatcatacaatcaataagatactcggcggattcatccccggacaggagtagggtattacttcttgaataagaaggcctgaacctgtataaatcttttgtctccaaacccattcacttctccagcttgatagccacccccttttattattgccgaaatctagtttcgacagtttgctttcaagcaaattgagaacattgctttaaactgtgaaagtgatccagttcagtcagcattaaactgccatcacttaagattatatatgttgtgttagttgtataccattaccatgcatcttatttaggcatcttctctgcatactcattctcttaagatacctgcgatcacattgtctcaggtagcaaacaattcagtatcagcttcctttttatcttggcactaaggtgacgatctattgttactggcaagatatgaaaagtcccttttatttggagcagatggctagaaattccttcgaatgcgcaagtgtgcaaacaccagtgctttgcttgttggtggtgtttatcttgtctggtttggaaaggaaaatttgaggcaacatatctatctatcaatctacagagggaagggggacaggaaggggaaggggaagatggaaggggagggatgctagctgaattgttcggtccttcaatgtgatatttgaactccatatgtaatagctttctacttactactctactttacttactaatttagtcggatatacggtaccaaatatagatagaatatcttcatgaggactcgggttagattctaaacttgtatgtcaaggaaatacccgggatcctagtcggttacgattgtattttatctataatcccatattctgttaggatatggactgtattttgtaaagcggacttcttcccctatataaggaggggtccgtgtgcctctcggggcgtgatcttttttccggtttatacaatcaataatacactcggcggaatcatccccggacaggagtagggtattacttcttgaataagaaggcctgaacctgtataaaattccttgtctccaaacctatccgctttcctagctagatagccaccccctttcattattgccgaaatcttgtttcgacagttggcgcgccaggtaggggtagcgtcaagtttttgccgactaagtgcga

SEQ ID NO: 42591 - DNA, 1501 bp, Oryza sativa
cagtcaggggtggcttctcgaagtaccacgagtgcatcggaaagagggtattagctagttaatcgtataactagaatgtatatacactatgtatactagaagtataggaatagattcttttctattttctttccacttagcttaggtaatttagtacgagaatgagtagctccatgcatgtgtgtcactctacccattgatttatcctaatccctccttagactatgattattacaagtaacatataaattattagtacatttctctctactatcatcttcccacgggattaaataaatacgatacccttggaatactctcgggtgaaatgctacaatggtatatccgtgcgcttgcggatgaactctgtaaccataatataccaagagtatttctgcgccattgctggagattatatttctagtaatgtcgttaagaaataccaagactccttcatcagtcttgtcgaactctatgctactcaggcacaagatgggcactaaatttttgctccactgtcatctcccaatcatggtatttctcagcatcataataacccgaaaaagatggtattttaaacttaaccttagcataagggtcatcgggcacacgattattattaccttgttggtggtggtcatttgaagtgccacccatacctgtgcggtatgtgcatagacgacgtcgtagtcgtgcttgccttgtagcttctgcatcaatattgccactaaatcatacatcgtgtcctcaggatggccaccagcgttgctgccactcacttcctcactggaaggttcttgtgtctccaacgcagcaacccgattagctagcgtggatatccgcttgtccagcctctccatgtggtttaagaagccacttttattgatggcatcttggacagcctttgtaacggcctccgtcatgtcattttgagcaattttctacactagttcgtagttgctcttgacagactgtcgatatttcttaacgacattactagaaatataattcccagcattggcgcagaaatactcctggtatattatggttaaaaagtttatccgcaagcgcacggatatacaattgtagcatatcacccgagagtattccaagggtatcatatttattttatcccgtgggaagatcatgtagagagaacttgactaataatttatatattacttgtaataatcatgttctaagcaggggttaagataatccaagggtagagtgacacacaagcatcagctactcattctcataatatattatctaagctaagtggaaagaaaaaagagatcatctattcctatacttctagtatacatagtatacatacattctagttaactgatatactagctaataccctctatccgatgcccttctggtacttcgagaagccacccctgactaccgagtttcttacgacagcccgtcatgaccatataacctgggctaaaaatggaggagtaccctccctagggaattaacttaggac

SEQ ID NO: 42592 - DNA, 1501 bp, Oryza sativa
cacgtctgtagaacatgagtaggtggcagttacatatcctaataacctatccagccacaagatacaactgtgtatggtactgtcacagatgtgccttgtcattgaagacgatatgtcctattgattgattgtttctctttttttttatctcaattacttaatcagctcgccggtaggctccatcatggaacagtggtgtgacctcaatcatggaatagtggtgtgaccttaatcagctcttgtcggtacgcctatcaaccggtcgttaataacttatcatggcccaatacatgtccatattttaatattgtcctatcagcgctatatatttcatgtactgcaacttgcatcatcatgttccaaatcttttaagatgtctttagttttcccagttacatccacgcctacttaatgtgaaatgtttagatcagatccatttgatatctaccatatgatatcttgtatatgtatgcaacaaaactaaaaacatgcgtgtgatatgtctggtattaattccctcagccagctaaaagcattagattaagggacaagttgttggaacttgttggtatgagtattctattaatcctattaagccctaggccaggatgtcacaccccaacacccccattcatatacacaaccatcaatatatttaacacaaccatattcacataacattcattttgatcacatatttcatatccattcacatatttcacacggccttaatgggagcagctcgatgctctgacagcgaaatgaattgacatatatatttgagacagaagccaatccaatctatttctaagattgaagatatcctcaccaggtaaagatcagaactgaaatacaaattagaaaacataattgggtgaacatacccatccaatttgaaagtgttactcaacttgcaaacttggtgagttatattcttcttagatctgaatatgtagatgacaaatcaaccaattgatctacgtgatattgttggccgtatccttcaactggaataatgaaaattgatctgcagttcaggacaaataaaaaaaagaattgactcagtatcaagtatctggatcctgggacaggaaacggaaggaattgaaatgcatgggaaaactgtttgataacaaaaatgggaaaataatgctaatatgtattgggccatgcttgcataaacactgaacacatacaggttcaaattagaatgctggtcctattttggggaaacaaattagatgaatcaaccaaaggcaaagaggaagttggtaacctgtgctagatcgttggagaaaattgaagaggatggtgcagtgatgcatatttttccagcgagcaagctccagcaacttgagcgaaacaccatcggcctgatagattaactatcccgcttgataatgattatgattttatgaatttataagtaaatggaaagaggggataagaagagaacaaaaggcattagagccattaagaatgaccatctgtctgcctatca

SEQ ID NO: 42593 - DNA, 1501 bp, Oryza sativa
aagaagaaagtttcacgtcttatgtcaggtaaatgaggcaatcaagtcatgaactccttatcaggtggcagctagaaacacatgaactatcacttgcacaagttttcacagttcacaggtgcaaaatagcaaactgtcaaaccccaaaagcaaggtgcaccagtgaatcacattgcactatccaatatagagagttctaagcataacttccattctctgagccacttatttgctaaaagaaatttgttctctgagctgctaaatagtaagtacacaatcaatcaaaaggcaggcaatcaggacactatggttgcaaacctttataaataattttaccagttaattaacaacaactttaatttggctcctagaactaattgaagttatacatgttctaattttactacacttcagctttctaaataataatagcaaggaaattttacttacaaaatacacaccagtgatgaaatacaatataactgtgatccttctaagtgctatctactgtccacaaatcgtatagagaaatgcatattttctgcaatatatatgatatatgagatcaggtgaagaggcaagaataacaaaggagacctgcaccttactgtacatgagaatccttacaattgcactggtggagaaaccatctttggttggtcgcccgaaatccacaatagttccggttccacaaaaaaccgggactaaagatgatcttttgtcccggttggggctacaatgggcatatgtgatctttagtcccgattctaaagttgtcaggccccccgggatctttagtcccggttggtgttaccaatcgggactaaagatcctaactttagtcctggttggtgctaccaaccgggacaaaagatctccccctttatatatgtcttcttcctcctccagcccgagcaagcttcaaaatttctccaaaaaagaggggaggtcatgccaaaatttcttgcgaaatttttttagtgataatatacaaatcggaggtgtctaaaaggttagtaacttcattcttcaatgttttttgttgttataatacttttggagctatgtttcacacattttttttttgtctctaaaacgttgttgtaagttgatgagagagaaaatttttgtggggaagatgaatatatagaaattttgtttgtttacttaaaaagttttattctcatagtttaaaatataatgaaaattaatcttaaaaatagaaaataaaataaattgaaaattaaaagaagtacaacattaatatccccttagaacttcaaaaataatataatacaacattaatattagtttagaacttcaaaaataatataaaagaattgtttgttggattattttataattattaattgtatgagtaatgatatgtcattattgtatgactgtttaaagagtttttaattattttatcattattgtatgactgtcattattgtacgaaaatttatttatgtacgattttttttcatttcatgtaaga

SEQ ID NO: 42594 - DNA, 767 bp, Oryza sativa
catttgtcctcacttgcattgagttatcttcatatgcatttgattggagttgttcctgaatcaaaggtgtgcagaaaatttaagatatgtgagcacacatatatatattataggaagataatgagaaacttgctttgttcaggtgaggatctacagtgtaatgaccggtgtcaggcgacaccgatgatttttagcaaaaactatagcgaaattgcttatccatataatataacaccataatctaaatataattagcatattatgacactaatagacacgttatgacaccaacgaattgattttttggatccgccactggctttgttgatcttaaggtggattgtgaaggtccatctgtttgtgtattttctaatgccgtaacatcttttcctatgagattaaaatagagaacaaaagtataagttaacaacaaaatagaagagaaggcataatttagtttagagaacctacttttctttcttgttttcttatttgaagtatttcttcctctatcaagtacactttttgatcttttagaatttagaccttttttgtgtggaggaactctaaaagagacacgtgtcttcacaacatcttcagtgcactgaattgtacatttaggaagatcatcatctaaactgactttgcttagcaagttatctattgtcaggcccaaaaattcactagtaatttccgaactaatttgtgcattaaatcctcatccaggaatcagccgaggtacataaaccgacaatttaatatacaga

SEQ ID NO: 42595 - DNA, 954 bp, Oryza sativa
atatatatatatatatatatatatatatatatatatatatatatatatatatatatatatatatattagtctttcagtcttgctgtttgaggttctgtcccatcaatatacttaggagtatttgctgcttgggacttgcagctgacaaaatattagcattttaatgttgttcctgcactcaacaggcacctccatgcaatcaaatactgcaaggagtttctatggctccccgaagtaatgtgctttatgtttgtctgtatatcttcaaaggtgacagtgctgacagcttcttggcaatgaagttctgcacaacggatgcgattatccgacgcgccatgttcaactttggaagaggaacatgcatccagttacaagatgatgaactacttgtagaagattttagttaagagtagtatgcaaactgatgatcggcaacatttctcgttgtatggaactgaccgaaagcaatctttttgtaagaaaccgattggcaacaataacatactgggagttgaaatctgatcctcaaattcatgtttgtaagtttgccactctcttgcaaaatgcaaaacgcagctacgtgctgccaaggttcttacaaagccccatctctaacattgatctagtatagacaagagccccatttgcatcgctcaaaattcaggcgaacttcacaggaatttggcacaaacaatttcgaaattcgtactccgatgttaattccgtgggttaaaccgtttttatcgcagtgatacaccgtcgaactgaatgcaacggtcgcacaaaaatttacatattcaccctcgtaacaagtcaaaattacgaaacacaccctccattctccgctccttccgttccattccatctccggtctgagccgccgccgccgccttcttcccctctcactcccacctcactaaaaccctagcccaaaccccacctcctctcccgcca

SEQ ID NO: 42596 - DNA, 1501 bp, Oryza sativa
caaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcccgggggggcctaacaggtcctgacagcattcgaaccggaactaaggatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgataggttcccaacttcctccagcgaacacatcaatatgttttcaatctaccacatcatcaaaataggagagataggaatagaagggtcatcaaaataagaaaaataagagagatagaaacagaaaggaaggaggggccaatacatctacgtacgtacgtatggtagcatgtcgtgcgtactacacgtacaggtcggaaggagaggaatgtgggcctttcaattttttatttttttatggtataaaataatgggaccatcatattttaagaaaaataaatctaatttattagagtgtcatgtggcagcttagaagcgtttgtagttctatgtgacggtttgagagcgtttgtaggaagtttaatggacttttagtatataatagatagatagatttatgaa

SEQ ID NO: 42597 - DNA, 1501 bp, Oryza sativa
aaaagtccgggcatggccggcgttgtattaataaaattgccaaagtatcaactcgatctattttgtattaataaagaattgcatagcaactaactccactgttgaaaaataagtttgtcgtaaattcaagattccacaattttggcgaattttaatttagattttatgtgttttaaggatcgttacaaacaaaatcataaccatatttcagagcaatcccaaatagatttttgagagaagtatcataggtttaaaatatgataaaaaatccaagtaaaaatcagccaaatttatacattcataaatctatctatctattatatactaaaagtccattaaacttcctacaaacgctctcaaaccgtcacatagaactacaaacgcttctaagctgccacatgacactctaataaattagatttatttttcttaaaatatgatggtcccattattttataccataaaaaaataaaaaattgaaaggcccacattcctctccttccgacctgtacgtgtagtacgcacgacatgctaccatacgtacgtacgtagatgtattggcccctccttcctttctgtttctatctctcttatttttcttattttgatgacccttctattcctatctctcctattttgatgatgtggtagattgaaaacatattgatgtgttcgctggaggaagttgggaacctatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatccttagttccggttcgaatgctgtcaggacctgttaggcccccccgggatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 42598 - DNA, 1501 bp, Oryza sativa
gtcttgaattatgcaacaaacgtacgagaagtgcataaaaaaatagttatatgattttagagcccatttgaatcaaagaaattatgaaagaatttcataggattgaatcctataggaatttttcctatgtagccctttaattcaaaggattgaagttttccaaatcctccaaaattcatatggaatggcttattgcatataggttttggagaaagcttagcaagaggtccaacctcttggtaagaattctttgagtctatctctctcactacaagagggttgagctatcgccaccaatttattacaacgaaaaataattcatggcaatatattatactatcacaatgatattttttctgtggcaaataactatattttgttgcaacgatttacaatcgttgttttattcagtatttttgttgcaataggaaatgagctatcgccaaaaaaaacattactattgcaaaaaaacatgttctatcgccacacatttagttcgttgcaataaaaaatttatcatctcataatttgacttattcttttcatatggacacggattaggataaattttatatgaaatttatagctctcgatgagatctacaacttaaattttttatttgaaatcttttaaatactcaaattcatgattcaaatctaagttaggcagtctcaaatggaattgtatgcatttttaaacaaaactgatgcgtaggtgagttggtcatggagagcgcgcgtaagggagagatcttgggttcgaatcctgaacatgacaagatatcaaaagaagatagttaggatgataaattaatattgagacatttaatttggtacgtataactaatgccacacatagagtggtggcaatagttatttattacaaccatgtgaagtgttgcaatatatattttttgccacatccattttatggcaatatcaaattttattacaactaaataaaaatcgttgcaataacctgttaccacgctatttattaccacggctaacaacgattttaagattgtggcaacatgtatctattgccacaattttagcattgatgctacgatttttttcatggcaacaaattatttttctagtagtgtctcatctaattcctgtgtttttcctggggtccaatcaaacgatcattcctgtatttttcctgtgttttgcaattctctattttatacttacattcctgtcagaatcttatgttttcctattcctccgttttttcattcctacgattacgattcaaaggggcccttagtttgtatagtcttatgggtgtgtttggcaccccattttggcaacccttctccctcggtttctgcgagcacgcttttcaaactgctaaacggggtgttttttgtaaaaaaaaaattatatatgggaagttttttaaaaaaatcaaattagtccatttttgaaaaaaaaatctgatacttaattagtcacgcgctaatggaccgctccgttttccgtagctgagatac

SEQ ID NO: 42599 - DNA, 258 bp, Oryza sativa
gggatttcggggactaaggaatgaacgagagagagagagagcagttagcgagtgtaaagaatgattataccctgcacagatattttttccacaattctactaccattaagtgaggtggtaatagaaataaatctcaaccttttaatgaattgagatcaacggtctagattattttctactaccagtagagagctggatcggtggcgacgggtgtgggagagagggaggtgcgggagggaggatgcggcgggtgcggga

SEQ ID NO: 42600 - DNA, 890 bp, Oryza sativa
tcgagctcggtaccctatatatatatatatacatgtatatatatatatatatatatatatatatatatatatatatatatatatgttacttcgcatttatcctaatacattttttttatcttgcagaaaagacgtgttgtcggagtcgtccgtcaagcctgagtggaagagctagccctaaaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 42601 - DNA, 1501 bp, Oryza sativa
tatagttagcttatagtctgctattatagctgctttcaaatgagtacgtattcttcgtcactatatccaacctagttaaaagtcatagcctagttgtccgtcacatctccatacttttgagacaaaaacataatatcattgcttagccgccactatagttatcctactatgtatgacggcgccacgtatcgattaaacaaccacagcaaccgcgcttgtctggttgtcccttgatgccgatcagtgatcagagaagatgagctgctatcatcgttttcatacttataagctataaaatttaaaatgtaaaacttaattttaaacataatttgtgatttgttatcataatttattttacaatatttatttttaatcactaagaccacgtacttatatagaagatatacctatgtattactccatccgttttatattattagtcgtttgactttttttcttagtcaaactttttgaacaaaattataaaataaatataatagtatttctaacacaaaataaatgtattataaaaatatatttaacgttaaatttaataaaataattttatattttagatgttgctaatatttttcataaacttgattaaacttaataaaatttaaacaaaaggtccaacaacttataatataaaactgaggaagtaattttttgttactaacaaataacggattaaacagggaagcgccgggggctaagaacctggactcctggagaagttggtcaaaagaagaagtcaccactcaccactcaccgagacagtgagggcaggtgggaaaaaaactattttcctttccataatagcagtaaaattcaacccaagcccagtgtcaccgcgtacgtcacatttacagcttttggtcgtctataaaaaagacccttgcccatattgatcatattgaaaaaataaatcatattgatcattttttttaaaaaaaaagtagctaatacttaattaatcacgtgctaatgcattgctccgtttttcgtgtgcaggagatcggtttcatctcctctaaacgaactcagccaagtcatcgtgacagtgagggctattttccttaccataagagcaagattaatagtgtagtcggctgctggctatattatgtccacatcattttacagctattgctgaagccaactagtacaatagtctatctgttatgttaattttatcatactaattaaataattacttttgcatgaacatagcaattcatatgatcacaagtaaactacatccctgtggccctttgtggctgcatcatgaacatgataattcacaacacatctataacaatagcagtaaaaatcaacccagcccagtgtcaccgcgtacgtcacatttacagcttttggtcgtctataaaaaggaccctagcttgcccatcgtgcacctcctcaacacaccaaaaaatcctactcgcgcgcccaaacaaacacgcgaagcagcaacaccccgagcgagtgagtgcgtgtg

SEQ ID NO: 42602 - DNA, 1145 bp, Oryza sativa
aaaaattacttccaacagatttccataactaaaattttttgggatataattttagaatgctcttgatgattctctaataaacgggaacatatctcccttaactgcatgacgtcaaagcgccaaaaagtagtataaagaacatgcagcctgatagatggataacataaggacataacatgcaatgcaatgaaccagacagaaccctgaatatgtcgaaatggagagccaccggtggaatattagtactatgacgtaggctagtagcaaatcaaccatactggacatggtgggcatgcaaatcgaactctagctaaccgatgaacaaaatggctaatcgtggaaaatcaagggtggccttgggcagcttgaaaaggaacaaaatgcagatccagcaggtaactggccaaaagaaagaaagaaatagcaactgagtctttcggcggttggccccaaccatgaagctgtggctgtgtttagtttcacatcaaaaatagaagtttgaagaaattggaacgatgtgacggaaaagttggaagtttgtgtgtgtataaaagttcaatgtgacggaaaagttaaaagtttgaagaaaaaaattggaatctaaacagggcctgaataatcaacaatttaatacaactatagaaatagcccaaaaatagtgaattttcctattgcttgcttcattgtcatcctcctaaggattgaaagggagatgaatagagtgcttggtaggacatgataatttaaagcacaaaactcccaaatggaataagatgcattcgatccattatcttcacaaagatcaagagtagttcatttcaacgttccagatttgacatcacaaacatttgtgttattatgttttcagctcacacaagaaaggtatacatgcactttctctccacagaacagaaggcaaaatgatgtgtgcactaactcagcatatatagcaagccttcagtaactggtaacctgatattaatcgtaagttcttcaatttcctaaaagaaaaaaaaaaccttcagttttcaaacactgatggttggtttcaatttctcaggccaggtgtactgaccttcatgctaaactaaactgattttacatcaaagtacaataagtactaaaatcagtagatgatgaatacc

SEQ ID NO: 42603 - DNA, 1501 bp, Oryza sativa
ccttcagttttcaaacactgatggttggtttcaatttctcaggccaggtgtactgaccttcatgctaaactaaactgattttacatcaaagtacaataagtactaaaatcagtagatgatgaatacctcagaatagaggcttaacatggtaacattgagcaaatttcttgtttaagcaattagtacaaactacaaagtgccgatgcatgaattcaacaaactaatgtgttctgggtgataaaatacaacaacagtgtcctgcagaaacactcatatgaactagctagctacaacaaagccatatgtgcttaagatacacggtagttcaaaaatattatatcaagcacaacatttgagactcagcgcacataattcacgagatgttcatgaggaagcagggcatgtattgacaccattcttgcaatcacgagtaagatcactgaatgtctccaatttcctcttcccccgaaggaacacctcagtgtcaactgcaaccctcatgtatccatcgaattcaacagcattaccattgctcagctcctttgtttcagtgtaccactcgctgttctcatcccataaatccttgaagtcatccaggaagtgtgttcgatacttacccttcattgggtcaaagaatgatttatcgggttcattggttgcaatgtacaaatgccggccagcaccgaccttatcattaagtgtcgtaaggagactatctggagaagtatctctatcaagatttggccacaactgtttgttctgggctttctcccccctcacaacatggactgaatcaaagtcccaatccatccgggaggaaatggcagacacgatctccatcaatcgacgcgatttccacaataaataccatgggcgcttgatcactgcctccgtctcaccctcacatacacgagaccagaagttatcaggctcaacattcccaaacttcctcatgatcagtgtgtccttgacgtcacgaagttgcatcggggtcaccttgatgtcttcagtgtagtgattcttcagtctatccttcttgtgccacttcccccaatctgtccagaactggctctggtcaatgaccgatgctgattgcttcaagtgctcaaaatcaaagtagagcctaaaatctctctcttcatccttgccacttgaagtataccgtgaattgaggcacacattaaggtccataacaagtgtccggttcaagtactgtgcctcaccaagtgcacacaagaatccccaaacgtagtggttcatgctcttgcatctctcaccaccgcccatgtagatgagatactttccgcggctgaattcagactcagattcgaccaccggtaaattgtcattgacagcttcaccgacaactagctccggctcggaggcggccgtggtgtctgcattggcagcgttctcatcgagcctcatctgcgtcttggccggcacaaagtcggtgaccggtgcctcgcgcttgcccttcttccccttcttgcccttgcgg

SEQ ID NO: 42604 - DNA, 1501 bp, Oryza sativa
ccaccggactctctctcctccctcccgcgcgcgcgcgcttgggccgtcttgggccggccggcccgttaagctcggccgagccgctccatttaccttgggccgcgccctagccgcccgagaaaaagtctaatttccatccctctgttctttcttttcttttctttttcaaaaaggatttaattaaatccttttcctttagaccaaaaatccaataatcttagaaattcaatatcttcccaaccgtaattccgtttgactccgttcaacttctaaaatttcccaaatctcgagatctatctagtggcacgcttagaggtcattaatagggctctattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcacacttaatctgttgtcccgtctgtagggcagattggcggacttacctaacttattgcatttgatccttccattgttaattgccatactatgtccccttgtaaccacccagttgcacctcgatattcgtgcactctgtgcgagtatcgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgggtgtacggtttcccgctcttgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaactgggttcgatgtttgaaaaatcagcagctgacgggatcagctaggcccgggtggccgtttgaaaagtggttggcccgggtggccgtttgaaaagctgttggccgggtgccaaccctgtttcaagatctaaagactgatacattgcacatactccgaccggacgagacgcactgtctcatccgtgtcgtttgagaagcactcacttagacttttt

SEQ ID NO: 42605 - DNA, 1501 bp, Oryza sativa
tgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaaccacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcaagagcgggaaaccgtacacccggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatagtatggcaattaacaatggaaggatcaaatgcaataagttaggtaagtccgccaatctgccctacagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaatagagccctattaatgacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagactttttctcgggcggctagggcgcggcccaaggtaaatggagcggctcggccgagcttaa

SEQ ID NO: 42606 - DNA, 1501 bp, Oryza sativa
atctctaattttaaccaaaatacaaaatttacgctgaactaaacacacacttaggctgtgttcgcatgcaccttttcccatcctcttcccctcgttttccgcgtgcacgcttttcaaactgctaaacggtgcattttttgtaaaaagtttctatacaaaagttgcttaaaaaaatcaaattaatccctttttgaaaaaaaatagctaatacttaattaatcacgcgttaatggactgctccgttttccgtacgcagaagttgggtacccatctcccccatacgaactcagccttagtattttagtgtcaaatccttaattgccacgtctaaaaagtggctaatagttaaatattcccagtaactgccacgtcttaactcgagtatcttccccttcccttaggcgtcaaaaaagaaaatctcccgtctcctccgctccttgcgccaagacgagtcgcggctgaacaggggaggggcgccgatctccatccggcgagcagagcagggcaggggaggggatcctggtgagcatccacatcctctttctgattcatctctctcccaccgggactacttttgtctggaattcgcttgcgttccgttcgtttaccctagcttctcttctagatctggaaggagctcttctcttaatttcagagccttaaccttaatacaagtaacagtttctttgttcacccaaaagtttgggggttcaactgaacccccatgtcccaagttggatccgccctctggggggcgcaagatctcgtggaatgagggaatgggtgtaggtcacaccagatcagctatctttcttttattttttgacatgatagagaagaatcagaattgtatagatttgggagctgtgaaataatgaggggtataattaattttgttttcattttttagattatagtctatcgaaacttctgttcttctcatgcctgaggaattcaaatccatgtttgaacgtgttttgagctgtgaaattgttacatcctgttaagtcaattcatcgaattaatccaatgccttgttatactcattcatgaggttagcatgtaagtggttctgttattattttgaagccaccaacatttactatagtggtttgccacaagtctaacaaagtttgtgaattagtaccatttgccaatggtgacccttgagcctcgtctacatacttatttacagtctcgttgtgtttaattccatggttgattttatgaggcgatgatacaccagcattgttctattgcatcccccttctgtctctttgggagtatgacaaaaaatggtgtttagattgttaatattaagtttgtgaggtgactatttcttggtccttgttaaccgtttagggcacttcgggtgggattctattatctagtttcgcaaatttaggctgctatgcccatgaattggtgctgaaacttttatttaatcatgtgcagaattgtggaggacttagaggttgtggcacactacagctttgaacca

SEQ ID NO: 42607 - DNA, 1501 bp, Oryza sativa
tatcaggaattatttaagttgacaacttatgtaatagagatgttaacccataaacatcgatttatcaactatcaccaaagcaacaattacacaaattgtttaatccaagatctttcaatcttttctctctttggtgttgaataataacccgatataaacaatatagagagatgagatgaaatatatttcaaatcaaggtagagatcttataataaaaatatatataataagctccccctcaagatgtgcatatatatggatataaaggaacacatatgcacataatcaattaagatcaacgagggagctcacactatatcttggatccacaggagagaccaagttagaatatatgaagtttaatgcatacatattatcatttttattttcatatccaaatgagactagttaaaaaaagctcataaaaacgttagtctcatataattagatttgccattaatcaccaaaaccaaaatagggcacttgaacttatagttacccatctcaaactttggaagttctacaatatgatatttcagaatttttgaccaaaatttggaagttttcgtctaggagtactagtttggtcattaggacaaaattgtacaatattgacgacggctaactaggcggcaatggtatattatacgtagtagaagttaagcaaaacactatggcatattagaacttgacaaacctagtggcatatcataaaatagagacaaaatcagtgacttgcaatagattctcactatattttatggttgttcactaattaaccacctatcttctatagtgcggtatttttagaaaaaaaatcaaatcttatactataaatccatatcttacacattaaattacatacacttataatgcaattttcaaattatacaatgcactattcacattttgtaggagaaatatgaaaaatgatttattatctgtttaattatgagaaaaaatattagtccaaattaacatgtatgaaaaaaacaaaaaacaatatgaaagaattaggaaaataccaatatagttacacattactagaaatataattcccagcaatgacgcagaaatacttctagtatattatggttacagagttcatccgcaagcgcacggatataccattgtagcatttcacccgagagtattccaagggtatcgcatttgtttaatcccgtggaaagattataatagagagaaccgtactaataatttatatattacttgtaacaaccaaagtctaagcaggggttaatctaattcagagggtagagtgacactaagcagaagcattcatactttcattcacaattatctaagctaagtggaaagaatatagaaagatcatattcctatacttcatgttatacatgcatcctagttatatacttacttactaataccctctttccgatgccctcctggtgcttcgagaagccacccctgactgccgagtttcttacgacaacccgtcatgaccatccaactggggata

SEQ ID NO: 42608 - DNA, 1501 bp, Oryza sativa
gtccagtacttgcccaaggtgagaggctctcctctgacttttttttttctcagtcattggcgaaaaaaatggtcgcggactggaacagtgcgatgcccgtttaattttactgcattaggagatgtttcgataatcagttctagcagagtaggttcggattgttaaattttcgcccatcggttcggctgtattttatttcgttatgattggggaaagtttgtgaatcgtggttacaaagatagttctcgactatctttacctagtttcaagtaaagttgagagaacgtacggttaatttaagatagtttggttatgttattcacctgcttcagatatgtaaggttcttgtactgttatcataatggtaaatcggtggtgcattgtaaccccacattatttattgatgatacatcatttctggagctttcaacactgtagaaatgtgcttgtcttgggtgactttttgtagaacaaatttgctggaaactggtaacaactgtaagggcaaaatttcagtttttgtcatattatacaaaagatgggcaacccttctgaatcagattctaagggatcaggttgagctctcaattgtggtgattcatgttaccaaaataaccagcctatttgttgtattcagtttgccacttatggttttgggagaggcatagttggtgttatgaggacaaaatgctgttacattgctataaaaaatatgaaaaagaaaaacacatcaatgatggttgtcaatttctgccttagtttggtcatactgaaggattatgtactgttgtgcagacaagcatgagagggtggaggagtggtgatgctatgaattcatcaccatatttctgccttggagatctctgggaagctttcaatgagtggagtttttatggggccggcgtccccgttgtgttaaatggcaaagattccgtcatacagtattatgtgccgtatctctctgccatacaactctatgcagacccatcaaagcattcaacaagaatcaggtagaaatttattctagtttctcttggcccttagattacttatttttctccattctgctttgtgcattgccaggaattataaaagctgcaaagtaagctagtgcagtaagcactggaggttcttttttttttatcattcttctgtctctggttatttaatatgggactgctaaagaaaaaaaaggttttgatttggttaaacaaccaatagaactgagagttgagaggatgtacttatggattcattattattattttgccttcctttgactatgcaagtctattggttcttcttttgtgttggggatgcaagtcacaactcatttgcgtacagaaagctagtgctttgaatatccttgtagagaaatgtgattgctagctgtagcctgtaggcatggctgcttgctgccaccttttctgttcattatttgaattgctcaaccaaaatatttcctcttgagttcacacaattttgtcttttgtttagagat

SEQ ID NO: 42609 - DNA, 1501 bp, Oryza sativa
agcgagcatgtcgatgatcttgggccatattagttcatatgcatgtaggtgcatttggtaggcttgtctagccaagtgtagtgagttttctcaagtctcaaacaaagagacaagtggacacattttgggtagccttaagtggttttgtccggtggaatatcctttggagtgtgagccaaagtcggtctgactggaaggtgctcgatctgacgcagccgaaggaggtatgaccgtgttgacgaaaaatccgcgcttggccaatggtgccagaactgtgttggcacgaactaagtcgacgaacacaacggcatgggagatcttcttagctccagtggcggtccaaatcttggtgagatgtgggcgtgccagtcagtttgatcctgcaactgacaagatatgtaaacaatagatcaaatagccgatcggctgataagctaatggagtaattccagccgatgccgacactagccgatgtcgatagggttttgagcaatcgactatatgtccaatgtagataatgatataaagacaatcggttgatgataatgtaatataacaatagtatactccagtagaaaccaatcggctaacaatgatatgatagaataaacactgatccgaaggttaaagcatacatcggctggaggttcgatgtcataaaatccataggattagataaacagtgaaatctttgttgcgatcggctaaaactaacttgtacgtaatccttataagccgatgcaacgtccatataactcatcggctaaaactccgatgaaacccttattataatcaaagatataaattccttatcggacactaaacacacattcctaaagataaaaggaaactaacaaactattcctaattaatagataaacttgccatgactcatcctccttgaactcggtctcttctggataagcttccttgaatagattaatttcattaactgaatcctccaagaatacaactagtggcgacttgataattcacatcgggcgataccaggactctaaagccgatactttctctaggctgatgatgacttcggggtttgccaaatttcactgttaacaaacctttgatggtcataccagctagccattgctcgtgcattaaatgcactataacaaactagttttctagccattacaatgaaggtcggtctgaccggccactccaaggcggtctgaccggccaacacctgtgagttgggatttcgcccccaccgactagttttggttgttgtgggtatatatacccactccctagtagcaatggtaaggttttagcactccattgcattatattgaatccttgcaagagctctcatgcccttgtgcactttatctagtgagttaagataacccaagtgggcaagtagttactttgcatgagcataaagcctctcttttctaccaaagcttcaaaagcagaatgggagtgtcaacctttcccacaatggtttcaaaaaagacatctcatgagacagtgaatg

SEQ ID NO: 42610 - DNA, 1501 bp, Oryza sativa
ccgaacctactctgctagaactgattatcgaaacatctcctaatgcagtaaaattaaacgggcatcgcactgttccagtccgcgaccatttttttcgccaatgactgagaaaaaaaaaagtcagaggagagcctctcaccttgggcaagtactggacgggcacggatggcgtagtggagctgaggaacctctccagattccccgccgcctcctcctccgccgcccgcgctggctccggcgccgattccgccgccggcggcctcttcacgtccgcggaggacggcaacggcgacaccgacggctttgactgaacaaccgcgtccacccgcctctctacctccttctgcctcgccgcctccgccggtgcgggaggcggcggcggcggcgacggcgacggcagcggcttctgcctcgccgccctgggcgccgtcgccggcgagggggagagcgaaggcggccgttgcccctgcagcagctgctgctgttgcagcagcagcatctgctggcggcggacgtgaggcgggctgtagaaccggtcgctcagcatgtagcctccacgagtcgacgacgactgcgacgaggacgacgtcgtcgaggaggtggacgacgacgacgaggacgccgcggcggcgccagacgggccgaccatggcggcggcgggtgggggggctaaggttttggggggatctgaaccggaagtgggggggaggcggcggcgaggcggcgcgggggcggaggaattaggaaagggagggaggggaggtgaggcgaggtttgttttgccgttgggttaattaaattaattaatcactcgcttaattactccggggcttggggtttctttcctttgctagtcttgacctcacgacactctgctagaatgctagatgcaccaaacaccactcgagtgataaaaaaaaaatcttcctctctatgacggatcacgttggagttcttttcttttttgccttttttggtacgatatattcctggcagaaatgatgtcttgttttactgatatcctctttgcttcgtcccacagctattcctttgtctttctgttttcggctaggctttttccctagcattccctcccttttagattataagatattttaactttagttaaagttaaactgcttcaagtttgatcaaacttatagaaaaaatgtaacattttcaatccaagataaatttattataaaaatatatttaattattaatttaataaaactaatttggtaatatagatattattatatttatctataaacttagttaaacttgaagcagtttgactttgatcaaaatcaaaacattttataacctgaaacggagagagtaacttctttaacgcatactccctctattacacttctgaaaataaatctatatgtatgtcgagatttatcttcataaattctttttgatacagaaagagtattttttaaaaaaaaatagacagagagtttttttaaaaaaaataaggaacacaggaggg

SEQ ID NO: 42611 - DNA, 1501 bp, Oryza sativa
tgaaagtttcagccttgcactattgggctcaactgcatatggcacagtccaatcggctaaacttcagttatttcacgcgcaaaaatttgacaaagcctgatgctccatttcaattacagaaataaatatggtttcattccagttggcatcctccttttcttgtggctatagtttccattggctatagcctgggtgtggagattatgggtacgccatacccacacggcacggttatccgattagttataggggataacctatatctatggaatatgtaacgaatcatgacttgtgtattatgtttccttgtatatattatagaacggcctaaaatcatagtttgataatattgtaaattagatttaggaaaccgataccgtattggttgggttggttaaggtttttatcttgtaatcctgccccccatcctatataaggtgggcaggaggtcctctaggggacatgagcacatatgatcgtcagatctatactacacccggaggattcaaatccccaaacaggagtagggtattacctctcattgagagggtctgaacctgtctaaatccttgtcttcgcatctatccacttttaggtctcgtgcgctaaccccttttattattgccgaattcttgtttcaacagttggcgcgccaggtaggggttcgccaagtttccggcaacgagtacgatggaatcaacttcatgagtcatcggcttcgtcttcgcttcgggatttttacttcctcgctgccgataacttgaacatgctctatctctctgacttggattcaaaccggtcggaagagattcaatctatagaagagaacaaacactcaaccatgtcaggagattcagatcagccgtgttgatcgcatgcatctactgatcactgccacatatgcatctatgcatggctgcctacgagaccatctaatcagaaggagttcgtctaactaccaggttgattcttcccgagtcagcaaggtcgagcaaagcatcaggatattaatccacgaaccagatcagatcatcgagtctgttggctccaatctttgacatggatcggtttgttattcttgttcaatttaattagattaatctccaattatgatttgctcttctggtgttttcctgcaggtcggcttagatcaagacggagccgtttgcagcgccctcgtacatagaggttttatccatgagcgatccaaatactggagcagcgccgacggacatcttgtggccaccacgggcacatgggagcagtcgcctacggcttacccggaaaaaatacatccatgaattgatccaactgataatgcattactaagcatcacgcttctataaggaaatattaatttccgaattctaactagattttctatctattttcatgcatgtatctctggagctaccatgtcacattgtggcagttggattttcggagttgtgatctccactgccaaccggtgtcatttcatcgtagaccgctttcgtcgtcg

SEQ ID NO: 42612 - DNA, 1501 bp, Oryza sativa
agtacacgaatttacaaaatgcttatttcagtacacaaacttgtttaatgagtgcgaaacaaggccaaaatggcagacaatgacaaagaatttctgagttggagcctacttagaatggcatgagcatacataaggggtcatgatacacgctacatgtgcgaatagcctctacttggtaatacctccgtttctaaatatttgacaccgttgacttttttaaatatgtttgaccgttcgtgttattcaaaaaaatttaagtaattattaattcttttcctatcattttattcattgttaaatatacttatatgtatacatatagttttacatatttcacaaaagtttttaaataagacgaacggtcaaacatgtgctaaaaagacaactgtgtcaaatatttagaaacggagtatttatttttgttatttctttgttttcaattcattgcattctttagctatatttcatattatgtccgtataatcggtatctcttattatatatttggttgagcacatatatacatgtcaagatgacatcatcctgatgtgtgcctgtatgacatcctaataaacacaactaagtaggtagtaggattaactagggcatgctcatttgaaggttctcatgcaccaaataagtttgtgcatcgaaataagcgttttgcaagcttttgtgtatcgggttgcacccacttcacaagtttctgtactgtcagtgcaatttacacttcattttttaccctaagctacagaacctatacatgtttgtcattggttttgtttgaaatggagatgattttcctatttcatacttttatgttcctgatgcaatgtcatttaatttggttcacaaagttcatgctagcaaaaaaatcactatcatgtcaatcaaaaccaccatacaaatgttctttagaaaatatgtatccgattttgaaagacatgggtgaaataactagttttgtatttgaggataaaaaatggactttcacataaacaaaaaaggtaaaatttataggttgattgtgttaactaggtgacgtttcaaacagccattgtccccctatattaatggcaggggtcaaaacccttcaattggactcaaatataacataaaatcaactcaaatccttttcaaaagtcacaaactgacttggaccagaagttcctatactgaagaagcgtgcgctttctatctgtttgattaaaataaggccatatttgtttaggcttataagccaaaaagtctctaaacaaacaatcagttttttcgtttggcttttttgaagccataagccactctaacactaagggcctctttgtttaagcttataagccaacttataagtcgaaaagtctaagcctaaacaaacaagcagcttttccgtttggctttttttgaagccataagccactctaacactattaagccaaaagctaggttggagaagcttttttggcttatgtgaggtagatgtatgactcaactactaaactta

SEQ ID NO: 42613 - DNA, 1501 bp, Oryza sativa
ctacagccaggctcatctgaagctttaatcctatgtgtcctaggccttccaggctttctcctcaactttggcctcatcaatttgaaaccaggatctacaaatgtccacatattctttgatgtcattgggttccatatcccagcatatgtttgcctcaatctttgcactgaataacactcatccacatagccattcatgtcagaaaaccttagagagcctatgaatgccaatgcatggttacaaggtttcccacttacttgccaggctctacaagagcatgtatgagccttcaggttcactgcatgcctccataccactcccttgttggacaccatagaaacttcagctaaatcatcgcaattactccttaccacattgtaatcttttagattcttgctctgttcattcagtgtcttaataatagatggaattattcttccttccattttgcttgcaagttggctcaagtgaaatttgtcaattatcatttgcctaagtgtgtcaaataagtccactatgtgtaattccttgatcttcatcacccaattgttgaatgactcagaaagattgttgttgatgtagtccacctttgaaagctctgagaatttgctcctactccaaaaaaatgggtgattggtttttaaatatgcaatagcttcaggagatttctcagcaatcttgttcatgtgatagttgtactgctggctggtgtagcacttagcagcatgccacatgttttcaccaaaaagtggtccatggtactgcttcttgaagttcttccacaggtgtcgcatgcactcccggtgctcagcagttggatagacatcactaacagctctctctagtcctttcccagcatctgtgctgatggctagcccaggaggattaccaatagcattcttcaagttctgcacgaaccatgtccaactctccgtcgtcttagcttctatcacaccaaatgcaacaggaaaaagccagttgtttccatctattgcaacagcagctgccagctgtcctctatgcttccctgtcaagtgtgttgagtccattgcaatatatggcctacaaccttgtaggaatccatcaatgcaaggttttagagctatgaacagccgcctgaagcatacttggtcttcatgaatctcggtatcaatatcgacaatacttccaggttgtgccttcaaaagctcctctctaaaagtgggcagcaatgcaaagctgtcttcccacttcccaaatatcttctcaagggccttctctttgcctctaaaaactttgtcatatcctattgtaaatttgtacttcttctctagcttgaccttcaatgcactagctcctagagttggaatctccttcagccaatctataactctttcagcaacccagctatttgttgccatggcagccccagtcttatttatggaacaacaactgtgggcaggcctatttaccttgacctgcacatataacaatgtaattatcagctttttatgcatcaaat

SEQ ID NO: 42614 - DNA, 1136 bp, Oryza sativa
ccacattcccctcccctcccctctcctctcctctcctctcccccacatggtttccttttttggcaccgcattactttcctattttagtaaatttatacacctaaagtttgtacacctcaaatttacacatctgaagttgagagatctaaaatttataaatcaaaagtttatatattcgactcaaatttaaatttgaattcaaatattttttatatatagtatttctatacatctaaagtttatacacccaaagtttataaatcaaaagtttacatacccgattcaaatttgaatttgtattcaaatatttttttatatatagtatttctatacctctaaagtttatagatccaaagtttataagtcaaaagtttgcatacccgattcaaatttgaatttgaattcaaatattagtttatagacccaaagtttataagtcaaaagttcacatacccgtttcaaatttgaatttaaattcaaatattttttatatatagtatttttatacataaataaaggtctaaacaatcgctaacatcagctgtgtaaaaatcttgagcaataaagcaactaagcattctcagcactcaagtgggccgaaaaatggatttgcactgatcgcgtgatgctcccgcacgcgagcgatcgctgattagccatttccgtggaccgatggccaatgtccagcagccgggcacttctacagttttagtacttatggaaaaacaaaacaacataaaaaaatttccgttgccgggactcgaacccgggtctctcgggtgagagccgagtatcctaaccagctagactacaacggatttatgaaaggtttcaaaatacaaatatttttacaaattaactataacagcacaagaacaaaaatccactgctttctttcacggactcggattactggattcctcgtcgttactccgatgccgatgcgagtacgcagcaaatcgaagtgtacgtggctgtgcctgccaactccgagccggactccatcacgccggccggcctctatatcttccaccacgccggtaaccaactaactcaccatgcccgcgctcacgaccaccgccggagaattcgaccgatagatcgatcgatagcggcctgccggtgaacgttgatca

SEQ ID NO: 42615 - DNA, 177 bp, Oryza sativa
ttagcactcctattgcacctcattttaaattatcagttttacaatgtgctagtactgatgaggatgtagaatacatgtctagagttccatattctagtgctgttggttctttgatgtatgccatggtttgctccctgccagatttatctcatgctatgagtttggttagtagataca

SEQ ID NO: 42616 - DNA, 1501 bp, Oryza sativa
gagaggaattcctttgggtcagtttcgcctaagtagcgtgggacgggtgggaacttgcactggggtgggattggacgggtcttgattcccccactcagcggtagccccttttcgccccctgccctgttcacggcaccttgctgcgggtacggcgtggcgaagggcgaaatcacggcttgtgcgtgaggttgggccatggcatccggctgcccggccccgattggtgatgcttgctgagccgccatgaatgggtcgaaagttggctgtgaccatgtcatggcgacctgatttggtgcttggtttgctctgaagcctggcgttggtgcttgcggccgaacggttggcgcctgagcagcattgatagagtcgaactgcggtccttgacttcacggcgaagcccacagacctggctgattcgaaggcaaccaactaggcgcaccttgacttgtattcccctccgggcgggccgaaggggctgtacttgaaatgttgtggggttggctgagctgctgaaggaaagcttggagctgcgcctgcagagccgaagccccttctgccattgttggtggcacttggccaggcggctgaggatgtacttgggcagtgaccagttgagcttgcagttgcacgtgagggaccggatacgctgctgcggtcaatggctgcccggcaaagtacatcggcgcttgcgcaacttgtggcggaaggggctgggtcggcacttgtggatagacttggggtgggacatagcctgctgaatactggaggattggtgccgaagcgaccttggaccgccttgccgcctcgtacgcttgctgctgttcttgcatttggcgaagcatgtcttggagtcgtgtcatgttctgtcgcatggcttccatgtcggcttcggtttgtgtctcggggtcagggttgacttgggcttgcacagcggcgagcgcagtttgggccgctgccggctgcgacggagcagcttggggcaccagtagttggcttgtcgaaaggatctccgccctggtctggagtgccctcgtcgccgcagccgccctcgccatgtcagccgcgttcggcacctgcacagaggtagcaggggccgaaggcggtagtgatggcgcaggtgcggaagcagatgacgctcctccatcttcggcaacaggcgccgaaggctctgctccctcttcggcggccatatccgcccctgtgtcgctttcctttcgccttgtaaccttctcctttacgaccttcttcggtggcattcgctcttagtggtttcgctcggaggtccccacggtcagcgccagctgttgtcgaaacgcaattgcatacgtcgaaagacgtggttactcaacagtggttgaaagagcagggctgtaaatggaggtttcatgcctctacaagtaagaaatactatggctgcaaggtaaatttgtgctgaaatgttcagttaattattttatcatttcatggttaaatttgatgcataaaaagctgataattacat

SEQ ID NO: 42617 - DNA, 732 bp, Oryza sativa
gttttgtttttccataagtactaaaactgtagaagtgcccggctgctggacattggccatcggtccacggaaatggctaatcagcgatcgctcgcgtgcgggagcatcacgcgatcagtgcaaatccatttttcggcccacttgagtgctgagaatgcttagttgctttattgctcaagatttttacacagctgatgttagcgattgtttagacctttatttatgtataaaaatactatatataaaaaatatttgaatttaaattcaaatttgaaacgggtatgtgaacttttgacttataaactttgggtctataaactaatatttgaattcaaattcaaatttgaatcgggtatgcaaacttttgacttataaactttggatctataaactttagaggtatagaaatactatatataaaaaaatatttgaatacaaattcaaatttgaatcgggtatgtaaacttttgatttataaactttgggtgtataaactttagatgtatagaaatactatatataaaaaatatttgaattcaaatttaaatttgagtcgaatatataaacttttgatttataaattttagatctctcaacttcagatgtgtaaatttgaggtgtacaaactttaggtgtataaatttactaaaataggaaagtaatgcggtgccaaaaaaggaaaccatgtgggggagaggagaggagaggagaggggaggggaggggaatgtgg

SEQ ID NO: 42618 - DNA, 1501 bp, Oryza sativa
cttatcttggttcacccacccaaaagggaaaaaaaaaaaacaagagtttattatcatggttggcagcagagtacccttaactttaagttaggactaaatcttcagaacatgtaaagcttagtttgagttgttagggccagcccaatacaaggcaaaccgaagatttattggagacaagcaatgaataaaaattatgtttttttccaatgcccctctccctcctttatgtctctccccctatgatcagatcaccagatgttgcatatttctcccatgctaaggtttcatacagctattatccatttatcctcctctgtacaaaatacacatggagcagtagagaagaataaaagataaatgaatcaaggataaatattgcctttaatctcaattgagagatcttgctgtttcagatttctggatagtcagaactcgcatgttagtccctcaaaagaaaaaggacttgcatcttacaaatgacagtcgaaaatgcaccagttccttaaaaacaatttgtgatagcataaaacatgactatacctctgagttgctgtgatgcagtaatgaagactcttctaggtgatacatcatacacaacagacaaccttggccagcttagcctgtaaggacgagtgtccattccatctgtcaacagaacaatctattaggaataagccagcaaattctccacagattatgcggacagattcatcgtaacaagttaaatttcagtacctgtctaagatcatctgaattgcttatgaaatgttgcaatttgtcatcaatatatctggtcactagcctataatgttctgcacttggcattaaatgtaaagctagaagatctttatcttcacttgccacatcaagtgaaagtagaacagctgcatatgggtcaataaaaagaggatctgcaacaaaaataatactgagaaacattagaattttgatatacaatcatatatagccatgtgtggccttctcctaaaaaatcagatgatactctacagggattatcatctgaattctgaactttgcgaagaaagagcaattcatgattcaaagttctaaacaactgcgttaaatctgtctcatgtgggactgagacaaaactctgttctagttaattcagaaaaataaatgaacaagcaactaaagcacgtcactgtaaaaacatgtaatttgcataaaaagtttgtatatggtgctgaaatagtactaatgtcatactttaataaataaagatttccaatattaggtaatcaatatgcacattgctgttggtttttttttaaaaaaagtgcacgctgcttaagattggcagacttgaaaacaggtgttaccaaataatttacaacaactaatctataagcacattgctgttgaaattatgactttgcatgcgccgccggggggggggggggggggtaacaaaaccattcccctcaattcgtcgaacaggtagcgcgcactgccagttccgacggaatcggcggcacaa

SEQ ID NO: 42619 - DNA, 523 bp, Oryza sativa
ttgatgtacaccggcattttcttagggtcattattaaataaaattttaggcttgggaggagaacttcagggtgtgacagggtcccactgtaatattttatttattttaaccgaacagtcacttacatgcgggtcccacatttttttacttaagtgccacatcaatgccacataggtgccatgtcagctgaaaccaccacccaaaccgccttggcaccttatttgcactggttttgaaagctgagggatgtgtcatatttggtattgcggtttaggacaaattttagactcggcgacaacttggtttagggacctgatgtgaacctattccaaaaaaaacacatcaatgttgggctgaactttggagcaacccagcccatatttcactctctcttcttccacatcacatgtgggaataagtctatattttctctctcatttcttgcttctgattaaatcactgtcacgcccagaaattcactagtaatttccgaacttatttatgcataaaatcctcgtccagg

SEQ ID NO: 42620 - DNA, 1356 bp, Oryza sativa
cgcaacccctacctggcgcaccaattgtcgaaacaagatttcggcaatacaaaaagggggtggctatcaagcaggaaaagtggatgggtttggagacaaggaattttatacaggttcaggccttctcaatgtgaagtaataccctactcctgtccggggattgattcgccgagtgtgttatagatagtatgatctgggagaaaagttatgccccaagaggcacccggacccctccttatatagtgggaggaatccgtattacaaggtacagcccatattcctaacggaataggcaaataaagataaaatacaatcgtaaccgactagaaccccatgtatttccttgatacacaagtaaggaatttaacccgagtcccttaaaggtattatatctgtatatggtacccctatacctagtcggatatacatgttgtgtgggtatgggtatccataatctccacagtcgagcacgtgcttgggaaatatccatctcactttcacccctagtgctaacgaaaaatttgaagttgaagaaaaacggggccttggtcatagaaaaatttagcccgacggttgtccaagatgatgtctctaacataaacactgaagtataaagtgggacatggctttgggccaagtgcacttcttgtgctagctgagccaacctagtcaagataaaagaagggaccgagagggtatacatgtgaaaggaataagtctattttacctccctcatctcttgctcgtaattgaaacgcttccttcaaacatcgatttgtacccatttcgaaaataagggagttgtagttgagggatgtgattgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagaatttcagtaattacccacatattaaattaatcattaaatggtctgtttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagc

SEQ ID NO: 42621 - DNA, 190 bp, Oryza sativa
caggctacaaaactactgaaacagaaaaaaaaccatttttaatggattctacgcatttttcttgatttactgagacttgaatgggcttaaacggagctcggatgaattagttatgaattttagaagattcactgtgtttattactataacaaaaagaccttaaataatttattgcgcaataattcccagg

SEQ ID NO: 42622 - DNA, 863 bp, Oryza sativa
attgttatcctttcaccacaatcagtagttttctgaggggttaatttctttgcatacactgatgaactctgtagtagattctctgcaggctctttcttgctcaattaattatcgctcactctataacagatcaactctggatttagacttctttggccaagcactatggctaaaatggcatgccaagcttggaacagaaaggtcaagcaatttttccaaccacggtgcagcacgtggctatagcactaacactaatttctatcatatgtaggcagatccaattgatgctggcacaggctttggtgaatcactgatgggtgagagacctacagagttccttgtccaacagagcaatggctgagttctttcagttgtgggatgaaatttagatggtgcagcttcaaccaggaatagccccgactccattcggtgctagctaacaggtgatggccagtttactttctcatcggcttacaacctcttcttcatggcaaagaccaaatgtttatatagtgaactgcataatttcgattcttgctattcatgatgatctgttggttgatctggaaagacggaacacttgggtatttgagcagaggtcttgacctacagagcaattatttggagacatcaaggagatcacgatttggaagtcggctagcattttttatcctgcagtgattatttattagtgttagttgtttattgtggtctgatgctttgcctcatacctttgttcgacatcatagtactttgtactttgtttctccctaaatcttaataaatttggtaggcctaatcctttggccaacctggtaaatcatttcagtagtaaaaaaatgtgttttcctggtcagattgat

SEQ ID NO: 42623 - DNA, 686 bp, Oryza sativa
tgatgtttgtaagacatggatctgaatgtcaacattgtcgtttgtgtacccggccggtcctagacggggattttaatgcacattctgcttggaattctattcaggaatttctaggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgcttgtttaagtgagatttggcaaaacaagtcagtctagggttttagtaaaattatttggggtttattcgtcagtcagttgggatttgatgggtgaaatgcattaggtcctagctcaggaatatgggttgcaaggtatttgtacctttattgttattattagtatgtatctaatttccccattattttatcgttatgtaagtctgtcttatttattcgctctcatgcaaaattatctatgcataaaatttcgctcttattcgattctcttatttgagtcctttattgctttatttaaatttggatttaagcatgcattgatcctactcctttgtcttctctagatggccggccacccacccaaccaccgcggagaaggcatgatcgactttgtggcagagttagcacgta

SEQ ID NO: 42624 - DNA, 284 bp, Oryza sativa
tgtgttatgatcttttgcttgtaacatagtgttctatgttgatttataattatgcatagcttgaaatgctttgaagagcaactttttttttttgaaacgtacaatttttttcagccatggaacaaaaatatgttcattcttgctctgttactatttgtattggctatttcaggactagaggtgtattttaccttgacatagcatgtgttttcccactgtctgctggacttctgttcctcaatgctatattatcatcttttgcagtttaagcgacaaggaattga

SEQ ID NO: 42625 - DNA, 619 bp, Oryza sativa
tgatatcgttaattggcaattgatttgcatttgtgacgctctgcaatttatgcatcttataatgtttaattctttagcattctgttcaattattcaagtaagggtttcagttgatatattatggtcaacatgtaaacatgcacctgtttccagttgtatatcccgcctaattccttctcctttcataatgtgggaagcacaccaaatcattgattgtatcaggcatgttctattcagtataatcagcctcaatctaggattttgggttgactgagatcaaattttgtgctgcgcatgttagcaaagaagctttgtaccctcatacctccttaatcaaaatataatttttcaaactttatgtttgtgagaatccatatggatgttgataacaggagagtttcttcatttcatgtactttatcaatgtttagccaacaatgcaaattcaggagtgcttatcagtattccaggcacacagtttattagtaaaacatgataactgttcagctgcaaatctgtaaccatttctttctcattgtacttttggaatgctctcttttagctatccatcttgccttaagttgcattgatttcggttatgcactcattttcactgtttt

SEQ ID NO: 42626 - DNA, 347 bp, Oryza sativa
ccgcacggaaaacggaacagttcattaacacatgattaattaagtattagttaacttttttaaaaaaatagattaatttaatttttttaagcaactttcatatagaaagttgctgcaaaaacatattgtttagcaatttgaaaagcatgcgcgagaaaaacgagagagaagattgagaaccctcagtagcaaacacgacctaagtgtgctagaataaactccttcttccaaaaacccaacctagtattagaatgtaatataatttagtataacgagagttttcatggtatggagggagtatctggttcggactcacgtgtccgattcgatttcaggcaacgaggaga

SEQ ID NO: 42627 - DNA, 1501 bp, Oryza sativa
gacaagccagtacagatcaagacaaaaccaataacacattgacataagcctagacaaataccatatgaagccacaaagaccgataaaagggatttagcgcgacctccaatcttgctgagttcctgttcgagaaagccgatataaattatccatcaaccacctgatcgagcttccgctattagattgacggagactagatcaactcatactcaatattgtactcgtaagatattgatatataaaggcaacactggcttcggtcaaaaggaatagtgttattacatgtcagtaaggggcctcaaacctatataaaagtacatgtgtcctatatattttcacgtgtatactctgatattaacgatctccgtactttacaaatagtgtagacggctacacagcccatcaatagtaacacacctcattttactcaagcttcgcctaaaaaattcaaagccgatgttattatagccattgagctgacattcttttcaaaacactccaccataccaccgaggtagtatatacaggagtagtttgtaggaatacatgtgagcaattccactgttaacataaaaacctaattacttactaatttattttccacatagtggtataatttcttttaaaaattacaggtggaataagcggatagatgaaaagtctccgcttgcccaccccgtatacctaggctatgtttagtttacgtcaaaattagaagtttggttgaaattgaaacgatgtgatgaaaaagttaaaagtttatgtgtgtaggaaaattttgatgtgatgaaaaagaaaaaatatttcggaactaaacacggagctaatatcttgtgcttggctgctactcctgccttgcccgttgctagttgctgcaagctaactatagtaactactgctgctgctgctcgctactcctgcatgtggctagctgctgcgtgctatctactgttgctgctgctcgaatgggccaaggcccaaggccggcggctctgttgctgcatgcgttagctagctgcgctgactgcttctgccttttttttttttttgccttttgctcttcttctcttcctattttcttttctttactacatattaatcttgcgatagatttatagctttggatgtttctaaatttttaatcaactagaaaaaatgcccgtgcgttgcagcgggtgaagactattttaattttattattgttatatggtttaattaagatgaaaatcactttgagaattcgcttggatatatgttcttctagaaaatcataagccacaattaggagtccgatcatcacaagttagaatgcgagttttttaaaaatatttttttctacgactccttctgtattttcaaaagagaacgaacttagaacttgactcaaatacagatctacatttccaaaagcaaacgaacttaaaaaccgactcatatatggatgacttaccaaagtaccggcaaaaaaacaacttcaattttttataatagtagagatata

SEQ ID NO: 42628 - DNA, 232 bp, Oryza sativa
ctgaaattcagagttacaaaagcagtttcagaggccaaaccaaaattgtactgacacaatcaatcccaaaactgaacgtgcaaatactcctctgaaacaaattatgaactgatgacatgttcttcgattttcagtaaaactgaacactggaaaaacatgtacaagaaagaaagggagtagaatctcactgggatctctgacgcttgtctgaacagcgtatcctttctccagg

SEQ ID NO: 42629 - DNA, 1501 bp, Oryza sativa
  unsure (1)..(1501): unsure at all n locations
agctcatttctgaattccccaagaccgnnnnnnnnnnnnnnnnnnnnnnnnntggtgcttgcatggtccataaggatagcgatcttgcacaaattgcacccccagaaaacagcggctactatgttctgctctctaatttacttgtagtcaagaagcaaatctctgaagcagcggcaaaaggcaggaagctggttaaactaatcgagatagttgacaagccaaacttcctcatggccggcgactgtgcccatccacagtgtgaggccatacttggaaaatcttaacttcaaagacgatttgacgctaggtatcgacctgagacagagctagcattgtacgatgttgaggaggaagagaaggagcatatgtttgaaagtgcacagtgaaaagctggcaattgccttcggatttctcagcacagaaccgagatctgaaatcaggataatcaagaatcttagggtgtgcctggagtgccacaacgccacccaagttcatatccaaggtgacacagagactgattctggttagggaatagggatgcttcacggttttcatcatttcagagatgagtttgctcctctggagagattactggtgtgattcacctgaaatgcctcgggtgtctaagcatatggtgattcaggcctccactgccgcattgccgcgatggcttcgtcccccatctctccctagaaaactatttaaaaaaataaaaattgtagataattttagaaaatgtagaggaaaatcagaaaaatgtaaaagaatatgaatcatgtagaaagttttggcatgatatttgctatattatggacattgaacaaagtagaaatccatttccccctcaagtgagcctaatggacttaatgaacagtgctcactattggcctagcctttttgtttttttttctattttaagtttcaatttcggcttgtctgcaaaatatggtgttagattttatttttcacaaactagtactataaattaggtactacctatatgatctttttttccattttttacaattttgaatttgtccaaactaaatgaatttatggatagatgatagctcttaatttgttgatggatgacataaattgaagggaaacaaccacctctattatagaagcttcttaggcccaacatttaaggcccagccgcccagctggcccaacgcaccaaaccaatcggaatattccattcactcaccgcacgacctataaaaccaatagcgacgtgccacgttagcccatccacgtcgccccccctcccactctgccctcgccgacacgtgggcccaacatagtaaccggtcccacgagccagggaaagaccagaaccagctcttcctcctttttaatccacccaccgttcccactcctccgctccttcctcccctctcccgattccccaattcggaggccaagcctgcaccggcaagcggcggcggcggcggcgacgaggcgagagggttcccttccgcggagccggcggagatgg

SEQ ID NO: 42630 - DNA, 1501 bp, Oryza sativa
agggaagtaacttgcaagtttctaggtggtaactcattgaattgttacaagtaactttccgttaaaaatgcactgagacggttagaattgctatgagaagtaacctaatacatagtgagaagtaacttaatgcacagtgagaagtaacttaatgtttctaggaagtaactcattgaagtgttagaagtaactttctattaaaaatgcactgagacttctgtaaaattgctatgagatttccaacaccagcgctcatgcctatgtaactagggaatgcaaattcaagtttattttgggaagtaaattaacttttctgttcaaattgcactgagagacaactagatgagatgttttcatgttgtttaaactagggattgtgaattcaagtttatctggaagtaagtagcatgttcctagaaattgctttgagatttttgaaacaccagtactcatgccttttctacaacttattttctcagcagcactagaaagtgaatttagggtataaaggaagatagaaatcaaaaaggatattacttacaaaattacagcacagattcatatcaattcatttctcgaagaatacagaaaagatctaaaagtttctaggttagttccttttttttgtggatggatctcaaagaagacataatttaaacttcatgtgtactttacctggatattttcttggatttgcttctcctccgtccccacttccaagatagcgatttttttctgatttttaccgccgtggcgactgtgtggggattgatgtcgccggatgtcccgatttgatgggttggagtgggggagagaggcgcatcgtgctgtcttaggtggggcccacgccagctagcgacgtgtgcgtcgcacggcgcttgcgcgcgcaagcgcgcgctttcccttccatttttagcgatggcgcacgcgggggcccaggaaaaagtggtttccatttttggcatggggcgcgcgcggcgcggaatcgccagttgcgcacgtcgcgtgatagccctatcgcgataccggtctcggtgtagtcgcatcccggtttttacggtgtttggttttctcatcggtcttcattttagcgcagttcggtgttcggtgtctaaatcggttcatttagaaagaaaaccgcatgtactgaaaacaccgaactagagcctccacttcctcacctcaacccatgacccaacaacaacatggaacccagcttcatctcatcttacccaatatttactcccatccaaacacaccgcatcggcctttctattgatgctaaccctagccgcaagacaccgccacccccatgagcaaagcgccgcgctcaatatcggtataaaccgtagaccgaaaaaaccgcaccaagttacatcagtttttgtagcttggtttttgttttgaaaaaaagaattttggcttgtagttttaggaaaccgaacttttaaaacaccgaataaaccgaaccgataagaccgaagtaaccgaatgcccaccc

SEQ ID NO: 42631 - DNA, 1501 bp, Oryza sativa
cccatgccaaaaatggaaaccactttttcctgggcccccgcgtgcgccatcgctaaaaatggaagggaaagcgcgcgcttgcgcgcgcaagcgccgtgcgacgcacacgtcgctagctggcgtgggccccacctaagacagcacgatgcgcctctctcccccactccaacccatcaaatcgggacatccggcgacatcaatccccacacagtcgccacggcggtaaaaatcagaaaaaaatcgctatcttggaagtggggacggaggagaagcaaatccaagaaaatatccaggtaaagtacacatgaagtttaaattatgtcttctttgagatccatccacaaaaaaaaggaactaacctagaaacttttagatcttttctgtattcttcgagaaatgaattgatatgaatctgtgctgtaattttgtaagtaatatcctttttgatttctatcttcctttataccctaaattcactttctagtgctgctgagaaaataagttgtagaaaaggcatgagtactggtgtttcaaaaatctcaaagcaatttctaggaacatgctacttacttccagataaacttgaattcacaatccctagtttaaacaacatgaaaacatctcatctagttgtctctcagtgcaatttgaacagaaaagttaatttacttcccaaaataaacttgaatttgcattccctagttacataggcatgagcgctggtgttggaaatctcatagcaattttacagaagtctcagtgcatttttaatagaaagttacttctaacacttcaatgagttacttcctagaaacattaagttacttctcactgtgcattaagttacttctcactatgtattaggttacttctcatagcaattctaaccgtctcagtgcatttttaacggaaagttacttgtaacaattcaatgagttaccacctagaaacttgcaagttacttccctataaacttgaatttacatttcctagttacacattttgtaccttgtttctatatacagcataatgcatcacctagttgcgtctcaatttcattttgtactgcatcaaaacaaattgtgaaaaaaaaatcattagtatagccactggtcttaatttgagaaaattgcttcctagaaagcatctaaaaaaacagaaacatttgtatcggttatttaattacatcgagtccagttataaagagttactatcctgttgcatgtaacttacttccaaactgtactggcttacttcaaaacatataaatgttactccctctaaaacatgcaagtaattttctataccacagatgaaattgtctgacaaagttactctgaaaacataaaagctttactttcatgtgatgtgtaagttacttctccccccccaattactaaattacctcaatgaatgctctgtataaactttgttactaatagcctgaaacacatgcagcaaaaatggattttgacctcaacagtatcccagaattagtttc

SEQ ID NO: 42632 - DNA, 519 bp, Oryza sativa
tatgttcgatggggcaattttatgcgcatcattttccatgcaacaagtttatgcattaagctatggtttagtcagtcgcattagtgtctttatccgggttcatgaaaaatgttctatgcataaaaatcatcatgctcggcgagttacttagtcatttgttgctttatttaatttggttttgagcatgtgttggttcctatccctctgtactctttagatgtcagacctgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagccttaattaggaattgtgtgcctctttttcagtgttttaatccagattaagataatggcacttaatttcataagaaaaattagtttccgagccatccgttttcttcctttctcttatttctacctatcccctccagatgg

SEQ ID NO: 42633 - DNA, 1312 bp, Oryza sativa
ctgcagccccactggacaataacacatgtgaattggcattaattgttctgtctgctgatatcaaggacaattcgaagagaatttttcctgccagaataggagtatataaaatttacaaaaatctcttactttttagtgtactattattatcattgcaacaccttatgtttttttttccacatggtgcagggatatttgttggatttgcagttggacaggaatgagcttaagaaacacttcgatcaaacgagagcgaaccgtcttgaccataaagaattagtaagaaaatatatattccagctgtcaatgacatgtaaagttacttattcctgtttgcttgtagaagaattagtaagaaaatatatattcctgatgtcaatgacatgtaaagttacttttcctgtctgcttgtagaagtaacttaaatgtctctgcaaattaactcagcatgtttgtggaagtaactttttctgttatattgacagaaaatgttattctgaaacactttttattatccttttatacttactaaattatgattatatttacagaaaaaccttttttccactcctctccctcttttcacttgaatgcagacaatttttcccattctctaggaattgggtaatgggaatgataaggatggtcactatttcgtggtgtgccttaatctgaaagctgaaagattcgaggtttacgattcgctgaggggagaagatgacgaagagctgatttcagcatctaatcttgttgttgtatccatcaagaccatgtaggataggttttacatgaggtcttcaaagaaaatcatccagaattacccactgatttttattgatggcccaaagcaagataacatgtacgtaacatgcttttttttagttagtgattttcatttattgtttttactcaaacttatccctttttgtttttgcaaacaaaaacagccgggattgtggtttttatatgccgaaatttgtggagttgtgggatggcaaacagttgctagcatttgaaccaagtgacatccccaacattaagaaactacttacacacaagatgctctcatttcaagaaaatcgtgtgcaatggatgcaagtattatggggcaaagagcttgatcctacacttaaggtaaggtaatgaaacactgcattttttttcctgaaccagcacataaattatagccacataaattaggttgggtaacaaattaaaatagcatcttggttctgcaaagaactcagcatggtcttcctgagaacttacatatcactgtgaagtaactactatggaagctaaaagtaattta

SEQ ID NO: 42634 - DNA, 181 bp, Oryza sativa
ctgcagccccactggacaataacacatgtgaattggcattaattgttctgtctgctgatatcaaggacaattcgaagagaatttttcctgccagaataggagtatataaaatttacaaaaatctcttactttttagtgtactattattatcattgcaacaccttatgtttttttttccaca

SEQ ID NO: 42635 - DNA, 345 bp, Oryza sativa
tgctattgtacctgctctaagccagctataaacatatgttaaaaagataaaacaaaagagataagagcaacatgctacagatctatagtcaggtgaaaccagatattaatactagtataataaacaactattgtataaattagctattacattagttatagatgatttggagataataattgactatactagtattaaacttgttattaacgccagcttcgtattctctcctgcctcgccacgcctcgctgccgccttaattacctcacctacgcggctcgctcggcgtcatcgccgccgccgtccgccgcggcgccgctacggtagccgtaggccgcgcaggaa

SEQ ID NO: 42636 - DNA, 1391 bp, Oryza sativa
accccccttattggggagagtggtgttctctcctattctctttacaatatatatgttaatgaatctagacacacattaacatatatatatcaatgtgggcaatgctagaaaatcttataacctaaaacggaggcagtaatatatttgttcagaaataacgaaatgctctattctcattcatcaaaagttgcaagtaacgattgtggttacgctgttatacccaaattaattaataatggactaaaaagctatggttatcctttaaaatgatttagtagagcgtgtacacatagatggtaacattatctgcaaacgatatatgtaactcgttttccctaaataaataattttaattaagtacaaagacatagaattaaaatttttatgcaattaagcaagagatctgctggttgcctgggcatataaaaggctaaaacaggttagtgcatactgtgttggagtcatgattgtcaatacacatagaaaggagattcatggactgaattgcttgctccaagtatagacaagcatatgaatcagctccattttagaccagaaaatagtgcactatgcatctcgaaacatatgaaagcccctcattcttttttttttccgggttgaaagcctctcattcttcattgttaagataatgttgtgctgcttttatactgaataaggtgtgtagatcaacgtcagcttacagttgaataggacttagcaaattggtaaatgatccaagttaatgagctagttttgcaatttgcagtacattcagttattcagacgatcgcacccgaacttgcagccatatatagtacgccaaaagaaaatccgaatctcattctgttggacatacctggtccaaatcgaatttctagaaactaatctagacagcaatgagcatttgtttcttttgcaaggacccatgaacaacttacagaaagggcatatcaaacattaaagtatcaaagtaagattaatactattgttttagactaatagagctttgatagccacccatcaagaggtacaaggcaatctatgaattaagaagacctaaattataaaacaagaaacacatatatattacatccaaatcaaggtctccaaaatactgctacgtacttatttgcaaatgcatatccacatgggaaaaaaaaacgtgaacagtgatttgacaaactgatatttgcactaagttaagatagacaaggttcggcaaaaccctgatcaatctagtttgtgaaattaatctgaattatttctctaaaaaaattaatctgaattctgaagctctttatacaaggagcagatcatgatgatatatgccatagacaaatcactacttgcagtgcttctcccctacttacatactcatttactcacacaga

SEQ ID NO: 42637 - DNA, 1501 bp, Oryza sativa
tatacctattttcattatggtaaatagtcatagcctaggctattagatttattcattaccataatttttataatacttggtgggtaatctttagagttttatattcggatgcctgtccagtgtgttcattcgtgaaccttttagagtgtaaaccactcggattctttttattatggctaaaaagcagtcggctagaatgcctctttaggcgccgcgtatgcttttgccatctgatgcatgattgtgctattattttgttctcaactatatgtttagtttgttaactaatcacatagttgggggctacacctaattaggtgcatctattcgatgcaccacgttctttatcttttcgccctttacagtcttcgtcttcgctactcggcaggccttggcatgataagttttgaagcactcggattattatctttgagaaggctatgatggttgactgcaaaggtctcgggggctactgtggagatcatggatatcccatatctacacggcgatgatatttgggctgaatataggataccaaatatacatagaatatcttatttgtatctcgggtttgtttcttaacttgtatatcaaggaaacaccttgagacttagtcggttacgactgtattttatctgtatctgcatattccgttagggatatagattatcttttgtaacacggactccttcccatatataaggggggtccgggtgcctctagcggcggatgttgattttctccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacaccaccggtcgcctagctccgtcaatatgcggctcgacgtttggcggtgtagctgctgctggtgcaagttgccagccaccggagtgtgtgcgcggcgacgccgatacgatggccttcggtgctctccacggaagtccatgagtcgattggcacggtgactccgacgagggcagtgcccataacaatggactggagccttatctcctcctcggcagcgcctccttctccgcacacgcgtcctctcgtcggatgccgaggtgccgcagccgaagtcgccggccgccgccgtcatctggcgccatctccttcgttcctcctcagcatgtgtgtggagattatgggtaccccatacccacacggcatggttatccgactagttatatgggataacttatatctatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggggcatg

SEQ ID NO: 42638 - DNA, 1501 bp, Oryza sativa
cagccatagcggaatcatgttacctgagattacagcagtgcggcacacagtttcatcgctgttgttattttctttggagtgtctagaaattttaatgtctgatatgttttcaccactcccattttcagaaggcaagtttgtcatatgaatcatactgactagagaatggattagttgaatgtataagcttgagtcactgagaatctctatctgcttctgacaatgctctttcgctgcacaaacaagaagagaacatccaccaactttaactttaagcatgttggacccaatgactcgccgtgcaactgatgatatgcagcctgggatttctgaaaccaaaccacccacaatatcatgttgatcagaacagagcctcgataaaacttctatggccttgtcttgcaatgaaggtgctgcatccgctacacatgacacaagaggaagtatggtgtggggattttctgcaagaactgtccatggagctttggtatgcccacttgacacctttggtagttttgataatagcaccagcgcatcaacaacttctgatgttgcggcagcttcaccattcgcagcttccaaaagcccagctagagcaaggacagcacctgaccggttaatagtatctgaaagaggttggttaattggccggcactgtaaaaggcgagctattgctgctgctgcatgagttcttccatcaatagatccctctctaagcacatgtgctatggggaagataatttcttcaaaagatacttgcagagataattcatgatcaagaaaaaggtttgccaaaggtcgcttgttctgctacttctagaactgtagaatttgcaagtgagacaagtggagctaatgcatcccgcccaattgcagcaacatccttattttgcttgattgacagaaaaatggcagcaaggcaagatgaggccgccattagtattttatctgtctgcccatcaatcagcttcatgactgaccaaagtgtcttcactgcaatatgagtttctcgcaagtccctgcgacaatgaaacagtccagcaagagcagatgctgatttagcctgagtttcttctttaggtgagttgagaattttgatcatagtctcaactgcatcatttgcagcacttccttcatgcagaatatcattaaggggtgccacagaaagcaagcttttcaaagcatcaggacatgaacttttgattcaggttgttcactagttaaaagagcagacaactgactaatagttcctgtatctgatttgtgaatgagatgattcagtgttttagatgctatctcctttccgtgtcactttcatttttcagaagccatagtaaagcgggcacagcatcagcactttcaacacatgcccgtatgtcttcactgtggttgcacaaattgccaaggatggttgctgaatcttctttagctttgaatatgtcacatgatgaatgatgaatgagtaaaaccatttgttcaactatagggtagatatgaaaca

SEQ ID NO: 42639 - DNA, 172 bp, Oryza sativa
attaaggttagactagatgggcctttttggctcataatatgctagtatcaatagtctaacatacatcctccggagacccgcgtgtcgcccgcccctttgccctggctcatgatcggggcccggccccaactccccgcgggttgaaatccacacccgcccctgcccccgtagg

SEQ ID NO: 42640 - DNA, 609 bp, Oryza sativa
aaatttgctcaacaagtaaaatgtggaatggttggcctgggttggcttgggacgagctggaacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaattatgcatctccggtgtggcttgctgagtactgtggttgtactcattcttgctcaatccttcccctcttcagtaagagaagctttggagaagatgtctttggtggagtcctggcttataccccagttgagcgcctgtgaagatggagccgtaggccgctagtccgctgctgtttatttttgtttgtcaggccttaagtgcctttgtaataatgtaaatattaccgatataataaagatgtgtcttttatatcatgtttgtatggtgtaccccggcttttcctgggacggggattaatacactagcgttcgggaaaaggcaattttcccggtcgcgacac

SEQ ID NO: 42641 - DNA, 1501 bp, Oryza sativa
caaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgcca

SEQ ID NO: 42642 - DNA, 1501 bp, Oryza sativa
acattttggtggtgatgaataatattatttaataacaggatagctattgaagatgggaaaatgagttttcacgatataagttaattttctaaattattggattgaaatgagaaatcaatccgtataccgaggccaaagacagaaaaattaggcaacttagaaatagcaaaaatcgttttgatactgttataatgagaattcattctatactctcttctgttttatactttatttatgctgcatcagtcttcagaatatcgccttgctttggctatgtgaaccctgtttttttttgtccaatactctatataaacattgatgctttaaccaagaaaatgactgacatattctcttgaattcacacagatgaagtggtttcggttggctgtttgtgagctcatcattggacagtttgtacaagcctgaaaggatcataaatgcagttttgtgcttgaaccagaactggttcttcttgctgcaagtggcaaggagtcactacattatggagtattcgattggatttttgctgaaggttgccattccagtgatggaaaggccttattgatgatggatattgcaccctgattgattttactcaattgttttctgttggtatagaaaccagttaaatctaaaaatattctcacctaataatggctctgtagtctgtccaagtatatataaactagtgcctactaggactatagacgatggatccacttgtcttgaacttgttagtcagctttatgcttgcatcagtatgcagtgtgctattgtttgacagcaacataattaataatggatcataccatattgacaaacaatcatttttggccggtatgtagaattgtagggaagatggtcttacaacttattaatagaagctcacctctcgttcattgggggcatggaagtatgatctcttcaatttcttcaaaccttgttttagctaatcggatcaaactactgtaaaaggtgaaaaagatcatggaaatttaaatctaaccactcaccattgcctacccacatgaatccaattcacttaccgttgcaatcccaaaccttgcaagattttagcttctaaaccggggcccgggataaatcgatcacgtttcacaaacatctagcacaatcataagatttttttttttaaaaagcatatgcgatctaaagaagacaaaataagcaaaggaaaatgtcgtcctcttcaacaccagccaggggtgcgcagaggcatgaaacaagcctcattgggtatgcacgcatgaagaaggttgccaattttccatgcatgcataatgcgttccacattcttcgactacgcttttagccaatctttgaggcaattctcctgctatatattgccccattctttcccatttcaaagctcatcaagcagctcaagcattccacaagcttgccgttttccactgacagctcaagtgctcgtgcaacattagctgatcagctcgtgttcccaaccgcgacaaagcttcacaga

SEQ ID NO: 42643 - DNA, 164 bp, Oryza sativa
aaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgt

SEQ ID NO: 42644 - DNA, 781 bp, Oryza sativa
gtgcccgaaatagcatcttcggcgaggcagcagcctagctgtggacacgggtggctcgacggcgtccgcgactactccgatgatctcccggccagtgctctcttcatcttgacggcgcatgatcccgtatgttgacggcgtgcgcagcgtagaacaccgttttggtcagtggttactcctcaggttggcgagacatggacgaagatgagcttggagaggcatccacgatagatgccatcagcttgttcctccttgtttgcttgctgctgaggtgtgtgcgcgacaccacctgtggagatcatggatatcccatatctacacggcgatgatatttgggctgaatataggataccaaatatacatagaatatcttatttgtatctcgggtttgtttcttaacttgtatatcaaggaaacaccttgagacttagtcggttacgactgtattttatctgtatctgcatattccgttagggatatagattatcttttgtaacacggactccttcccatatataaggggggtccgggtgcctctagcggcggatgttgattttctccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggaagcgtcaagcttttcgccgatcagtgcaa

SEQ ID NO: 42645 - DNA, 1501 bp, Oryza sativa
tgcggtggaggctgcggcggggctctgtgcagcggcggtggaggccggcggggctcggcagcggcgtcgtcgaggcggaggcagtggaggcttgaatgcttgaatttttttatgcttgaatgcttgggggaatagaaatttttgactgtaaatttaaattgtgcttgtgtgaattgaattttttgactgtaatttctgcttgggtgaatggaaatttctgtggatttttgaatggtggagcgtcgacggaggcagacggagcggtgtcgctccgtctattattttttttaaacttggccacgattaacactggcgggtgacacagtgttactcgtattttcgctggctggccagggaaaatgtgtctttgctggcggttgggcttaagacgactgacagcgaaaataaattatcgctggtggccaaaaaccgctagcgaagatagtgattttcattggtttttgttttttggcggctcaaaattctgtcagcgaaaatccaaaatggccgctatgaaagatggttttcgtagcagtggttatactacacactgtaaggcgtgtataaatctgtgaaaggataaaattggcaataaattagatgtcactagagtaaattagtaggtccaatcaaccttaatctaataacgttagcacatatggcccgccctaaacttttgtttgtgtcaaatcgaaggccatgccagttcaggtagacgattcatcgtccgccatggacacttaggccgtgtttacttctttggctaattatttttaaagtataccgacacacatttgaaatattaaacgtagactaataacaaaacaaattatagattccgcctgtaaattacgagacgaatttatcaagcctaattaatctgtcattagcaattgtttaccctagcatcacattgtcaagtcatggtgcaattatgcttataaaattcgtctcgtaatttacatataaattgtgcaattattttttttcgtccacatttaatactctatacatgtgtctaaatatttgatacgatattttttgtcaataatttttgggatctaaatacacccagatctatggatagttgcaagttgggcaatttgtcatttattttatcaatatacacgcgatcttcaggaaggcaaagtggtgcccaccggccaccgtccacttcagcaccatccgggagtgaccatacgcgagaagcatgaaatcggccttgccaagcgctacggaagcgtgaagcgcgccttattagcacgcgccgcttgcagcctcctctgtccagggctccaggtgttctaccggacgcagaatgcatccaacctaagctacccaacacacctgacgacttgctataagtatcccctttacagccactccatagctcatcaagcagttcgaacactccatttggttgtcattttcaactataatccaccacaactcgtgcaacatcagctcactcgtgttcccaaccgcgacaaagcttcacaga

SEQ ID NO: 42646 - DNA, 784 bp, Oryza sativa
gagagagagagggagagggaagtgggccgagccggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtttgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagttcagtgatgcttccgttccagaacttctcatgattcatatcttcggagtcaacctcggacaagttatcaacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctt

SEQ ID NO: 42647 - DNA, 218 bp, Oryza sativa
ttaccggcgttcctctgatctgatcgcctgtcgctaaatgcaacaaccagagatggtatcatatcatcgctgtttcaatttagggcgatgatgcaatcatgcaaggcgttgtttgtaattcattaccgaaagagtcttgcatccacaaactagtcccgtgtgtcccctgtcctgtccaccccttctccactgtgcaccatgtatatttctttttcagg

SEQ ID NO: 42648 - DNA, 1501 bp, Oryza sativa
tcttgtgctgaaaataaatggtgtagcaaaaggtacagatttaaaataggaaaaataatatattttactccctcaaactatttcaccggagcacttagcctcctaaattattttttttggctcattttacatcccgaactactgaaaacgatataccttatcccttacattgtttctctttgtgtaagtcaaattttccactaacgtttttgtaggatgatatatgaattacaactatcgtctcaacatttttataatttttttctcactgtttacataggatgaaaacacctaaaactaattttatcatcaacattttaaagttcaattaaatagtaatgaaaaaaattgatttttttttgaacttagataatggcgtcatctatgattgtaaaaattttcagcttagaatacaacttgtataaagcgtaacataaataaaaatattactattaggtaataaagtaaactattttcaatagtttaggtttaaaatgaggaaaaaaaatagtttaagggttaagtaatcccatgaattagttcgggggagtaaggtggattttctttttatttaaaagtctgacgccaacgatgtcgagtggcgctgagacgacgcggcgctgcagattgccttggtgacacgttatttagctaaccagtgcatgcaatgttgtatagtaaattctctaaaaatatttatatgtcagaagtatgcaaaaagttcccacatattaatgacaaaaggggattatatctttgagctcctttagagcacaagattaaaaaaaactaggaatatgatagagattggtgtgtaaatcagaggattaaaatacagagaaattttatcgaatagaagtatgtgtttggatagagcataggaaaaacatagaattctttgtaagctttcgggcaaaggaaaccgaaaggagagctcggagtggattgttattgtcctgtggaatcagtagcttaggaaatgttctttggttttccgttgttttcccaatgagcaatttttctgatccaaaggacactatagtaacttaattcatagaaatacaaatcctctaattttttattccctttgtttttcctccgatcaaaggaggcagggagctctcccaaaaagaggaatatctataccattaactaacgagggtccatattatatatagaaaatccaatttatttttttcaatgggtaacagtctatcttcactgtgcgtgaaattcgggtagttttaattagagtaaatttcacaaaactattgatacttttactacaaatatttaagatggtatatcaaaaatttagtaacaaagttatagaaaaaatacaaattaatgccaatatagcattagtgcaaagaatttaaaatctaaaaaatatattttgtaaaagctttttatactattttttatgatgctctgttttaaatatgtagcttcgtgataaatttgatgttaaatagtttcatgatgtaccgccttaaatctc

SEQ ID NO: 42649 - DNA, 1501 bp, Oryza sativa
aagggacgctatttcatctgttgctgatgcactttcatgatcctacataacacttctacgtcgagggattgctgtgttgcatctttgtaatctagtgtaggacactgaaaatacatacgattcagaatttcagactagattttggttttatacctgtacggttcattttctgtaaatgatgtatgtcggctacatgcacatctagaacttacacttttacgttcttaaatttgagcacagatgattttcatacaaatgttgaagtgcttcatgtgatggctgaacaaagtttcttttcctacagcatggttcttttaccattcaaaagacaattattccctctttactcatttaattgatttacttgttcttaaactgaacgggaaagagtggacatgctcagtttgttattaacaaaccaaacatactcttaccattgttactctaccaaaatttagtagtttagaagttcttacatataaacactaccaaaatttgataaagggtgagtgtacgcacgtacgtgggtgtctacgtttatattatgtttcgaaaataaaaatgataaggctacaaaaagaacgtatctagcactatcaaatttttgtaaacataaaaccgattttgtaaacatctggcgacaaatttttggcccgaaatcactcggatttgcttcccttggattagtctctgcattatttagttagcggctgtgatgcgtttctttcccacgcacgcatgaggtcagcaacatctagcttggcacagtattgatgagtacacacattgcacgtcgatgcggctaggtgaagagattgaagaaataaaatataaaattacactcctatgacatgcaagtgcactataattttgataaaaaatattgtgtaagtaaatatgtattagttaatttatttaaaatataaaattacagtcctataacttaaaatacatttgtaaatacattcgtaaattcaattgatataacataaattcaattgatataacatgtaagtgtactgtaattttgataaaaatgttgtgtaagcaaatatatatttgttattttcttttgtagtctgttggatgtaaatctaaaggtaaaaaaatctaagttcttttagaaatcacccgcaaaaggataggatttgtcaggcagttccacgtaaaaatgtactgaaatttgacaatacccattaccggtatggttgatttgaggcccaaaggaaaccgaaccgatgcagcagtggaggcccatgatatgagaacccggaagcaacaacctgcagttgcaagccccatccatcatcaccattcaccaaccagcgcgtctccatgggcttagggttttagcttctgtagcagcagcgtggcaaaggttttcgcggcagccggcatcaccaatggcttagcagcaatcaagctctcaccactccggcgtcgctcgtaatccatctgctttaccccatggccgacccagaggacgccgccgccgccgccg

SEQ ID NO: 42650 - DNA, 1315 bp, Oryza sativa
ttgcgtgggcagcacttcggtcattacgccggcgctcgatgctggtgcgggcgtcctgctccccacgcagatcttcccgggtcgaagaagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtgaagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcctgtaatggttaggatgaagcctggcatatatctgatcagggctaacg

SEQ ID NO: 42651 - DNA, 1501 bp, Oryza sativa
cctcgttgagcacgatatggaggtcatcctcgctctcctcgtcgctgctgatgtagcccgcagtcccgtcgcccaagtccaccgcctcgttcgcgtcggcctccgtgtggtgggctcccggcgcctcggcctcggcctcgccgtcggtggccgggttggagcctccgctctccccggcggcggcaagcgcggccgccacctggtcgtcgaggtccgcgtagaggtcctccacgtcgtcttcattcccggcggcggcggcggcggcggcgtcctctgggtcggccatggggtaaagcagatggattacgagcgacgccggagtggtgagagcttgattgctgctaagccattggtgatgccggctgccgcgaaaacctttgccacgctgctgctacagaagctaaaaccctaagcccatggagacgcgctggttggtgaatggtgatgatggatggggcttgcaactgcaggttgttgcttccgggttctcatatcatgggcctccactgctgcatcggttcggtttcctttgggcctcaaatcaaccataccggtaatgggtattgtcaaatttcagtacatttttacgtggaactgcctgacaaatcctatccttttgcgggtgatttctaaaagaacttagatttttttacctttagatttacatccaacagactacaaaagaaaataacaaatatatatttgcttacacaacatttttatcaaaattacagtacacttacatgttatatcaattgaatttatgttatatcaattgaatttacgaatgtatttacaaatgtattttaagttataggactgtaattttatattttaaataaattaactaatacatatttacttacacaatattttttatcaaaattatagtgcacttgcatgtcataggagtgtaattttatattttatttcttcaatctcttcacctagccgcatcgacgtgcaatgtgtgtactcatcaatactgtgccaagctagatgttgctgacctcatgcgtgcgtgggaaagaaacgcatcacagccgctaactaaataatgcagagactaatccaagggaagcaaatccgagtgatttcgggccaaaaatttgtcgccagatgtttacaaaatcggttttatgtttacaaaaatttgatagtgctagatacgttctttttgtagccttatcatttttattttcgaaacataatataaacgtagacacccacgtacgtgcgtacactcaccctttatcaaattttggtagtgtttatatgtaagaacttctaaactactaaattttggtagagtaacaatggtaagagtatgtttggtttgttaataacaaactgagcatgtccactctttcccgttcagtttaagaacaagtaaatcaattaaatgagtaaagagggaataattgtcttttgaatggtaaaagaaccatgctgtaggaaaagaaactttgttcagccatcacatgaagcacttcaacatttg

SEQ ID NO: 42652 - DNA, 187 bp, Oryza sativa
cgaacttatttgtgcataaaatcctcgtccaggaatcagccgaggtacacaaattgacaatttaatatacagattcatcaaattaactaaaacgataaatcttacttaagaggcactcagtcctcaccaagaagaaaattacagcggaaaataaaatctagcgaagctccggctccactcccacagg

SEQ ID NO: 42653 - DNA, 1501 bp, Oryza sativa
gaaggttctctgaaaaaaatattagaagattaatatttttttaaaaaaaggagtgattgtaataaaaaaaagttacagaaaatcgtaaacttacaaagcttgctctcaataatccataatactcttgatgtccacaaatattaggtggaaggatccaactcctaaatgctagaagtagaatttgaagttaagtagtggcctattgacggtctttgtgttcactccacccctcatttttctaggtcactatagtctgctccactctcttttttatagagcagaaaaaactttgttgagctttagctacagaaaagctggaaggtcctgccaaattgagcactgcgtgtcgtatcactcacctcttgatttaattttcttcatgtcttacttctaaccattctgtcatttttcaactatattttatttaataaatggcattatagttttttcactccatacttatctctctaagaaaaagattgggaatattttatattagtggaggaagtacacttggttcataagatacgatggtaactggaaactgaaaaaaggaggaattgaaatggtcaattgacttggtgctacacggtgatacgatagctgaggaccctgttgctcatattttttattggatttccctttttttttttaataattctgagttttcttctatcggatatttgaatgcctctaggagtgatgttgttgcaaaggactataatctagatgtataagtctatggatctagatactttaactagacttatcttaaattatgatttatatttgagtggttctagaaagtctctatgtttattgcgaagtgatgtacagttagaagcttctggaagctgatttttttttttaccgggtgggaacagctagatgttctggatgctgtgttgttaaggtacaactttttcttaaaagaaactgctaaggtactacttgcttttagaattatcacataacactgtagttttctattttgcttgatcttctgtatttttttccttagacaaaattcatgatttatttgataagctaggggcgccacgtggcccaatcaaaagctggcataaccactggctttagattaatagatagattaaacgtagactaatgacaaaactcattacataaccctggactaattcgtgagatgaatctattgagcctaattaatccatgattagtctatgtgatgctatagtaaacatgtgctaattatgaattgattaggcttaaaaaatgtctcgtgaattaactctcatttatgcaattagtcttgtaattattctatgtttaatactctaaattagcatccaaatatccaatgtgacatggaataaagtttactccctgaatacaaacatacctttgcatctaaataacaaagatttcttattggtgacaactgacaagcatatcctatcagatgaacgtcagtgacagtgactgtactcttgtactcttacaaccgccgtcttcattccag

SEQ ID NO: 42654 - DNA, 1501 bp, Oryza sativa
agctgttgatgttttgattttttttttttgaactctgaaaatttgcattttacagctgagaagttcagggaacttgtcgggaaggaggaagcatcaaagagtggccagtttacgttcatgaactgttttgatatgggctcaggcagccttgcgtgcgcagtgaaggagggcatcaagttgtatgtctacaacctccaaactgcacatacggaaagggtgaggcaccgggccattgagaaagcattggctgatgctgtgacagaaggcctgtctgccgctgaggcagcaaagcaagctcagaaggttggtgcgaaagccgcaaaagtggcagctcgtcaagccaagaggatattggggccgataatttcttctggttgggacttctttgaagccatgtacttcggtggaagcatgactgaaggttttctccgaggtaccggcaccctatttggaacctatgtaggtgggttccatggtgaggagaggctggggaggtttggttatcttacaggaagccatctgggcagttgggttggtggaagaattggattgatgatttacgatgtcataaatggcttgaagtatatgcttcagtttgtcaagccagagtatgaagcatcagcatattattcaaaagagagtacagagtatgcatatagttatagaagtggggaaagagaggagccaacatattatgagacatcagaagagaatcaggaggaatcgcaggggttcagtttgttctgagactgcaaactttgatactagcatagcatgtctccttttgagtaacacgtttaggtttttttttggtatttttaagtgaggatatgattcttctatgtaattcttgtttcagccactgtatataaaaacccttgcggtcctgccaaatggtaaaaagatagcagtgatgttgaacgtctacagaataacatagggatgtatatcatattcagatatgttttagggagcatatgtctccaacgtttgtttcctgtttatgtattcctgttccacttcaaagatagtttccaatttgacaaagttgagcaaatgccaagcatttcagttactgaagattttttttttgacttctcagttactgaagattttgattagagcagcagaattgtgactttctgagctccagtcctcactcctcagctggttccattttttttaccatcaatatgaagttttaggcctgtttgaaactttatattggagtagtatatttgcagcacacaaaacacaaaacatggtgattcattagcgcatggttaattataaattaattgttataaatatgcaaaattaaacacttgtatacatttttcttttacacaaaatgtatcagaaaacatgctaatgaaaaacgaggaagttatagtttgcagttgaagtttagatctcagccttctagactcgtttagatttcagataatctgacaagatattgttctactatatggcagggacagggacggataaaaactgt

SEQ ID NO: 42655 - DNA, 1501 bp, Oryza sativa
cagtaaaaaaaaaaaaactgcacttaaaaaaactgatgattgaaattctgttctacataccagtacagcatcgcaggtttatctggcctccagtagattgaacgctttcccttgcggacactgcttgttgctattggaatgtcctcagcaaggggcaaatcacaaagttccctaatgaattctccatctacagtccataattcaactttcttcggaaaccttccacaaggtacaatataggaatatggacggtgaatagaagaaatcattaagtatttgtcatctggtgatgggtcaatagatgtatatacagcaggagggccaattggctttactgttccatcaaaagaggccaatacaagctgcgaggtcgcataataatcaaacagatcggcatcatattcatctttcaaaagatcctggaaagttctcacttggaccacatttgatgtctcattggactgaattttcggaccagatggaactgagggcttctgcggtggagctccacgtgacagagggatagtgcagacaagcaaagtagaattgttaacccatacaaagctgcaacagcaaaacaaaagttctttagaagtaggacaggagaaaacagcagaaattgatattcaatttcacctgtcaaaaatagcatttaagtatatctcaggagatttaaaaagtggtcttgcttctccagattccacatctgcaatccacaaacgtagcttgccgcttgtgttgtcctcctaattgaatccacactagagttcattatatctaatcatttgaacaaatcacatccatttttcaaaggcagccaaccaattacctcatcaactctaacgctgaatgataaatggcgtccgtcttgtgacctaggtcaaatggttcagtgcatagagttaggaataaagtaatccataatacaagtaaaaatcatttctgaaacagctaaaactggaagcaaggcaattaagaaccagaaaaaaaaatccttgaagttccttgatggaaggtccagaaaattaccaggtgacaaaattaatccttgcgccttcaggatatccatggaccactttctctggacccaaagtcccatcatccatcagcttatggatacctattccagtgtagaaagacctacaaattatgtatatcagatttccaatcataacatgtcttggacatagtactaaacttgtcacagataaaaacgattagttagacaatgaaaatttacccaaattatttattgtacttacattctgcttctagtattagaatagccatcaattctcacaccagcaagtttctcttcaggctttgcgagatccgacaatggtggcagtgctcggcgcttcaggaataaaatcttgtccttgcttggcgagaatgatagcacgggtagcggtggtgcatcaacgatgtcttgtatttcttttggaggaaggcggtagcccatcatcgctgatgaaaggtctgcagagcaattaaatgcatc

SEQ ID NO: 42656 - DNA, 189 bp, Oryza sativa
cttttttttttcatgtagtacaactcatttaggactaattaatcctcctctgagcaccattagcttcacgtactgacagtcttaaaccacacttccaaagttactagagcagttactgtacgtagtactccgtaccgtgggggcagtttactgtgctccgctgaacacaattatcagtagtacaagaga

SEQ ID NO: 42657 - DNA, 1501 bp, Oryza sativa
ttggttggcagggctcccaacttagcttcttaacaagacttcaccattaaaaattgatatataacacatggatttagtatttaaactatgaaaaagaagaacttgatatatgatgaaatgtctgcaaagtgtgcaccataatatcataacacacgtacaccgcggtcggccacaatatacaagggtaggcaagatacacctaacaatcataattggttcagctgatagacaattttaagaatataactgaatatattggcagttggcatccccagttcgtcacagtggtaatattctaaccttcaataccaagattatatacttgtactgcttgttcaatgttccacccatccttcctatcttaattacattgaatgacctccttcggtcattccagcaaaaacatccgtacgcattaataattaaataattataccaatttagtaccaatttcaaccaaatttacgccttcctaaattatggccaaaagaattatgaaaacaaggactacattggcagagcatctttttaataggcactcaaagttcgggctgaggactctatcctagctggaccaaatgaactaggctcgacctaagggcacgataattattagtttttgtttacctctaattcgaaattaatacaggtaccaatcattttcagttgactaccttattctgcaatctccacaactacaatgacgtcattagttttgcaaacgagacggtaagaaaaccatatcatttggagtgcctcctaaagctatggccttcactcttcgaagcaattaccaatcgcccaaaagcccatcactaaaattctctccactcaaaaaaatcaaccaaacaacacccaatcctgcttgacaagaacagcgccctccttgtcccacccaacaacaatacgcgaattacaggatgaaacgaaaaaagcagacatggaaattgcacatcaggacgtccccaatcgacgattaacctactctccacgaggccgtacaaatccacagatcaagaacgggaactaaccggtcatgctgagcgcgaggacgcccacgatgaacagcagcagctggacgcgtcgcttctggatgtccagcatcttcgccctcctcctacgccccttgcctcagacgctgcggagatcgattgccctcgcggatcgcatccaccggaggaggaggaggaggagggaggaagggaaaaaagaaagaataaataaaaaagaatggtcgcagcgtcaactccgcggttgccgcgtgttactctagaaacgaagaagacgatgcgcgtccagctcactggcacgtggggtcgtgggccccagatgtaggaaaagcttggaggactgcgacgtcacggggctaaaagctcgagggcctaagtgaaaaaacttcggggtattgagctgatcagctgaacagaactgcccccaagacttgtggagttgtagcgaagctgcaagagtgacgcggcggcggcgatggacggcggcgggg

SEQ ID NO: 42658 - DNA, 1501 bp, Oryza sativa
aaacaagtatttataatcttctttattccctacacacactttctctctcatcatcttccatcacattttctagagggaaaaatatgtaaaaaaaatagctccaaatgtagatgctaagcaaaagaaagagtaggatgaagttgctaaccttttgaagacctcaaatttgtatattaccaccaaaaatatttgcttaaaattttggcagcacctccctccctcaaagcttaattttgaagcaatggctcgggctggaggaggaagaaggggtatataaagctgtgcaactttagtcccggttgataacaccaaccgggcataaagatctcaaatcactttagttccggtttgtattaccaaccggaactaaagatatgatctttagtcccggttggtaacacgaaccgggactaaagatcccaagccccctgacagaggtctgacatgccctgtcaggaggcgaaccgggactaaagatcccttcgtcccgttaaagtaataaaccgggactaataagccactttagtcccggttcgttttggaaccgggactattgtggaaatcggccgaccctccaaagacctcttctccagtagtgttggtttggtgccaaaatcgaccacaccaagttgctaaattttggaaaagtggataggtatgccaaggtatattttggtctaattaatgacttgcctcactttagagtggtgtacacacctcatgttaagggtgtgtttagttcacgctaaattgaatgtttggttgaaattgaaacgatatgacggaaaagttggaagtttatgtgtgtatgaaagtttcgatgtgatagaaaagttggaagtttggagaaaaattttggaactaacctcggcctaaatgttagtgttgtcagagctaccaaattttgcatagttggcatgtctagggtgtgctttatttttttctttggcaaaatttggtaaggtgacacaaacttaggctagctaagctcaacaagtttccttaaatggaatctatccatccgaattcaaatacccagtaaagtcataattcacagtaaaccatgtagatcatacaaaacccaatgtattttctttgaataaggtaaatcaatagtttgttatgtgtttttgttaggaccaactgattgtcctcgatcttagggtgttttttgcaaaagaaaaaaaatataggaaagttatcggttttgaaaaatcatattaatctatttttcattttttagctaatgcttaattaatcatgtgcttattcacaataataccattgtacgtggcaggggaaggaaaggttcccaaccctgtgtgctgaacacaacctatggcacgctatctatttgatattgatatgaaaatgaatagcttaaattccctataaatttttaacagatcaagttaagtgatcgaaattggtgtacaactataaagatccctttgaattgtccaatatttttaaaataatatataataataatattattatt

SEQ ID NO: 42659 - DNA, 1501 bp, Oryza sativa
ttagctaaaaaatgaaaaatagattaatatgatttttcaaaaccgataactttcctatattttttttcttttgcaaaaaacaccctaagatcgaggacaatcagttggtcctaacaaaaacacataacaaactattgatttaccttattcaaagaaaatacattgggttttgtatgatctacatggtttactgtgaattatgactttactgggtatttgaattcggatggatagattccatttaaggaaacttgttgagcttagctagcctaagtttgtgtcaccttaccaaattttgccaaagaaaaaaataaagcacaccctagacatgccaactatgcaaaatttggtagctctgacaacactaacatttaggccgaggttagttccaaaatttttctccaaacttccaacttttctatcacatcgaaactttcatacacacataaacttccaacttttccgtcatatcgtttcaatttcaaccaaacattcaatttagcgtgaactaaacacacccttaacatgaggtgtgtacaccactctaaagtgaggcaagtcattaattagaccaaaatataccttggcatacctatccacttttccaaaatttagcaacttggtgtggtcgattttggcaccaaaccaacactactggagaagaggtctttggagggtcggccgatttccacaatagtcccggttccaaaacgaaccgggactaaagtggcttattagtcccggtttattactttaacgggacgaagggatctttagtcccggttcgcctcctgacagggcatgtcagacctctgtcagggggcttgggatctttagtcccggttcgtgttaccaaccgggactaaagatcatatctttagttccggttggtaatacaaaccggaactaaagtgatttgagatctttatgcccggttggtgttatcaaccgggactaaagttgcacagctttatataccccttcttcctcctccagcccgagccattgcttcaaaattaagctttgagggagggaggtgctgccaaaattttaagcaaatatttttggtggtaatatacaaatttgaggtcttcaaaaggttagcaacttcatcctactctttcttttgcttagcatctacatttggagctattttttttacatatttttccctctagaaaatgtgatggaagatgatgagagagaaagtgtgtgtagggaataaagaagattataaatacttgtttgactaattacatataattttgtatgaaattataaaactaagctaatttaatattaaaataagaaaaacatattaaatatttgtttataatgtaattaaaacatgaaaaatatgtacaatgaatttaataataatgattaattgtatgaataattatattcaattattgtattattatgtaattaccttttaaatcttggattttgtataattacgatttatatgtatttcatatagatggatcggcaacggatg

SEQ ID NO: 42660 - DNA, 1501 bp, Oryza sativa
tcacaaccgaatattcaggttggagcaaacgcagtggccacctgtcctaacattgctacgtcggagagagagagagagagagagagagagtgaaaaatgacaaataagtgctagattagccgttaattgattcgtcatactccttggatcttttgccctgggctgcttcccagaagctagagcgaccaatcggggctaacttcaccgcgacgaagtcatcgatcgatcggcacaggaggaaacgcgttctgaattctgaatttatttttctgaatatgccagcgctgtctgtctctttctgaaactctgcaatcttcatcctgctgaaagcatgcgtgctgacgctgctggttaagctgcgcagctgccggctcgcttctggtcagacaacaaaagaagaagagagtgtcaatgtggcaatgcttcccttaatacgtctttgctgccattgctggagttaattactaacctatgtgcatgatgccttgtccgtttgtggatcgaaaaaagaatatctcagagcagccgtgaaaacacatcataaggggaggaaaacgaagcccctctcttgttgtgttatggaaatttcactcgaatcttctttctcatctctggaaatttcagatctgcgcggtaaaatcaataaaaccttcatttcacttaaccaaccgagttgattagagcaaaagatgaactttttttttccaaaagatactagtcggtgcacacgtaattgaactatattagacagtactagctccagtactagtcaatgcacatatataagtattcattgatcatcccctctcccccacacaatcttgtgtatccgcaaaaccacaatcaacttcgcaaacctaagcaccactactactcttctgcttccccattcctccctccctttcgatctgttcgtcctcctagctctagctagcctctttggtcaggttatagattacatagcaccatgaattattctcctcccggttggctcgatcgattcagctagctgagcttctcgatcgatcaaccgatcttggttgcttcttcttcgatcctttcactccgtgtagttcttgatttgaaggatcgacgacgaactccctgtggcttcttgttcgccgggttcagccgcatccatgtcgatcacggaggctagcctccacttctgctacctccactcgctctccgtcgtgttcctctacttcttctacgtgatttcctgattcgcctcatccgcttcctctccaaacctgatcaaacaaagcttcgtgcacgatccatcttcgctgaaactaaggaccaaaaactgaagctttgtttgatccaaaaaaatatatattctactaaatgtgttctagcttgttcctttcctagtatcgccttgttcctgcacgcgattgcccaacttggagcacgaaatatttctgcctagtacgtgttcgatcggtgttccacggtgagtgttagtttctctttgtgctctgtgatacattcaaga

SEQ ID NO: 42661 - DNA, 937 bp, Oryza sativa
agattaccgggtataaatatccactgcatcggcttccccgcgccacacttagacttctccacgatcgatcttcttcctcccgcgccattaccgccccagacgtcaccgccgcctccgccgtcatcatcgtcatgctcgccgcgctcatccgcccttgcgaacgccaccggcagcgttgccttcctcaaggtgaggggcgcaaatcttacgcctccgatctcgcactctctctctctctcgatcgatcttgacacgcgccggccgaccgaacctcgccgccatcgtcgtcgccgactccaccgccggccgccgccgccgccgcgcgccaacaccactgccgccacgcgccgactccacctccaccgccgccgccgccgccgcgcgccgactccacttccaccgccgccgcgcgccacctccacctccaccgccaccgccgccgctgcgcgccgactccacctccgccgctgccgcgcgccgactccaccgccgccgccgccgcgcgccgactttacggtggaacgtttgaacgagaacgttttagcgaacgacgacttagcgacttagcgacttagcgagaacgacgtcttagcgacttagcgacttaacgactttcacgaacgacgacttagcgactaaacgactttcacgaacgacgacttagcgactttgacaggcaacgacttagcgacttagcgactttcacgaatgacgacttagtgactttcacgaacgacgacttagcgacttagcgactttcacgaacgacgacttagcgactttgacggacaacgacttagcgacttagcgagaacgacgacttagcgacttaacgacttaacgagaacaacgacttagcgaattatacatgtatacttgtagggtttagatgtatgagctatacatgttgatgtccatgacctcaccgtcttttttt

SEQ ID NO: 42662 - DNA, 1501 bp, Oryza sativa
tcctcctccccggcgtggcgctcccaatgccggcgccgcctctcggcacccctagagccctgaggagcggcgacgacctcacctcggcacccgccgccgccacaacccttgccgcgggcgccgtctcggcggccagacgcggcgggaggaacccggcggtggtggcggccgcggcgcgcagcattgcggcggtgccgcccgatagcttcggggcggccgcggcggtttcgtcgacgagaaacctttttgccggccgttgatctctgtatccgcgcgcgggttgatttcttcagattgtttagagcgatttgacagttttttctagcaaattactgtgctccaaattatgcatttgagttatatatatatacactagtgtgattctggatgtagtctcttgtgaaattggatttctcggaagattaccgagaacttgaaatggtccaacaaagccttttttttgtcatttggacaaagtaagggatagcttcgttcaaaaagaaaaataaaaatcacaaagaaagaaagggatagatgcaaaagagaagcacgaggcaaaggcattcgtactttcccttgatttcaagatagagcaactcagcaagacatcgtcaggttcttctggcatgcagtagtggtacaacattctggtcgacaggcccaaatttttgtaagaacctttcttttcttaagaccacggacagctccaaaattgtttccctttttagagaatccaaaaaaatcgtaaaaaaagaatcagacatatcagctgattcttctcttgtgattatctcgactctgaagtctgaacatcgatcggtacgagaaaacgggcactgcctaatctcacttggaaacgggtcaggccagcaatgacatggagcctcttgtcatgtgttgtcttgagcttgggcctggagagattgaggtgagatttggcccatctcggagcccatcaaaccagatggactaatacatgaagatgaagtactcaccggctcaccccctcggaactgagaaagatatatctatactcttttagaaactcttttagaagaacattgtagtagtggtggcagtgaatctatccgccgaagcagcataagcaggcttctattgctacgcaacaatagagcaggcgcgccgcccacaaaatgtttgaatgatcgggtaaagagcgagcttcttatatgggatccgacgcatccagcagagcgaagcagcgttccattcttctcgggactgtggtgacgaaccttactctcctcggtcaagtggatgacccgtctatccaataagttgactaagtgaatggtaatcctatagtttgaccagccgaggagtcgtatgaggcagaagctccacgtacggttttgaagccgagcctttccagcaatggggcctagggaccgatatgatgattggtttaggtagggcggccggcctactatgggcacctgtagagattagtgcgtgagaccgcgatccacaaactgacgca

SEQ ID NO: 42663 - DNA, 1501 bp, Oryza sativa
agcttttggaggctcaattcgtgcgaccttgtcggagcaaatatgttcttctaagagaaagtgaagtgtaactttgtttatgatccactgaactttgtctagttgatgtgtgctttggctgcatgcttgcagatattaaaggtctctctcgctgacgaattagctgactttggagctaatttactcatgaccatgcatatatagcatatcagtgtgtacctttcagtttccttctacttaattggttccaacaaagcagaggtgattagatgacctataaatttatctcttctttttccaagatgacatgaacttcacctttgccccagcacttgtttaccgaactaccgtgacgtcgcgaatgatgtaaattggcatccttgcgtggattcgtatgatcttattaatacttatattacacagtaaaacatctcactgtcaatgaggggcccaaggagaagcagaagaagattctttctaaactactagttgggtgttcattgtaacggaaaaaaccacgtcgagtgaaatgatgttaaataagtgtaaattgactgtataaaaaccttaatatagtactaataataattatataacatatttataattttcacatctttatagtattaacatgttagtaccatataagtagtaatagctaaatgcacgtgctttgttatggataaaagaaaacatataaatgtgttgcctatcttttttttttgttatagggaatattcatcgtactctaattttttaatgtgactatccatttagatttgatcttttttaatattaaaaaaattagggttaacttttaaaatttacaatggaagtacgtagggtgttactcttgctaccatcaggatagatctgtccccttcctcggtttccccccacatatgggatattttaagaaataaacgtctttcttcatagcagggtcgggggaaagaatggaaaagacgatttcactatatttcttaccgggaacagggcctatcacaagaatatttttttattgggacgataactctgaaaagagagatttcctgtcttttctttcaactcaggagaaatacggtcgggcggcgctaattcgaatccctcgggcaaaaaaactacagttaccgccatagacaatgattcatttgtgaatgctaaatagtagttgcccataagaagatccattattgggtgaatggagaatggatccaaggggctcgccaaatcagttactggtcctaaagaatttgtgctttccgcatctgataaataatttggtctctcataggtcacagcatcagccaataaatcctgtgtcaacggcttaggttggtttaccgatgagcccgacaggagagcctttcactccccactgggcttgggctccctgcgtcattcccattggctggggcaggtccatctccctctttctctaaaagctctacagcgcgaataagccctatgtatgggctctgcgctattgtatccagatttt

SEQ ID NO: 42664 - DNA, 1501 bp, Oryza sativa
ctgacattgttatgagtttcaggcaaaaaaagaagcaaaactggctctggcacaacatggactcggcaagggccatgacacaaaatcagtaacctttaaaatgccttcttctgatcagcttagtctgaaacgggttgacccatccaagcttgaggtgcattttctctcttcccctcccgcattgcactcgtgccagcgcgctcatgcacacacatccacactttgcttatatgaacatcttcctttatgtaggctcacataaagagaaagcttacgaaagaggagagattagaaatggtgaaggctggaagagaggatagaggaaaataccaagcaagaacagctgtgaaacagaaaaaggtattcgtttatatgatcctcctttttggtgcttattttgacctatgttggctatatggcacaaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatggtttcacaaaccgtgtatcatcgatttttcaagtgctggtgtattcttttgtgagtggagagaatgaagccggtatatcatcgctcacagtggttgctctatgaatttggacagtactcgtatccagaaggttcagcatcacgtgtcctcctggcccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatccgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagccgactgaccagcga

SEQ ID NO: 42665 - DNA, 1501 bp, Oryza sativa
tctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaacccccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggggtcaccggagcagcgacgaggaaggcgtaatcacagccggcgaccgcctcgtcgaagctgccttcctcctccaagtcggcgcggaagaccgccaggggaccaagtgcgtgcaagtccttgaagtgggagttcttctccatgttttctgcgactcaaaattgcaatgtgtagcagcagtttcagaggctaaaaccaaattcctttttaaaaaaaaaaa

SEQ ID NO: 42666 - DNA, 452 bp, Oryza sativa
ctactgcatgccataagaacctgacgatgtcttgctgagttgctttatcttgaaatcaagggaaagtacgaatgcctttgcctcgtgcttctcttttgcatctatccctttctttctttgcgatttttatttttctttttgaacgaagctatcccttactttgtccaaatgacaaaaaaaaggctttgttggaccatttcaagttctcggtaatcttccgagaaatccaatttcacaagagactacatccagaatcacactagtgtatatatatataactcatatgcataatttggagcacagtaatttgctagaaaaaactgtcaaatcgctctaaacaatctgaagaaatcaacccgcgcgcggatacagagatcaacggccggcaaaaaggtttctcgtcgacgaaaccgccgcggccgccccgaagctatcgggcggcaccgccgcaa

SEQ ID NO: 42667 - DNA, 1501 bp, Oryza sativa
tatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgcgggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagt

SEQ ID NO: 42668 - DNA, 1040 bp, Oryza sativa
catcttggcaagaggtacaccggtctaacattgactataccattgtcacgttttgcgtgaactgcaagagaacgcattactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaat

SEQ ID NO: 42669 - DNA, 678 bp, Oryza sativa
aaacaatattgacatttgtagctaatgtttagtgtggagaagaacgggggctatttgtctgtctcaagtctcttgacagacctgcaactcaccagtagttgataccttgatagtatatacaagtctatgactgataagcaggtagattctattcttatttcttaaggtatcatctcccactggggtctattatatttactaacaacagcatatcggtgagtgttgagtgatgtgtcctgtccttctacagcataagggcacaaactggtcctttcttgcatcccattgttctccccacccttcggtccacactccatatgccctgcacttgctattgccttccctgtgcacaccagtattacctctgcactctgttccaatcctgtcaagcaccgcttgcctgccatgctaaccctccacaatcactgctgctgttttttactgaggcgttgtttctaatgtggtagtgtggcaagcaatttattatattttaatattctggaagacccccaaaatggcaagaaaatagcttttggaagactcatatttatcaaataatgcattccattatctcgcagcatttattctaccaatgatcagaattgttcatatggatccattcatccatgatagacttgtgatcagcttttgctgttcaacctttgcctctggtgcaga

SEQ ID NO: 42670 - DNA, 1163 bp, Oryza sativa
atgtgtccagatttaggaagcgtatcctatgcacacaggccctcgcgtgtacacaccgtgtacatcaactaaaaattatcacaaaaaattctaggaaaattcatacatgtactttcaacagtattacatctacgtgcaaagtcacatcttcaaattcattctacatagagaataacaaaaaagataaaattctgacaaaattataaccttaaaactgtcagatttttttgttttttttgttacggctaaaatataatgaatttgacgttaatattttaaccctaggtgtaatacaattgaaagtatgtgtatgattttttctatattttttggtgacattttttagttggtgtgcacgtgtgtacacgtgagggcctgtgtgcataggatatgttgccccagatttatagctaaaagttgttatatttttggacgggtagtgagaactcatgtgaataagcacatcagttttttttctgttgtacatcttatcgaagtacctaaatgctcaattctctaatggtcgatataggtggtggggttttgttggcttaatacttacaaaagtggtcatttattatttgtcactataacctttccactacaatcaaaaaagacacctggatatattattgtaccaataaattttgcgcctgattttttttctatgtatgtcattttcactgatcgagtccacacatgcaacgaaattggcaagtgcaccgtgcaatgcgcaggtgttgccgagacatgaaaggaggaaaaaaagagagggagaaggtgacaagagagggaaaaggaggcgcctgccagcgttgcggctgtactggccggattctgttgggtgcgccaccgaccggtgcagaatccggacgcaagtatagtccagtccaacccatcaaatcaaacaaaatcgactaatcaaatcgatttgacatgacgcatccttaagaaaagctacttcagctaaaggcccttatcacaactgggagtaacagtagcaagtactcgtactctgccttttcctttccttgatgaaagaaagaattgattgcctctgtaattaggtgtaattaacaccttctctacgtcgttagtgcacggtttggttgatttgactgggcactaaggactggacttatttttatcatctttccgacaga

SEQ ID NO: 42671 - DNA, 172 bp, Oryza sativa
ttcaatttttcttggactattatgcccctgagtcaactgattcagtcggactctttcttctcttcgtttcaatctagcgaccgaacgcgagaagtcgagaagagaagcggcagcgacaccggcgccgcccaccaccactgcatcgccgccgcggcgtgcctcaccggtcccg

SEQ ID NO: 42672 - DNA, 575 bp, Oryza sativa
tctatataagtcttaaaaaaaactctccatatatatactttcgttttttttcctggcaacaattataacgacaccaattttcataaataaccaacaatcccattgttgcaccacatattggaattcaaagtttagagtacttgcaaaaaattgaagtttcaaataaaaatgaaaaaccatggttaataaatctagcacaagaataaagcaagatattgacatgctttagaagagctctccaagtatacactcttctagatataaaccttaacaatcccaaactaaaaaaagttaagccttgcctttaccatactgctactacaaatcctagtattatatatgttcttccacactttcagctaaaagaacacattaagtgcttaatactactacgtgttgttaaatttgcatgtagtaattctgatatccacaccaaaaatatcttccacatgcatggcatgagtcatgacaagtagggagtagcaaataaaggaggccagactaaggtggtgtttagatccagggacttaactttagtccctgtctttagacattaatttagagtattaaatata

SEQ ID NO: 42673 - DNA, 241 bp, Oryza sativa
ttcctgcagccctgttgaaaccggtgcaatttgactccctcagcggttttggagggcagttttgctgatgtggcactgccatgtcgatgttgaactagtcttcgtctcacgtggcgtttaagtggcattcaaattaaaaaatattatatgtgggacatgtctgtcattcacacacagaaatatattatgggggccatatgtcatcctctctctctttctcttcttttcaccggtctgcagg

SEQ ID NO: 42674 - DNA, 1501 bp, Oryza sativa
ggagggcccctcctcccgaacataaccttagttgctttgcattcacgctgccgctcgccgccgtacaactccgtgtgtagatctgtagagaggactaaagatagatgaggtaaaaaggttgaccgtgtggagaggataggaataaggctcataaccaatacgtatacattttagagtggataaagaaaaacagaaacaaatgccatattcaactatttatccaccacagtctatatataattgaaattgtttttaatccgttgcaacgcacgaatattttttctagtataatacaatggaatagagcatattattacggttgctcctatattcaatattttccacactcctctggaactacagagctcggacgacgggcatgagtttggacagatttggctgataaacacgaacacttcggcggcagagggatgggcagcaactatctggcgtggtggcctcccattgcgaccactttctcttatcttcggacgatagcaagtttcagccctctcgatctcgagctcaccgacccctactctctgacatgtgggctaccgtcatctccttttttttccatgttactagcatatgggcccccacaaacttctcttaattctttttagcactacgtcaatacaggttaaccaagttaacatgccacgtcagaaaaaaaaaacgttgactataatatcatgtaaggaccatataggacaaaacctattcaaaccatcccgcggagagcaaaaataagccagttttaatagtttagggagcttctatatctagttttgtgattcaggggtgtgaatcagactcgggtaagagaggcgatatgccctatcatgccgtgacagctcaaggcccaaattcacggagctgatccataatgaacttcagagttcaaacttttcagagatccccagacattcctctggttttccgacgttcatgagttcgtccaagtttggaacgttgtatgccgcaaaccaacctctcaacgatcacgtacgtagtacgtcttcttgtggtttttttttgtcaattgaacgtggaagtcttgtttctggactgatcgttctagtcgattgttgaatacgaaggccaccataaatcttcacatgctagcttgctgacacactgtgattcatatggccaatatacagcgagcggatagtggcattaaaccgcggcttcgcgtggaattccaccggataggaaggtaccgggtcgcagactttcaacctctctccattatggcggcgcacgcgcggttcccttctgccgcagcaaccgcagcgcgcacgctagtgtcctaggactccacaagtattgggatatgctaaaattctcgattagtttggcaagtcgcacaagtacaccacaagtacacgacggatgtctcgtatgtagagaagacgctggcgctcgttttataaaagccgggctggtgatcatgatatctaatcaaccatcacctctttcacaccatatcctataa

SEQ ID NO: 42675 - DNA, 1501 bp, Oryza sativa
aatctccttttaggcaacaattttgcataacctcaatcagtattcatagcaccaatttaacaagctagataaagcaaacatatcaaaaatcggttcaaataagtaaaacattaatacgattagtgtactctaacttatgaagaactaatttaggattatatatggtttccaaaaacggaaaatgaacttaagtaaaacagaaattttgtagtaacaagtatagatacaacagcagggacaaccattggtcgtgtgctatctattactatatattatccaaagatctactctctagaagtttataagttttgtgggcctaaaaattgccactttaatcaaagatgtaaaatagagaaagttatttgcctttaatcatggtcaatctagattataactatagattgactgatggttgtatagagaacatgtcgtcggttggatatctatctttcgtacatggcccaccaaagtttagatttctaaatttgaagtagtttttcaacaatataatttagtaatcttagcaatatatactatacgagatcttctttaatgcttgaaattaattaggacccttgatcagcaatgatctaatggatagagagagaaggtacatggaaaaaggtattaaaagggtatgccaggtatggaaggtggaagggtaaaatggtaattgtttttcattaaattatttttcggtaaagggcaaaagcgagagaagctacaaacgtttcagcaggaggaagaaaaaaacgagaggaagaataagaacgcgtgcaagaggaacctacatgaactacctgctgatcgtcgctgccgtaaaagcccgccgctcgcccaggccgcacacgcctgccgctcgagccggataccgctgtcgcacgcgcccgtaacgcccgccggtcgcagctgaggtacgcagcagcatgtcgccgtcaccgccgccgcacgaatcctcgggctgctatctactctgctagttccttgctcgttctttgtcgtcatgccttcatgcagccagcagttgtattccaggttctgaagatcgattttgccagcaaaaacaaatcaacaatgccctgtgctgcgcatccgatcccctgctggtttctgcgcctaatttggctatttgatcactacgtacatattctgaatatcgattgaggtgagccactcgccacctgcatgacatcgtggatggccgatttgttaggcactcgacggggtgggaattaagcaattactaagctatccatgttaataaaaatttttgttcctaaattagcctttaaagattaacggtggataacaattcgttaaggaggtacctggagtaccttccaagcacagtaaaagatctctacagcgtccaggcgagcgcggtttgccgttagcaagcatcaaaccgactatagcgctgccgtccggcgactgtagctgaagtgaacagctcctcagatccgggagcagctagctcccttcaaatctttttttcctctca

SEQ ID NO: 42676 - DNA, 415 bp, Oryza sativa
gaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaa

SEQ ID NO: 42677 - DNA, 1501 bp, Oryza sativa
tctgtagaatgcaatacatggatgctaagaagaaaaaagaacacatcggcttcttggatccaactcggatctgccaaacacagcatacgatgaggctagcaccagggtctgaccagctgaagagcaagaatccaaaagagatagcagaatacaagaagggcttgcacaaggagaaattgattactgtcgcacagtacattggacgagccttcttgcactttcaaaataagagagtcgtcatggccgcttataattttaagtaagtctagtacatttatcttgtatacatatgtcttattttagctggtactaactaactatactgttgttaatatgtagcgatcattatatctgtttactcatccaccctaaagacggaaccgtggtagtcttggaccctctcgattacagtcacaagcaatataaagaatttctaataattttacagtagtaagtgattatgacttttgcatttgtatatgaatgtattataaataaatatcctccttactgtgaaacggtacgacatccatacagtgcataccaatactataagttcaagggtggagaacagacccgaataagggagaagctgctagtacgtacctattggccggtaatactccactcacttaatgtattccaattgattcactaattgcaaattttaactacttttttctatgatatgtcctgaagtgtcacaagcaaccgcgaggaacggtcctttgcggatattatgcgtgtgaattccttagggttaatggacggtacaggactaacgcggaggatgtaagtctctatactatgtactagacagcttcacatatttatgatactaatatattgattaacttcaatgcatgcagttgccaagattagaatgtcgaacaagctttgacgatacaggtatcccaaatgtccagcgtgatctgtgtcacttcatccaccatgagtgctgtcatgtgaaagaagatttcttcgacccagagggtgtcccagcgacaagtgacgaattcaaggatcttcgggagtggaacactgctatgccataatgtaactagataacgttatttgaagtgacaatgtaaaaaaatattgtaatatatatattttggcaatacttttgatttatgcaatatatatatatatttctcagtaccaaatgcttgataatcttccaatatatgtacataataatctacctgcaaaaatttctattaaataatttaaaagtaatttacgggcaaattattattaaatttcaatattttctacctatctttgcaggcggaagtttttttttcaggcggccgattcctattttcgtaggcggaccggactagccaatgtccgcctgtgaaaattatcttcacaggcggacggccgcccagcgatcttcacagtcgttggcttacaggcagacggtcgccccgcctgcgaagacccttttcgaccgcttgcgataatgcttttcctagtagtgtactctatgctcatc

SEQ ID NO: 42678 - DNA, 195 bp, Oryza sativa
actggcgccgtgcccgtgccaccgtggcaatagggctgtcgtggaggtgctggctaggccgaagggggtgccagccaaagtggcgccgcccctcataccacggcgccagcatggctggcgcgcccctcctctgcgggccccaccaactttctccccttcccccaaaattttcgccaagtctgttctgcctccagg

SEQ ID NO: 42679 - DNA, 682 bp, Oryza sativa
taatcactgaattattgccattttgccaacttgctgcgtcatattactggagtcccacactgtaagttgcagaatcctttcagtttccacaaactagcatgccaaagatagtaatccgctcaaggtcgacgcttgtaaactcttatcgtttggagcagggaaattttcctatttcttgcaagaaatgaattacttcacaccatttgtagcagtgattcttttccctacttcttgtaaactctttagtttggagcagggaaattttcctatttcttgcaagaaatgaattacttcacaccatttgtagcagtgattcttttccctacttcttgcaagaaatgaacgacttcgtgtgaagttcatgtgaaattcgccaggcaagtttttagaggggagaccaaagacgtgaaggcaccaatgttttgtgacacaagagatatgtgtagattgcaaatcaataggcaaacttagctcctttataaaattcccaacaaacataaggttagggatctaccagaaagcaaaatctgccgacgtagaccctaaacacaaccgtggagtaattactcgtgcaattaacttagcttaatctccctctaggctctagtagtttcagtttcagtagtactgtagttttttcaccagctgaatctgacccacagcagcaacgaaccagagcgca

SEQ ID NO: 42680 - DNA, 1322 bp, Oryza sativa
  unsure (1)..(1322): unsure at all n locations
gaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcgggccgctattgggagccgccaccgacgcctgcctgctgtacagaaactgcagcacgagcacgagcaccagcaccttgtaccgcaccagccgcggcaaccccctagcctccgccgccgcgcccaccttttttctcgacgccgaggacgacgacgacgacagtgccacgaccttcttcttctcggcaccggcgcccgccacctcttgcgcgtgccccacgcagcaccacccttcccggtggcgccgccgcgccactatgttcgttgccggccggcttccaacaggagaaaagagtgagagagagagagagagaggaggaagggaggatgctgacggcggcgttgcctccgccggcgcgacgccggctgccggaccttctnctctcccctccccccggcgcctcctcccccacagcgccgcccgtcgccggctgagaaaagtgagagagagaaagggagaagaggggaaataagaggaaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggcc

SEQ ID NO: 42681 - DNA, 1387 bp, Oryza sativa
ataaaggggtatgcggattgggtggtaaaaaaagttaaggcacgcgaatttaatggtaaatagtctatattctcccgatttagtagaccacattttggcatcaaaccaaaatagaccctctcccagaatttgtaaatggctttgtggttcgtgatatcactgaacctgctgggtgaataaagtaaaaaaaaaaacccataaattggccttctgcaagatctcgtcgtcttgcccaaactatagccttcgatctttccatcaggaccgcatggggggagagcaggggcaagtatgaaatggagttcagattcagattctagaacagtctgaacatgcgacgacgacgatggcgatgtatctgaacaatctggtcctctccctctcctcccgggcgggcttccacgcggctgagtttcaggctcccaatctgcagctcctcccagaaccttactctgattgattggttcatcgtttccatggctccaatgaatgcaacgtgttgttcagattttctgaatcttgttctcaatccggagtacgtgctgtagcagcagcaatctgtccctgatctgagaattttagacactcgtagattcgctgatcaatcattccgttcccttcgagtggtctagattgagcttaatcatcctgctactcgaatcaaatcttcagcaagtgagagctagataattcagaagaaatcaacatattcttcgcgaaaaaaagaaataaccgatgaaaccacggtaattaggttcttcgaatcaccgggagagtaggaaaaaacgagctaaaatcccacataggaggaaacggttaaaaacggccactccgcgtctccgccgcgagactagctctcgccagtccacgtagcccaatccacaaccgccacgtgctccgacaatcccgcccgtccatcgccgcggccccggcctcatctcgaccactcgtttcctcccttcacaccagccacgtggcactctctcgagagctcccgcccgcctatataaacttgttcgcgctcggctcctcctcctcatcgacctccaccccacattgaataattatttttaataattttagttttttttttttggctttagatatattcccaatccccaacctcccaataatccgatctctcccagttctgttcggatcaaggctgtgtcgatcgcaaaaaagaaaaaaaaaacaatttccttttggggtggttcatctgttgatcacttctttgtttcccgcgttttgctggggattcgattttcgggttaagattttctacacgatggccttgaacttggctcaaaacgccgcggcggcagcgtgcttcgcgaccgccggtgatgcgcggcgagctgcttcggtggtcgccatgccgtcgtcg

SEQ ID NO: 42682 - DNA, 770 bp, Oryza sativa
ccgactaacccacaagcaacaaacctaagcacggaaactagcaagcaaacaaaactaagaagacgattaagctaagggcggcgactctgaagcttggagcggcgcttgcgatcgaagaacaggtctgacatctaaagagtacagagggataggaaccaacacatgctcaaaaccaaattaaataaagcaacaaatgactaagtaactcgccgagcatgatgatttttatgcatagaacatttttcatgaacccggataaagacactaatgcgactgactaaaccatagcttaatgcataaacttgttgcatggaaaatgatgcgcataaaattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcagaagaacaaaaccccaaaatttttcccgaaacaaatccaagtgcaaaaagcatatgcagatgaagaggggttcagagggctcttaggtttccagttggcttgtcctacggtcaaggtcggctctgataccaacttgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaa

SEQ ID NO: 42683 - DNA, 1226 bp, Oryza sativa
catgtaatattaatagcatgactcaacataaaatcgggataaaattggagtaggaatcggtgcaggggctctttttagtagatgcgttcttttttaatttgggcttgtgggcttaatctggtaaatttgagtaggaatcggtatgggatttttttttcgtgtgtaatacgcgcaaactggagcggtgggaaaacggaaaacacggtgtgaaaagggttacggatggaaaaaaggggttacggacgaaaaaaaaaggtgcggggtgaaagatgtgacgactggaaaaatacaaatatttatattagttatagatttatgcacctaaagtttatatacctcaagtttacacatcaaaagtttagagaccaaaagtttatatatctgatttaaatttaaatttgatttcaaatattttttatatataatatttctatacatctaaattttatacatctaaattttatacacctaaagtttatagaactaaagtttgtaagtcaaaagtttatatacccgatttagatttgaatttgaattatatctgatttaaatttgaatttaaattatatccgattcaaatttgaatttaaattatatccgattcaaatttgaatttgaattatattttctatatacatctaaagtttatagatccaaagtttatagaactaaagtttatatacccgattcaaatttgaatttgaattcaaatattttatagatccaaagtttataagttaaaagtttacatacccgattcaaatttgaatttgaattcaaatttaaatttgaatttgaaaattcaaattgaattcaaattcaaatttgaattcaaattttttatatatagtgtttctatacataaatttttctaactatttgttttttttaaaaatttttttggtttactgcactaggaagagaagaaggagaggaggaagggaagaagtgggaggactggggtcgcgtattggggaggcggggggatgcgatcgctgggcgatggatcgcccattagccgccactcaaacagtgaggtatgtaagaactaagatcggctttgatgccacatgctcatatctaaccagaagcataaatgtgggcttgatgcaatcgttgttttggacattgggccgtttggggtgtcacacttttaagggcatccctgccaagttcatccaaggatactaggcttctcaatatgggccttcgccttgggcccaaga

SEQ ID NO: 42684 - DNA, 1272 bp, Oryza sativa
ctgtaatttgagaaagtcactctatccaattgctcatactatggggctgtttggatgggactaaaaattttagtccatgtcacatcggatgtttagacactaattaggagtattaaacgtagactatgcaaaacctatttcataaccctgaactaattcacgagacgaatctattgagcataattaatccatgattagcctatgtgatgctatagtaaacatgtgctaattatggattatttaggcttaaaaaattgtcacgcgaattagttctcatttatgtaattagttttgtaagtagtatatgtttaatactctaaattagtgtccaaatatccgatgtgacagggactaaagttttagtccctaaatccaaacaccacctatagttgctagcttagaggcttgtgcgttacaatggaaaacaaaatcagtttctacctcattagatcaattaattagcatttatttaccaagtaatatgatgatttttcttattaacaagtaggtgattttgaaatttgaggagatccaatagtaaaataggagatgactcataaagatggtgtaatagtacagattaggggacccacatatcaatggtagtgatgatgtgggaaaggacacccactattataacattttaagtagtaaagagtatagatatttgaaagtattttttcaaaaaattgtggaaagttgtatactacctaataccattacatatagccagttttattatagagtactagtatcataaatatcagagtactatgcattagtgttcgacacctaaggcggtgcaaaatctgccaaagaactagatcaacgtgctgattaggcaggtgtcaatccatcgagaattcgatcgatcgagagagagagagagagatcgatgcataatctaatcaccaaatggtatgtaccgagcggagccccccgattcaccaccgttttcaccatcaccggctcacgtacatatagcagagtctaaccgtgcgtgccgatcgatgagcgcgagcgatatgatccagcgcccacgacgatcgatcgacatgccgctgctccagtgggggaatccggtcggccgcccgcgtctcgtcacgtcgatcacctacgcgaatactcctacgcgataccagtagtgtagtactaggcataagccgccgcacgcgctccctactcgtacgtcgtctctcggatcggtagctaattaagctagctaagctaggtagccgcggccgggcagagtagacgatcgagtagctgaga

SEQ ID NO: 42685 - DNA, 259 bp, Oryza sativa
tataatcgacatatgccaaacgacatggctgataagtgcaagatgggtgatggcacatgcctaacaaattagggcaatgtttatttcaatccatgccaatgtgttacaatatattttaggaccttcttatttcaatttttcgaagtttctatctcctgtctccacttgttcagctaaaacttagcttattttccttggctctgataagggtttgatgataatcattgtcatataaaagagttgtattttactatgataa

SEQ ID NO: 42686 - DNA, 668 bp, Oryza sativa
tgtatatacatatatataaagttggtatattttatatacatacatatataaactttatatacaacgaatacaaactttgtatttgtatacatcgtatacaaattttatatttgtgtatatactttttatacatatacacaaaaaatataaatatacaatatatatatatatatatatatatatatatatatatatatatatatatatatatatatatatatatatatatatatatatatatatatatatatatatatatatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtactgaccacgcgtcgcgcgccgcgcgcgactgatcgccgatcagccatccccggtggggattggttggttttctatcctttaattccctccgtgttttttctaggttaatttcaactgcttcgcgttcggtgatctctttgttggcttctgcaggatttaatttacttaaggacctctgctagaaggtgcatatcaatgcctatacgtacggaagatcgacgtttcatggagttagttgtaagtaatctcccctataatccccgtcc

SEQ ID NO: 42687 - DNA, 1501 bp, Oryza sativa
agtggagctgaagcctcgctaggatcgcctttttccgctgctgctgcttttgtttcggtgtgaggactaagtatctcttctgtaagtattttacgctttatttacgtttggaactgtatattacttgtcgttttgtgtaccctggctggtcctggacagggatttaatacacaaaatagtctagaaagttgggctaaatttctgggcgtgacacaactatcctaatgaactgtgataatcaaacagtgattattaaggtgaacagttcgaaggacaatatgaagtcatttaggcatgtaaagagaagactgaaatctattagaaagcagaaaaactccagagtgatagcactggactatgtccagacagctaaaaatctagcagatcagtttaccaaggggctaccacgtaatgtgatagatagtgcatcgagggaaatgggcttgagacccacttagagttgcacaatagtggaaacctatccattgtgatcggagatcccgtgaatttggatggcgaaacaaactattgtgtaaccgagagaagagacccttaaatgggctcattttcatgatgtacttctcttctattctgtatggtaggatggcgtatgcctcaatgtgttccgagtggctttcattaagcagagatgttgacctgcagaatatcttagaaggaacacaactatatgagttcgactgctagtcacagtctatgagatttgggtgatctctagatactcatgaaaggcctgaagtatgacttataagctccaacccgagggaatactaacggttgcctagtatcagttatggaattgagtgaaacctaactgcacaagactgacaattcaaggcatagtccattgttcagttgtggtcaggtgtagctccttttctaggtgaaagttcaacttaacagtcttcactgaaacactggtatataaaagctgctatggaataaagagcattctcatgagccttggaatttggtggggattgttagatttaattgggtaattgatccatttaaatcaattaaatcaaataaattccaagtctcattatgctaggaattcatgtgtattcattcttttatgggatatcaatgggatgaagagttttgagaattaatccatttgattagggaattggtaacttatatcaattagttctaattgatggatggttgatggttgtgtagtggaggatggttcatggctagttgatgacaattagttgctctattcctcttcctattccattggtaacttacatcaattactcctaattgattgttggtcgatggttgtgtagtggaggatggttgatggcttaattgatgagaattagttactctattcctcttcctattccatgactcttactcttcatcttccattcctcttataaaatgagaatggatttgatctcccgcgagagaagtgagacacactttcatccattttccaacgctgttgctgctacggtaatcccatccc

SEQ ID NO: 42688 - DNA, 616 bp, Oryza sativa
tatcccttcaatacctttacctacctaccactcttattacttttttttaatgattaaggatattttagtcattatcgctctccactattttcattttggaatgctaggaatggttttttttttacggagggagtatatatttaaacggttgcagtactctacaacagtgcatctcgtgtgagatttcagacttggaactaaacaagtgatcctagtcaggcttcacctcagaccaaaagctctaaataatttcattcattattaattcgtcaacaagaacagaactgtcattgcagtaagatctccagaagaaatatccatcaagtttaattaaatcagtggtggtgatgctaaattaaagcacatgcatgcatgcccaaattaaagaggataaacacatatctacttagtgacatgatgtcatttatctagtaatcttatgatcttatctgcagtactcacttctaggtataaagtaacacagtaagcatcgcaggaaaacgatggaaagcaaaaaaggaaaaccactaagtgctaaagctaaatctacctacgagatcaaaggggattagctgatgagctgatgactcacccacctgatcggctgattcacaga

SEQ ID NO: 42689 - DNA, 158 bp, Oryza sativa
tgtatatacatatatataaagttggtatattttatatacatacatatataaactttatatacaacgaatacaaactttgtatttgtatacatcgtatacaaattttatatttgtgtatatactttttatacatatacacaaaaaatataaatatacaa

SEQ ID NO: 42690 - DNA, 1137 bp, Oryza sativa
attaataatactgtgtagctctaggattcgtctttataaaatggctttgggcaactaagtgacttttaaatgccgttacgtgaaaacttacccctatcttattatccccttgtactcctttgcattaattgtgcatctccggtgtggcctgctgagtactgtggttgactcattcttgctcaatcttttccccccttcagtaagagaagctttgaagaagaagtcttaggtggagtcctggcttataccccagttgagcgcctgtgaagatggagccgtaggcccgctagtccgctgctgtttatttttgtttgtcaggcctaaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgtagcgcgtggtttgcatcggggggttgtgatgtaaccatgctaggttgtttgcttaatcaacttgcagaataagtgaaacaaacaacacatcaacaaagagagttagttcctttaaggtcctgtccctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaaccagggcacacccttggtccattccaagca

SEQ ID NO: 42691 - DNA, 1501 bp, Oryza sativa
acccgatgtactccacgaacccggagatctcccactgaggtatcgcgtagcgacccgtcaccctcgtgccgttcatctgcgacttgtccggcgcctcctcgaagttgccattcggcagcaggcctgaaaaatacacgcagcaagcagaatgacatatcagcgatctttcgtcattttcagtactatctaagcagaaatgagcgtcacaaatttatcgtgcaactgattaaccgtctaaatcgcatgtacgatcttaagctggcaaatgtactatggaaggctcttaccatcggtgatagccgacgccgatcgagcagcaaaagcaacgccgacgagcaagagcagcgcgacgcagggggtagtctgaatcatctctgtttttcttctcatcacctctctgagcaagtactgctcctgttattacttggttgtaagcaaggtggcaatgggattggacagcaaacaggtttagaactgtacaggagattgtgatatgctgtcacttaattatagagaacggatcggtgttcagagttcagaccagatgtccagaactccagatggacagcgtgttttctgcaggaaaccgagcgaaacgagcgccggatccgcggaccgccacgatcgaggaggttggcagggcatctctcctcggttctgaggtgccgtggaaatggggtcccttggcgaggcggcgaccggggaaggcgttgtctgcgtttgcctggggtcacatggtggtttggcttgccattctgtttcttttgcatgggcggcatgggcgcatggctgctcgccatttgaaaactccgccgtcccccgcaccagcacctgtgagaagggggaagctgcgtaacggcgaccgacgcggcgcgccaccgtcggtgcgactaacccgcccgtaaggctgtcgaaggatagtatatgcgcaggagcgatgtagcatcttagcacacaaaaacagggccgaaattacataggggtaatggctaaggcccataaatttcttggaccaaattggtttagtacaactctcgttcacgcatcaaaattaccatgtcatttttcgattacatggaaaatacaacacgtccacgcaccacactcacacgctccaatgattgtgcttcctaacacaagctcagagagatgaagaccaacatcatatcttagtcccactaaattcctatagaaaacacacttacgcaaccaggattaaactttgtatgtgaagctatccacgactctgcaccacactaatggtgttttcctgaaattaccacggtaactgaaatattataaagattaatagctattgtttctatatgttaggtctaatgatgtgtacagattcaaataactgttattttgcgaagtgagtatatcttaactggttagattgtttgtggtggaaccaacccatccatactcaagtattagacttgtcagggttacggataaggtataccctccacccttggatatacgtcatgtatcgata

SEQ ID NO: 42692 - DNA, 1501 bp, Oryza sativa; identical to SEQ ID NO: 18910

SEQ ID NO: 42693 - DNA, 1501 bp, Oryza sativa
aaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaaaccaattaaactgtgttgggttaaaaagccaatgagacagtagttggggataggagtttggatacgccttttacagatcaagataaggattgctggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttgggatgctccccatctcgaggaagcactaaagatgatcatcggcaattaaaccctagtggcatagatacagatagcaagcaacgtatttccttgaaggtagtcagtgcagctttttgacgaaccacatcaaggtttcacggaaaggcagcaagccaaaggacctcatcgtccccagaagcgtccgcaatccacattaaagaataccacctgttagagataagccgaaagatgattgataaaagagattggcaaagacgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaagagtgaaatcttcaactcggtatcagatgctgcacggagtgaaaagtgcaagcaccggttaccaggcaacaccatgtcttgggagattgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacagg

SEQ ID NO: 42694 - DNA, 1501 bp, Oryza sativa
gtggttttccttttttcgctttcctgagatgctcactactacgacctagaaatttgttaattatgagtagataagatcgtaaggaaaggctagataaatgtcatcatgtcactaagcagatatgtacactctgcaacggctgaatgtgttgttcttgctgacgaatgaatataactaattttttttaataatggattaaaacccgacctatacatcctgcagcaggatatacgcagccccaaagatacatagtctgagtatttaagctcgcaatataggtttcgaataacaaaacataaaagctaggcactaggcctcaaacagttccagcagcaattggcctgaaattggaactgtttagttgtactagctgcgtataattcctttgccagaagtctgaaatccgaccgttgatgtgtggttatgttatcactctatagcactataattaaacagaagtgtttttacgtcatagctagcagcttgagcttagtaggacgctaggacgtactccctctaaaagttataaatatttaacgtttaaaataggatttaatcaaacttaattttaaaactttggccaccaataatttctgaatttctttgtttaaaaataaactagctgggtggctcgcgcaattgcgcggctagcacccatataaaattatatatttttaatatgattttacttcaaatttattaaatagttatctcgttgtcttaagatttttaaagactaaaccttattatcctcgtgtttctaatttccttagtttctaaagtcacaacaactgctaccccttacttctgtcatattattctttatttgcttgctcgatctaccaccgttttctattcattctccttagaatctttatatgttttagagtttattgtcctattgggcatcttttttataatttctagaagtcccgtcaaacactatcattatactcatctatgttcgtccattgcatcttctctttattgtcattgctattttaaaaatcgaacataattatcctttaggtttatttttttactttctagaagtttctccaaaacgtcagcgactttgtcactatactactctacggctcacccgctgccgcccttctttattgtcattgagattttaaaatcaaacaggattatcattggggtttattttttttactttttagaagcccgaacctttaaaaattggagtttattatcttgttgggtttcatttttattttataatttttagaaatcccatcaaacgttaccactatactcctctatgacccgtccgccgcatactctttattaggattgtaaaagtcaaacataactatcattggaattcattttttttactttatagaagacccaccaaccatcggcgactttgccattgtactcctatacgacccggccgctgcctctcattttattattattgagattttaaaaatctaatatgattatcattgggtttatttttttactttctaga

SEQ ID NO: 42695 - DNA, 1501 bp, Oryza sativa
gccgtgcccacggtcatgggcggatgtgaggtgattcctagcgtagttttgtttgactactggttgtgaaattgctgttgtggaaaggggttcgctgtttgaaaaatctgcagctgatgggatcagctaggcccgggtggccgtttgaaagttgttggcccgggtggccgtttgaaaagctgttggccgggtgccaaccttgttttaaattttaaagactgatacattgcacatactccgaccggacgagacgcaccgtctcaaccgtgtcgtttgagaagcactcacttagttgtttttagaaaaagagttcaaataaaatcaactgcaaaaacaacagcctttccttgaagcctgcattaaacatctattttcccttggcttgctgagtactcccgtacttacccttgctctatataaataattccccccccccagttgctgaagaagatgaagcggatcctgctgatgaggagttctttcaggagcaagccggctacgatgagttttagggtttcggcctagttcccaagtcgcgcctgtgttgtttggtccaagtcctgcttccgtttcccttttgtaatgcagttgtgagctcgggatctgtccgtagcccaacatgactgtatccctactctataatgaagagaccgctgttgctgtgatattctgtctccctgtgataccagcactgtttcctgggactggtatcgatcaacaggttaatttggagcgtcacgagctagttccggtcggtactagttcggggcgtgacagaagggtttaacttgttgacggttaatatgagcatgtttgacagcttttgataacttctcttaggtctggtttagtccctaaaaaattttatcaaaaatatcacatcaaatctttggacacatgtatggagcattaaatattaattaaaaaaaactaattgcacagttagagggaaaaacgcgagatgaatcttttgagcctaattagttcatgattagctataaatgctacagtaacccacttgtactaatgacggattaattaggctaaaaagatttgtctcgcgattttcggcgagttatgaaattagttttttcatttgtgtccgaaaatctcttccgacacctggtcaaacattcaatgtgaaacccgaattttcttttcgcgaaccaaacaggcccttagaatcaaaagttttcctaaaaggtatagctttcaattcatattttgaaaaattatagttatagaatctagaaaatgaactaaaagttaggagttggatttctcaatatctcagattcttaaacttctaaaaactaattaccaaccaattgtttctcaaaattaagttctttaaagagagccttcgtatactctcgaagtagtccatgcacgtaaacattattgtataattttaatctaaaaactcagcaaatttatatatgtatttccttcgtctcaaaataaattcatttctcatttatcccacacataccaatatact

SEQ ID NO: 42696 - DNA, 1501 bp, Oryza sativa
gatatcatgaagcagatgccaccgctaccagtgaagataaacgaggagctagtcaactcaatgctccccaggccaactgtacctatgcagtagtgaactagtgatagtgaatgaacatatatcctcagtagtctcaagagctctttagaatagacagctaaaataaaaatgccagccttgttctgttcgttcattgtgtagctcctctggtccttgatctaatctgttcctttcagcatgttccgtctagtactctagattgttgaccttccaaccgttctccaaatcagccggttggaacatgtaccatactgccatgggacatggtttccttctacagcagtgtcaccttcaaactctggcatgttttgtaatctatagctgtttagcctaatatgatggaatattggaatgggaagccaagatttaccctctgcggttctcttaaatgaggcacagtgtatgcattgttttgccccctttgtttttgtttgtgtttggtgctttcctaccatagttctgggtgtgtttagttcacgtcaaaattggaagtttggttgaaattggaacgatgtgacggaaaagtcgaaagtttatgtgtgtaggaaaattttgatgtgatggaaaagttgaaagtttgaagaaaaagtttggacctaaactcggcctctattgagatcaggtaattttattggatgcgtatctttttgaattaaatggctatcgctacacccttgtcgtacgaaagtagcctacagtacgggtgtgtttcgttcaatgctattcttaaatcttatccataccaaattcattgttgacattacggggtatgttttggttcaacgctattctcaaatctcaatcatacaaaaaaaatgttagtaatagcaaagtacccataggctatttggtttgttaccgaaaaatatgggatgccagtattttgttaaggatagaaaacctttgaactaactttaccaaaatttttacatcaaacaaaacaaccaacttataccaattttttgcctgccaatattttgataaggttgagagtggctacaatccaaacaagacatcgaggggaaaaaatagtaatgtgggtgcccaaagcctccatataaggaataagtccactttgactcccttaaaagtgacctgaatctaatccgtgaccctcaaccgtaaaaccggataggacgactccctgaactattaaaaccggtacaatttgactccctcagcggttttggagtatggtttcgctgacgtgacgcatacgtggcggtatggacctggtcttccttccaagtggcgctgacatggcggttacgtgtcactcgaattaaaaaaaatatgtcacccattttttcattaaaaaaatgtgggacccaccggtatatggggcccacgtgtcatcctctctcttccctccttcctcgtccctctctcccttctctctctctcctcatgcctatgtcatggatccccgtctcctcgactc

SEQ ID NO: 42697 - DNA, 1501 bp, Oryza sativa
gattactcacaaaatgtgttgacataattatagcaacaccgttgtagatttgctacagtaattcatgaacaatattttttttatgatctaagccgttggtttttgatccatcagttgcggtgcaactgctaaagttgtagttatatgggttcatcttttcacttatgcttatgcttatcaaccaaaatttaaaattttaaccttaaatttaaagtttatttttatgattttttatcatagtttattttttagcctttgcttttaaattgttaagaacatatacaataaaaaattattcacaaactattttttgtttgtaaatatatcgtcgaataagcaaaatgatagggcttatagtaaggactgcaccaatctcggtccgtccaacaggctcagaggaaaatgagagattcaaaaaaagtgaaatcatatatgacatgccagataaatgctttagcaaactttaatgatctgtttagaacatagaatgcatacagatcctgcataatgcataagtaaattggtaaaaaaaaacccatacaaatcccataggattaactagcaccattgctattgtttgttgttgtagtcatgtggtgctatctgatcagatataaatgttgctgttaaggtggcagcttctgtgaatctgatgagcttaagaaagatgtcatgctcgaatctgatcgccatgctcgaagctgatcgccaagtgactcggataatttgacttgtgctttttaactatactttcctaatcctaaagctgccggccatccgtcgtccttttgtgagatctgtgaatcagccgatcaggtcggtgagtcatcagctcatcatctaatgtcactttgatctcgtagctagatttagctttagggcttagtggttttccttttttcgctttcctgagatgctcactactacgacctagaaatttgttaattatgagtagataagatcgtaaggaaaggctagataaatgtcatcatgtcactaagcagatatgtacactctgcaacggctgaatgtgttgttcttgctgacgaatgaatataactaattttttttaataatggattaaaacccgacctatacatcctgcagcaggatatacgcagccccaaagatacatagtctgagtatttaagctcgcaatataggtttcgaataacaaaacataaaagctaggcactaggcctcaaacagttccagcagcaattggcctgaaattggaactgtttagttgtactagctgcgtataattcctttgccagaagtctgaaatccgaccgttgatgtgtggttatgttatcactctatagcactataattaaacagaagtgtttttacgtcatagctagcagcttgagcttagtaggacgctaggacgtactccctctaaaagttataaatatttaacgtttaaaataggatttaatcaaacttaattttaaaactttggccaccaataatttctgaatttctttgtttaaaaata

SEQ ID NO: 42698 - DNA, 1501 bp, Oryza sativa
ctctctctcctcccctcccgcgcgcgcgcacttgggccgccttgggtcggccggcccatttagctcggccggtccgctcctttttcccttgggccgcgccctagccgcccgaggagaagtctataatccctccctcttttccttttattttctttttcttttccaaaaaggatttaattaaatccttttcctttagaccaaaaatccaataatcttagaaattcaatatcttcccaaccgtagatccgtttgactccgttcaacttccaaaattcctcaaatctcgagatctatctaatggcacgcttagaggtcattattagggcttcattttcgccgtttgttgagttgtcccgtttcgcatgtagtttcggagcccaaagacccgcaacgcgaggatttcgaggatcaagctccagacctcgagcaaggcaagccacctttgaacatcttgagcctatatttgaaatttaattatgttgcttgcaaaatattatgcattgataggatcgcacttaatctgttgtcccgtctgtaaggcagattggcggatctacctagtttgttgcatttgatccttcctttgttaattgttataccatgttcccttgtaacctcccagttgcgcctctgaaatcgtgcaatctgtgcgagtaccgaagggcgccttcaaatttaaaatctgagcaacttcttgggtaaaacttgagttttacaaaagacttggaaaacccgacacctgggtcggtgcttgcgaactaaatggattttctaaaaccgcggaccggggaacgtaccgggtgtacggttttcccgctcttgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactggttgtgaaattgctgttgtggaaaggggttcgctgtttgaaaaatctgcagctgatgggatcagctaggcccgggtggccgtttgaaagttgttggcccgggtggccgtttgaaaagctgttggccgggtgccaaccttgttttaaattttaaagactgatacattgcacatactccgaccggacgagacgcaccgtctcaaccgtgtcgtttgagaagcactcacttagttgttttta

SEQ ID NO: 42699 - DNA, 454 bp, Oryza sativa
ctaatgttctttaagcatgacatagatatttttgtatttgcacaaaaattttgaataaaacgaatggttaaacgttgataaaaaagttaacggcgtcacacattaaaatactgagggagtgctagaatgtgacatatggttttttagacggtgggagtatttcactataaattatgagtttacagaattaccctccaccaatagtataaaaagacaattttatcccctttaattttatactatattatattgaagcaggaggaaaaaataatatttttttcgattatttgtactgtcagtataatactgtaaaagttttcttaaatttatggataagatggagatgtgaaaatgtcaagagaggaacgtcacccaggctagcggcttctccgttctcaggtagtcaacgtcagaccaggattcctcgtccagcacatgcccgtcgccttgcagc

SEQ ID NO: 42700 - DNA, 594 bp, Oryza sativa
aaaaagatctctgaggttgtgcttgtgttgcagctcgctttttttcagatgacaagtactcacgccagagatacctgttgaagaagagattcgggttgctgtcaacccaaaagccagcaccaaagtactgaaggagaaacctcgggccaccatgttccatggatccctcgaagcgaatcagtcttgcctacctcgctatttactgtatcactcaaatgatctgatgtatcgcgatgctatctacgaatcgtacttcctcttgaccatattagtatgatcatgaaagtcattcaggtgtcttcgcatgttctgaactgttggcatgattataatctaaaaagtatgaatctagactgttactagtatattgtcacctttgtgctattaggaaatcatatggtggttagctgataaagcaaggaagcaataactgccattttattcaactgagcaataactgaacactcgtgagttgctactttgctttcatgtatagtactggtcataattttaaatgatggctatatgtcggataaggcattctgatagctcgcatggcttacgcggccattgtgtccaacggctaatcagtga

SEQ ID NO: 42701 - DNA, 1501 bp, Oryza sativa
gtcttgcaaccccaaacacttgtgttctccactcaatcaatcaaacacaggagtagggtattacgcttctcagcgttccgaacctgtataaatcccttttgtcccatcgtctttgggggattgaaccccctcaagatcacacagctttgctcaccaagccctcgaatctcacccgctgcccccggccgaactctcaaaggggggcctcatggttccctggtggaggagttcattctccgacaaatgcgatgccaaaaaaggaaacaggtagaaggagggaggggaaggtgggagcgaatatgattgctaccccctccctagggcgagcgatcgccaaacagcatttccagttggcagcttggcaccaaaatttgaccagcggcatgtgcagactgaagatacactttgggcgataaaagacgttgaatgcctgatcttttttaattcctccacaaagcactaactagcagcatagaagctgacagccggcaaaccgaaactgacggactacaagtcgtagatgctgccactctagcaaatcagatccacgtgaacactaacctgatcatcgatcaagtaccccccatcaacaataaaaaaccccatctcttaataatcgcaaaaggggaaaaaaaaagcattcatgcacaaacaacatagagccgacacggcaaattaaggacgcacccacttcctgtcttcctctaaacgagaaaaaactaaacaccgacgggggcttaatcccccccgcgccgccacgtaacgccggccgagggaacaggccgaacagaggaatccttccgttgcaacggccatgcgatacggggcatgctgcacgtgatcgcatacatgagccggttgcgttctgccccggttgtttgctactcgcgtccacgcgatcgatcaaacgatcgtcagatcgaatcagggacagtacagtacagggagtcgctagcgtgcccgcacgccgacccggcgcgtcgcgcggcgcccaatctgcccgcggcgaccgaggcatgcatgcatagcccgataggcgatagcccatgggcttcggtttcgctaacgcagtacagcgtcgtcacctataaatgcaaggcaacagcagtacagcacccgtcccggttaagctccgtcccaggtaagagctagcagctcgagagagcgcaaaaaaagaaaaaagaaaaccccaaaactccagagattaatcggcagagctagctgtgaccgaggagaagacagagcagccgaatcgaagatggcgttctataatggcgcgagtgttgtcgcgctgctgttgctggtctccacggctgctcgagctgccggcgatggtgagagcgtcagataatgctgcattatgcacttttacagttttactcctgaaccatattagcttgcttcagtgcttcctatggaatttccgcaagattcctaggagtaatttgccatccactatctaggtggcaattctttgccatgaactagatagtactctgaa

SEQ ID NO: 42702 - DNA, 546 bp, Oryza sativa
gcaatattgaaagaagagtccatataggaacgcaatacaagattaatcaaaattcagaataaaaataaaataaaatccgaaattagcaaaagaaaaaagagagtctaagtaggaatataatctaaaaatagctgaaattcggaattaaaaataaggaatattgaaagaagagtccatataggaacccaatacgagattaatcaaaattcggaataaaaataaaataaaatcggaaattagccaaaaaaaaagagtccaagtaggattacaatttaaaaatagcagaaattcggaattaaaaataagaaatattgaaagaagagtcatataagaatccaatacgagattaattaaatttcggaataaaaaataaaaaaaatcaaaattagaaaaaggaaaagaaaagaagagttcaagtaggaatataatttaaaattaactaaaattcagaattaaatataagcaatattaaaatataagcagagtagtggcagttgatgggacatctaaaaactattaataaaacaccaaatacaatcctaatga

SEQ ID NO: 42703 - DNA, 1501 bp, Oryza sativa
aaccgagctttggatgctttcgtcgtctcatccttctcggcagcttcacccttcagccaagccagctccctctccagcggcgcgatcctctccatcagctgctcgtcggcgaccggccgcgcctcagccgccgcctcctccacgtcgcttgagagggcggcgtcgacgacggcctgcaccgtcggcgtcccgaccgcgtggaacttgctgcggttctggtcctcgatgaccacggcgacgctagcgccggtgaggatggagaggtcgctggcgcacttgaacagcccgttccgccgcttgaagaaggtgatgtcgcgctccctctcgtcgtcgacgtacgccgcgccggtcctcctcgccctcctcggcatgatcggcgatgaggggatcgatggaggtttataccaaaaagagattttgtgagagaggcgaaccctaaaatggaaatttaataaaagattagtttatagtgatagacatataagctagatctaaaaaatataaacatagctagatctggaaaaaaaattatagctagatctacactcttgtttctggatttaattgcttttaatgttaagtggttccaaatagctagtatatacataattatatagatgcatctaccatttttgttaaaaaataaactatggacatatggctaagcatacatatgattcatgttaaagaagagcatcattatcaaaattaaggaagatgtggctacttgggtaagctggagctgcgaagctccgtgagtttccttcgttaggagataactcctgattttttttaatcattttacgggcatgatacttgatggcggatggcctgtgtatatatatatattttaccgcaatcgttcactgctctattaatacaaacacggtaaaacttttgtcgcctctttaaaaaaatgttagtgaacatctaaaattaactacgtccatatagctccactactctatcaatacaaacacggtaaatcttttgtcgcctttttaaaaaatgggttaatgaagacctgcatctaaaattaaatacgttcatatagctatgcatagatatgaatcatgtcgaagaaaacatgcatctcctctaatggagaacaggatgtttaccttagctagggagattacagagatctctggtggagaaggaaaccattaagcgagagctacaaacatcttgccaccttgttggagaccagtcatggtgagacaggcatccgaaaggagatggaagaaactactaaatgatttcttaagaggtatatgtggctatagcaagaatgagctcgatgaagaacaaagagggggaggccgccttcttatatagggaaatgaggggtgtcataataagaagattttatccaatgtgtttttgataaacatgcaaactatagaaatcctaccaattgtcactgacaggatggtcatccttttacatgggtatggtgggtccatttgtcagtgaaaattggttctaacgaatagtagca

SEQ ID NO: 42704 - DNA, 1501 bp, Oryza sativa
cacagaagctgccaccttaacagcaacatttatatctgatcagatagcaccacatgactacaacaacaaacaatagcaatggtgctagttaatcctatgggatttgtatgggtttttttttaccaatttacttatgcattatgcaggatctgtatgcattctatgttctaaacagatcattaaagtttgctaaagcatttatctggcatgtcatatatgatttcactttttttgaatctctcattttcctctgagcctgttggacggaccgagattggtgcagtccttactataagccctatcattttgcttattcgacgatatatttacaaacaaaaaatagtttgtgaataattttttattgtatatgttcttaacaatttaaaagcaaaggctaaaaaataaactatgataaaaaatcataaaaataaactttaaatttaaggttaaaattttaaattttggttgataagcataagcataagtgaaaagatgaacccatataactacaactttagcagttgcaccgcaactgatggatcaaaaaccaacggcttagatcataaaaaaaatattgttcatgaattactgtagcaaatctacaacggtgttgctataattatgtcaacacattttgtgagtaatcacagtcgatttcttgttcaattgatctcccttgagattcgtgctacaattgcaataccatgtgcattgaacgtctttacatatttcgtgttgcatcgtgaagccaatcaatttaaatttctcatctcgtcagcatgtgttttcatgaaaaaactactacatatataatttcaggacttagatatgtaattttagaacttacattataaatatactaaaattacatatgtaatttagagacttacatatataattttagaatttacattgtaaatacactaaaattacatatgtaatttagggacttacaatgtaaatacatgctgactattttttggtgaaaaatatggcgacataaatataaatatagttactcccaatctacaatgtaccgattactgtagcatcgatggtgcggcatgatggcagagcaaatccgagccgttggttccatcgatccaacagttattatgtgctccttgcagtcattactactacagcaccgatctcagttcctctcgacactgatggatcattcacatagccaaagccactttagggctaagtactgttcctagtaatctaggcccaattaaaactctaacattagcagtaaatgggccgcatattgagccgaaagcccaaagcccaaaggcccacatgcctctcgccttataagtagccgaggcagtgaagccctagccgggtcctcgtctcctcgcgccgccgccgccgccgcggacgccgccatgtcgaagcgaggtacgtgcgagccacctctctccccacctccgctccgtctccttcctccgccgctgcttctgcgtcgctgatctggtcttcgcgcgtgtcggaa

SEQ ID NO: 42705 - DNA, 1501 bp, Oryza sativa
ggcctgcggagactttgcgcaacacgagacggtgggaatcgcggcgccgagcggccgtagtccgtactcttcgtcgcagcttcgccgaggcgccgaggcgtgcggagaagagatccacgccatctcggctgggacgcatcgttttgtcagagcaaggtgaatagtatagccaactactgctccaaaatatctatagccaatctaatagttcattcatacaatagttaactataaaaatatactacactattaatatacggtcacacctctcacacacacataacatgttggagttcgtgttgcagccagctataaatttatagcccgctttcttctctctcttcttttttcttctcgatatatagttacagctggcttatagcctactattgtacctgctctcatggcacagccccagtgccccaggccccaagctcgaacccccaacccgctgtgcgcggcgacgccgtggccccgagctgggcggcgtgcaaactggagaggaatcttctgtagcagatggtccccaagttgccgtgatgccttccgtacgatccagccggcgcgtctcgcggcgtcccggactcatcctccctgcacagatcacacaagttgtaataagcaacagctcttatatatgtgagctcgcgcactggcccctcgcgaatcggtaaaacgacctactccgattcgatttgtctgtttgcaccaagctccagcgaagttcgagtgctggaccgtgtgacgagagctcatgatcatggtcttggcgaagtgcacgcgctgcctggctcttgtggtggtggtgctcgttggcgtggctgcaccggtggtcttctctgtcaccgatggtgagcactcgtgaacaaatactatcagcttgttaatcagttgccgaaccttctattgttttgtaccacgcgaaacctgccgttgacttatatccatagatcgatcctcacaactgcatatacatgcagcagttagttgtataatcattttttttttgaacgaaagttagttgtataatagatctgtttggtgtgtgaatgtctcttttgatccttcctgcatctacagtattatcacctgagttaaatatcagatagcaatttatgaatgaacttgataaggttgacaatgcatatatagatcaggtgcacaccagagaggattgaggattcaaagctcaaatcttctgctgatcatgacagtgaatttctagaaactaacagccaaagccaatctgcagcgatctgaaccactttcatttttagtcatagtaagtagttacacctggctcgttaattctctccgaactctgaactctgtacagcgtaatactgttcttcattagttcactacttcactgcttaagaaaccactgctttgccctttaatcgctgtaatgtcgaagctcagttctgtttcgagctacataatacagcaaagttgctttgcgttcggactttttctagttcaattttcagttccctataac

SEQ ID NO: 42706 - DNA, 179 bp, Oryza sativa
ctcaaaatcccttatattggtacggagggagtagttgattcttgtaggtacaatgagaattgctttgaatatgttattgatgtgcttatctctaatttgatatgctgattcaatggttcaaacggtgtctatcccgggtgaaattttgacccccttttttaaaattttcttgtcaaata

SEQ ID NO: 42707 - DNA, 1501 bp, Oryza sativa
ttatccctcctctccctctccctcttctgggaaggggttgttgtgcacgatctccaaccccggcgtgcgcttttctccccataagtgggtgtgtgagtgcggttgtgaggacatcatgtccgacgcctcctccttcacctcccttgttcttctagttgtatagccggcacagtacccaatcatccaactgcatgatcaattcatgcaaaatcatatcagaatgtgattcaattgtagatcgcctttatcgaataatctttgatcgaagcaagaataatttaacttttaaaatagtgaattgaggcttaccctgagagacctcttcttggtgcccgcgatggcgcggccaatgttggcgagctggtactcacataatccaatcggtcttgacccatcacaggcgtagaacacaagcacaagcgccttcttgatgccaagcgtgtgcctttgcggtgcgacgggctttgtcggttggggcatgatttgttggtgtgcttgcggtccggggtggggagggattgaataagtaccactccctagtgccactctgataggtcccacgagttgaaattttacagatccacctccacaatgatcgacaccaggcgcatgggacgggccccacctataaccatgaaacaggcatcgagaggtggtcctacaccgcaagctcgaagggcaacaacttggtgcaaccgaggaacacgacagtgtcgtttcccgatgccgtgggagggtcggtggtggtagggtgggaggaggtggtgatgagcggggagtagggagcaaaaccggaggagagggcagcgtgaatggagggaagaaggagaggaagagtatgaagaaaagttaggcctcgtttagttagcaaaaatttttgttttgggtgtcacatcagatatatggacacacatttgaagtattaaacgttgtctaataacaaaaaaaaatatatattccgctagaaaactacgagatgaaattattaagcctaattaatctgttattagcaaatatttactgtagtaccacattgtcaaatcatggtgcagttaggcttaaaagatttgtctcgcaatttacacacaaactgtgtaattggttttttttccacatttaatactctatacatgtgtccaaacattcgatgtaatgggtgaaaagtttttgttttgggaactaaacaaccccttagccactggcatgtggagctcacgtgagttccacttaccacatctgtcaaaaccggtcactatactgccgagtaaccaaacttgatatagtattgtgagttagagaatatgctacatatagtatttcggttcagaaatgagtttttagaatcgacgataaattaaggtaactaaaacaaagtgttcctcagtgaaatcatatcatatgtgggtaaaagaggaagaaaaatcacaccagcactgaaacccaatctacccccatccaaaacagcgactcgatcagccgtcgccgctcacccactccgaca

SEQ ID NO: 42708 - DNA, 1501 bp, Oryza sativa
gccaagggaaaatagatgtttaatgcaggcttcaaggaaaggctgttgtttttgcagttgattttatttgaactctttttctaaaaacaactaagtgagtgcttctcaaacgacacggttgagacggtgcgtctcgtccggtcggagtatgtgcaatgtatcagtctttaaaatttaaaacaaggttggcacccggccaacagcttttcaaacggccacccgggccaacaactttcaaacggccacccgggcctagctgatcccatcagctgcagatttttcaaacagcgaacccctttccacaacagcaatttcacaaccagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaaccgtacacccggtacgttccccggtccgcggttttagaaaatccatttagttcgcaagcaccgacccaggtgtcgggttttccaagtcttttgtaaaactcaagttttacccaagaagttgctcagattttaaatttgaaggcgcccttcggtactcgcacagattgcacgatttcagaggcgcaactgggaggttacaagggaacatggtataacaattaacaaaggaaggatcaaatgcaacaaactaggtagatccgccaatctgccttacagacgggacaacagattaagtgcgatcctatcaatgcataatattttgcaagcaacataattaaatttcaaatataggctcaagatgttcaaaggtggcttgccttgctcgaggtctggagcttgatcctcgaaatcctcgcgttgcgggtctttgggctccgaaactacatgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaataaaaggaaaagagggagggattatagacttctcctcgggcggctagggcgcggcccaagggaaaa

SEQ ID NO: 42709 - DNA, 188 bp, Oryza sativa
tctagacagacatattccgctttacaaatagtaggacggaatgcagtgaaaaacagcacaaaataggattccagctagggaacatgaaagtaaatagaaaaattctctaaaagaaagttgtaaatataaagtaatttagcttaaagagaagctagaatcgtaaagcagacagatcgtatgccccgtca

SEQ ID NO: 42710 - DNA, 1501 bp, Oryza sativa
tgcttgagcatgaactgaacaaaaagaaggtttgctgtgctgttgcttctaccacttggcgtaggaataaccgaagaagagtagaaggtccacctcgccaccgccggcgccctcccggcgtcgtccttcccaacctctccttcacggatccacgccggggacctcctccgcccccagtcctctcggcgcggtggccgaacgggcggcgccgcacttggccatcttctgctcgagctagagcagctcggcggccagattctccgccgagggctcgccgaacccctcgtccaacgcagcggtggcggtggcggtcggcctccaccaccgcatccgttcgcaccgcgcgcacggccaactccatgcctggggcctggccacacccctcgacgccggtcatgagacgcgcgcacggtcgttcggggaggacgacgctgggagagcgctgacggtggcgaggtggaggcgccgacgacggggagtcgaggagacggggatccatgacataggcatgaggagagagagagaagggagagagggacgaggaaggagggaagagagaggatgacacgtgggccccatataccggtgggtcccacatttttttaatgaaaaaatgggtgacatattttttttaattcgagtgacacgtaaccgccatgtcagcgccacttggaaggaagaccaggtccataccgccacgtatgcgtcacgtcagcgaaaccatactccaaaaccgctgagggagtcaaattgtaccggttttaatagttcagggagtcgtcctatccggttttacggttgagggtcacggattagattcaggtcacttttaagggagtcaaagtggacttattccttatatggaggctttgggcacccacattactattttttcccctcgatgtcttgtttggattgtagccactctcaaccttatcaaaatattggcaggcaaaaaattggtataagttggttgttttgtttgatgtaaaaattttggtaaagttagttcaaaggttttctatccttaacaaaatactggcatcccatatttttcggtaacaaaccaaatagcctatgggtactttgctattactaacattttttttgtatgattgagatttgagaatagcgttgaaccaaaacataccccgtaatgtcaacaatgaatttggtatggataagatttaagaatagcattgaacgaaacacacccgtactgtaggctactttcgtacgacaagggtgtagcgatagccatttaattcaaaaagatacgcatccaataaaattacctgatctcaatagaggccgagtttaggtccaaactttttcttcaaactttcaacttttccatcacatcaaaattttcctacacacataaactttcgacttttccgtcacatcgttccaatttcaaccaaacttccaattttgacgtgaactaaacacacccagaactatggtaggaaagcaccaaacacaaacaaaaacaaagggg

SEQ ID NO: 42711 - DNA, 665 bp, Oryza sativa
agatgggccgagagggattcggcccatcgaccccgggggaggcaaaatagacttttgcggagggatttgatttggaaggatttggattcggaattggactcgacgatagatcggggattgagatccgggatggcacggacactagacaacaagcaaggaaacaaatttcgcaattagggttttttaagagataattttcccgctatgcgccacgacggaacgggcgctacaccttcgaggctagcctgtttgaaaagatattttttatggtgcttgttaagaatactacacacgtgacgtagtaaaccaatggaaaataataggggcaattataaaattttcactggtttattcaattttataaggatgtcactcgaatgataattctactgacattttataattttgtttccagtgacagtcttgtaataatgatttaaaccagtggtaaatttatgattgtcccaaagtaatgttatctttaagatttttatttttgtactctttgttaaaaatataaaacgagttgaagtgatcgaaacgatggaaaaagctatgtatctactttgctcggaattcatctttccactataaactacaaaattggttatttttcacaatatttgttagataaatgttttttgatagcacaagctaaataatgt

SEQ ID NO: 42712 - DNA, 237 bp, Oryza sativa
caccatttgtgaggacatacttgatatttgtgctgtgcaatcaaccagcacttcagaggtaggcacttcatctcatctatcttgcaagccaaatcttatgttcttttcatatagctgggtaattgatatgggcacatttattcttgagctatgacatcctttcttccatttgtaagaaatatttgttcaatgcatttgttcggccacagagaatttgatgagaaattttattacagg

SEQ ID NO: 42713 - DNA, 1501 bp, Oryza sativa
attcataactttttcatgtgaactctaatgaagacaatctttatatcaaaattgtagctctagacgtgacctacaactttatagttgaaaagtttttgaattaaaactgtttagggtcccaaaatattgttgcatgtttatatattttgaaattttaattttaaaattacattttgggacaaaaaatgacttaaaataaaaaaaatcaactacaaagttgtagatcgcgtcgaggactgtaagtttgatataaagtttatcttcattagaattcacatgaaaaagttataaattatttttaaatataaagtttttagacagttctatttgacccagatgatattcaaatacaagtttagggactggggtgacacaactgaataagttagagtatttaaacgagtgatctgcaaatttagggaccaggataatactgtcgaacaagtttgagaacctgaacagtcgatttgctagtttagggaccgagatgatacaacggtggaccggtgatggactttactctttctatattctaactgctcctaattgattatgcaactacaccatcttttatattggattctcggatgatattcatcctaatatccaatatccactcattagcagtttagcaccgagactttgagattaggccaagtcaaagcggatccatctgctcatcccggaaatgaatccaaccctctaaacccggaaaccctaaaccctctaagagcacgaatgcacgatgccatttccactcggtaaaaaaaaaagaaaaaaagaaaaaaaaaagagcaaagcaaagcaacggcttttcgcccatcggaaaaccaagcacgacgacgtataaaatccacgtttttgagcgcgagaaattaatttctctcggtattttcttctttcttctctctatactccagtactccaccctccaggagcagttagcttctccccctgctttctgctcctgacgcgagagcaagaagaagaaaaggccatggcggagaagagggcttcttcttgaggtgaggttggttgctcgcttctcttctcttctcttcctcctgctgccgattcggttggcgattttgctcgagacttttttttttcttcttctttgttgcgagtcttcgcgccgctttaatccggagagcatttggagtctgacttggcttccactcgcgcgcggtttaatccccttttttttttctatttttttcttcacttctgatgatgatttcgtgctcttctccctcatcacgatttcttggcttgcaggcagctgcttcgctttcctcaccccccaaatcgcgccagaattcgatcttttccggcggcggctggtggagcgcaagatcgcgctgcgcgtttgatgggcaaggcgtgttcttggtggagtttcttgggagccgcctctcgtcctggatccgtggcggccggcgacatcctgggccggggagggtttctcggatccggttcttgctaatccgatcggaatccg

SEQ ID NO: 42714 - DNA, 1501 bp, Oryza sativa
tagctagctacctccatattgtggacatggcatctcgatctccccatgtcaccgtatatctaacaaccagatctttctcgtgcacgtatagaatatctcttcccttctagctagttaattagcacctagacgactagtcttggacgtgtacaacatcaattatatcaactaatagctggcccaagataaaaagaaaaaaaatgcttcaactaaactgaactctcatcaggaaaacgtacactagcagtcgtgtggttgcatgaatccattcattaaagtttcaatcttggtgcccatatatattatgcatatgtgctttcaattatattagatccattggggctaaagatttgtcgtcggtcttcatctctttgagaatgttagaggtcacacttgcgggtacatgagtgtggtgtgtgtttagtgtcgttccactatcccaagacatctcataagtgtcgtcttaatgaacatcagcgtcgacgtggatgattccaaccaacaaaaacgaataaaaaaaccaacaaaaaattagccacataatcaatctttaacaagtcaaaacattaatcatattggaagaacggaaactaaattacacagagaaagggtgtcggaggccgagataacccttatcgctactgctcactgtggtggagaagtccgcccatcctaatatatctgcagcaacctacatctgccaccgttgagctagcactctaaactcggacaacctcgcatctggcggtttttgagcttgtggcgaataaatccagtagctcctgagccctagacgacatgatttagaaagagggggagggagccaccatgccaacgagagtagggagcgctcgccgggtagagggggatcgaagagaagtgagagaatgagagacagagagagtgaggggggagacgatggggctaaaaagttcttttgcaggctctcggtttggctcggcttagattatttacatcgattcatttaaattacggaactaatagtttttcacattttataatctattataattctgatacaatgctagtttttgctagtacagagcgcacacaaggttgggtagggtggacgagaaaccccatcaatgctactcttttttaactattattgataggaaatcatatttaacgtattatgtagtagtatatgtgtatgtgttttatgtataataaaaaaaaataaaatgtgacctagaccaatcacttcatgacactactacagaaagggtttttgcgtgcgggccaaaaggcatcttcctatgcaaaaggccggcccacacacccaagaaagtttgtgataatcatattttcgcatgtggtcggcccaaccgcacgtgaagatacattatcccgtgcagtcgacttaacgcgaccgaacgggaagatgcatcatcccgtgcggtcgcttaagtggaccgcacgcgatgtggacgcattatcacgtgcggtttgttaagaggaccacacgcgataatgcatc

SEQ ID NO: 42715 - DNA, 1501 bp, Oryza sativa
ctgaaggcaaccacaatggttacgggtggaacacggaaaagctgacgagggctcttttttttttgtgcaaatcctgggttcgagcccaggaccagcggcttctcaagtggaagcactaccgccaagctaacagcttgtttgcaaaagaacccatttatattacggacaatatggttgaaacagattaaattcacagatgcttttgtggtgcatagtaagtgctgacaatcaataagtattaaaaaaactaattgatctaatatgcttgtttttttttttttggaagagatggttctgacatcttccattaagaaatatcattacaaaatgccagataatctggaggattttcattcagtgacttttcggactatgtctaaccaggttctgttataaatgaacttattgtagcaagtcaggatcaattttcccataatgcattccaacagtcatgagaatggaggggatgggagatattagtaaaaacctttttatctttgcttttcttcgaggagctgtggtcctctttctttctctttccactttcctttttctgcacatcaaatgcataatctcaaatcattgcttggaaaaagggtaacaagaccaggcaccatgataacagagttgaaggcgcatatgctacatttattactcacattcatccatctacaacgcaaggccacgtctcgaactgttttgtctggcaacttcatggctatctttgcataacgaattacaggagcatcagatgcatacctgagagcaagcaccagagtaacatcagagcaaaaacaaaggccctcaaagctaaacaatccatgacgccccctcacaatgttgttttcggtgctactgtcattttgatggcaacaagacgtgtcggtgccatgtggattctacccattatgcaacgaccgagcattcacataatataccgtacaacaaaatagagcaagtcacataatatgctgggaatagaggacgaaaaaaaatagtctctcaacattgctacattatccacttgtctaaacaaatgctactggtagcttttacagggcagaaaaaaatgacatgcaaaattaagaaatattacataattgaaaccctaaatggagccgtcgtacagttacaatcttaattacccgacataatccaagcaattgtatccaaaactcggaaaatcagtacccatacgcaccccctaatccgaattgccaaacccccaaatctgcatgacgcagcgaagcacgcgacttacttgacgagcaactcgtcgagggtggactgctcttccggcgaccactcccgcgccaggccggggtcgtgccggagcgccgccaccgtgccgccggggctagggtttgctccccctcctccaccatctcctcctccgccgccgccactggaatgggacccgttctgcgcggcggcgctcgccggcggcgggtggccgttcgcgcccatgccgaccaaactgggcgcgaattttcttgctccc

SEQ ID NO: 42716 - DNA, 1501 bp, Oryza sativa
ggcggaactcctcagtgcacctggatggctgcacatgctccacacggacatggatcctcttctgataatgcggttcccaacctaccaagagattaacaaacaatcagtaaaacagatacatgatttcaaaaattaaataatcccgaagactacatatccacatgactgaacattacacatgccgacagctaactacatatctatccaatttatctacaccaacagaatgtgtttagacggtagcatgttatatgattgaaacatataactacacatgcacacaggattaaatgaacaatcagaagtatatctttaaatgcacttctcataactacatcataaaaccaaacggttaaactttccacataaccgataacaatacaatcgacgtaaacttgaggattgatttgccactatcctacttggacgaatggaaacctagaaatgaaatgaaccaaagccacaatcacaatagctctacttcagtacacaacattctcaatacatttaaagagaaaacaaaatccaaatactaaagcacaaagtaaaatcgcacaaatgttaccagtaaatataaccagtaaaccatctagactacactatttatcagatcttacacaaccatgcaagagtatgcaatggcttcccattcctgcaactgcaaaaatgaaatttcatattggcacaactaaactacatgattccaaagtcacttggggcaaaaacatgacaccaagtcacttaagcgacacaaccacagatctatgacaaagaggcggcgccgccgccggggtgtttggggatcgggggttatacctgcttgttgatctcgacgccgatggcgcgcttggtgacgttccagacgcggccggtgcggccgtggtagaacttgtgcggcatccccttgtgcacggcgccgttcaccttgacgtcgacgtgctcgccgatcttgtaggtgcggaggtaggtggtgagcgggatgtaccccttcttcctgaacggccgcgcgaacaggtcgcgcgtccgcgcacgcagcccgtggcccgccggcatcctggcggctcctcctcctgcttcccttcgcgcggcggcggcggcggcggcgggtgaagaggtggggtgagcgtgtgtgcggcgctagggttcgcgagggtttggagatagtgctgcattttatagttgcggtttaagcttaggtttgcgtcttgccgtggcggagttgggctgggctcgcaatgtgggccttttatggtccatgaaacaaagtctatagtacatcccgaattaaggcccatgagctgttcgtcttcgtctggctctcagccattctttctgtgcgatccaaatgaggggcttttctgcagaataaagttgcaaatgtgagggctcttctttcctttctttgtgtgtttttaagttataaagtgaacttgaggtgtgaaagaaatatatttgcatttttttgttgctgtactggcatcattgttagctcaatcctact

SEQ ID NO: 42717 - DNA, 866 bp, Oryza sativa
acattcaggtatttgaaaatcaggatttagaaaatacaagaacatgatgccacacctcagtgaataatatggaaagtaaatacacaaatttgtaaaataggatgccacacctcattaaatactatagaaagtaaatccacaagattgtgaaaatgttttttgatagcactatatgaaaaacataggaatttcgagacacaaagggcttttgagtagatgtgacacatcatattactacgaatttggacaagagactatctagattcgtagtactatgatgtatctcatccatccaaaaacacttatattttagtacggagggagtagcaatttctagtttttttttccttgtaggatttccatactaaataactccttagtttttcctttattttactacttaagtcaccaaaattttggtaggttatgttttggctttaatataaaacggtatatttgcgcctctttatcctatgttgatgatcgagttaattaatctctatcccgcatgtaatataatggattctcttttactacaatcttagagccaaagccaaaaggaatccattacatttctgagcatctctacactcttctggatgtactcaagaatctacacatacatatatgcgtaaacaattcattggtggcccaagacataaaaaagaaccctagagctctagacagacatattccgctttacatatagtaggacggaatgcagtggaaaacagcacaaaataggattccagctagggaacatgaaagtaaatagaaaaattctctaaaagaaagttgtaaatataaagtaatttagcttaaagagaagctagaatcgtaaagcagacagatcgtatgccccgtca

SEQ ID NO: 42718 - DNA, 1501 bp, Oryza sativa
gatgaaaaaaaaaagagaacatcagcacttcagcagggttgtacttgtaaataggcaatgctgtacaaatagatgactcaatttgacaattcagtaaatgctgcactgtaaatgctaatttcaaaatgactctaaattcaatttaccttggagatgagcctcgtgttgaggcccaggcgggcggctcctgtcagcgcgttcccggcgttgccacctccagacacctgcaacaatggcgaaaccccaagaaatcgccaggagcgaaacgtcaatcttttccccatgtttcttggtgaagaactaaagaagtggggggtttggtttggtgtggtgtgtcacctgcagctcgccgctgcggatcttgtcgtcgggccgcgggtacgcgtccaccgtggcgaggtagtccagcgtcaccagcccgcaacccagctgcaagaagaagaacacctcacgccaggagtcaggtcaggtcagaccaaccaaaggcagcgggagagcagagggcgcaaatcacagtagctcaccacgacgcggcctgcggcggcgggagcagcggccggcgccccggcggcgcagcggagaggagggagccgctgcggcggcgcgggagcagaggcggtgacgccgccggcgagcagcccaggaggagcggcatggtgagagcgagtgattaccgctcgctgctgccggtggagccgacgagagttgtttggtgggtagttggatggatcatggatggctcccgttgtcattgtcgcgtcgtcacctctgattgcgtcattccatttccatggattgctcgatcagttcagacattttcgagttgaagaaaaagtttagaaactttcacctcaaagaggggagaattccatctcaaagaaagaatttccgaaactttcagtgcctgtaatttttatttaccggcatccaaatcccaagaactgatgttcttatcagtgaagtttgcagacctatcttagacatgcatggttcttagaaaaactgaacacatatgtcgaaaattttttgggactcttgcctttttaatttcaagtaggattgagctaacaatgatgccagtacagcaacaaaaaaatgcaaatatatttctttcacacctcaagttcactttataacttaaaaacacacaaagaaaggaaagaagagccctcacatttgcaactttattctgcagaaaagcccctcatttggatcgcacagaaagaatggctgagagccagacgaagacgaacagctcatgggccttaattcgggatgtactatagactttgtttcatggaccataaaaggcccacattgcgagcccagcccaactccgccacggcaagacgcaaacctaagcttaaaccgcaactataaaatgcagcactatctccaaaccctcgcgaaccctagcgccgcacacacgctcaccccacctcttcacccgccgccgccgccgccgccgcgcgaagggaagcaggaggaggagccgccagga

SEQ ID NO: 42719 - DNA, 469 bp, Oryza sativa
ccagtgcatgtcaaatacgtacgtacgtattcaggtccagccgagccagagccagccagccatatgcacagcgccacaggattttattccgaacaaattgtatgagaacatgtacatgtatgagaacatgtacatgacgcgtcagcccaagccagtgtcaggactcaggacgagctgggacgagtaggcgggcgcgaacatgaaaacggctgtttgttccgttgtgcagcaggcgacgtagagggagagggaataatcgtatgatcgtcgttgcgaaatcgtgcgatgcagcgggggagaagagaaggcggtttatgtgtacaacagtggcgcgtgttaggatagtggacaaacgatcaccaggggaaaaaaaaaaactagcacccgtgacacctgaagatgccggcgatcgatgctgatggtgatgggacgcgcggaaccgaagctagctagtccaccgctgccatga

SEQ ID NO: 42720 - DNA, 279 bp, Oryza sativa
atctttagtcccggttgataatatcaaccgggactaaagatcctatctttagtcccggttggtgttatcaaccgggactaaagatatcggggggcctgacaaggcctgacagatttagaaccgggactaaagatcatttttagtcccggttggtaacaccaaccgagactaaagatcaaatatgcccgctgtagccaccaaccgggactaaagatcatctttagtcccggtttttagtggaaccgagactattgtggatttcgggcgaccgaccaaaga

SEQ ID NO: 42721 - DNA, 1501 bp, Oryza sativa
caaagccctgtgcgccttttattccaggcggcgcagcagcagattcttcgtttttcttgtcaccgatttttttggtttgaaaacctcttgtcaccgattaatcctctcttttttttctctaatctcgtttgctttggggaaaatggagggggatggcgtgaactcaccgcaagagaggagcggaaataataagttgacgcgaccgtatcgtgagtgattaaaatttgtggggttagtgcgtgaatcttgatgagtgtttaaatttgatgcaacttggtaggtcagtcgtggatggttgcgagagggatgcgttgatgcgttgatttcttttttttcagatttcttttttgcgataaaagcttttgattgtatcacctgtctacgcacctaatgccacatgtttgacaaatcggagtcgccgcgcatcctcttcccactgaacttatgtatactggattaataaattagaggtttgtcaaattgtgtttcgaagaagaaaaaaattcgctagctcctgcgatccagtgcgcggttctgcggctgtgcatgattcgcttggcattcgtttgtgccgtgcgatccagttatttcgtgccgccgcgcgtccagtccacatcgacggccgctcggtgacggccgcctgtgcttcgcgaatttttttaggattaatattatttttatggaaaatcgcaaaagtagtggccaaccggggaaaatcgcgaaagtaggtccctgtcgaacgggtgcaattcgatagggcacctatcgaacgacgggcagtcgacagagccctgtcgaacggctggcgttcgacacgctggcctgtcgaacggagggagttcgacagggcccaccaccccgcgccgccaggcctgtcgaaccgggggcgttcgacaggtccctccaccgaccctgtcgaacaatgggcgttcgacaggccggtttaaagccccgtctccccagctcgcgatgcttgttcgatttatttgaggaccacatcgccagccgccgtcgagagtcgccacatcgtcgccgtgagcgccggagggagcgaggggaggggatagcaggccggagaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcagga

SEQ ID NO: 42722 - DNA, 1501 bp, Oryza sativa
tgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggcgctcacggcgacgatgtggcgactctcgacggcggctggcgatgtggtcctcaaataaatcgaacaagcatcgcgagctggggagacggggctttaaaccggcctgtcgaacgcccattgttcgacagggtcggtggagggacctgtcgaacgcccccggttcgacaggcctggcggcgcggggtggtgggccctgtcgaactccctccgttcgacaggccagcgtgtcgaacgccagccgttcgacagggctctgtcgactgcccgtcgttcgataggtgccctatcgaattgcacccgttcgacagggacctactttcgcgattttccccggttggccactacttttgcgattttccataaaaataatattaatcctaaaaaaattcgcgaagcacaggcggccgtcaccgagcggccgtcgatgtggactggacgcgcggcggcacgaaataactggatcgcacggcacaaacgaatgccaagcgaatcatgcacagccgcagaaccgcgcactggatcgcaggagctagcgaatttttttcttcttcgaaacacaatttgacaaacctctaatttattaatccagtatacataagttcagtgggaagaggatgcgcggcgactccgatttgtcaaa

SEQ ID NO: 42723 - DNA, 1501 bp, Oryza sativa
ccagggataggcgcgagaggagcacggaaacgaggacgagcacggcgaccgccggccttctctcgccgccgcaccaagccagtcgccggcgccggccaccgcgcggtgcctctagccgccttcgcttgccggcctccgcgcggcggcgccgcccgctgcctccgctctgactcggccgccggcctgcgcgcggcaccaccgcctgccgcctcggctggtcgcggtccccggcctccgcgcggcaccgccgcccgccgccccgcgcggcgccgctcgccgcctcggctcaccgcggccgccggcctctgcgtggcgccgccgctcgccgcctccgctcgctacggccgccggcctccgcacagcgccgccgccgctcgctgttctccgccggagagaatgcagtagtccagctggagggaggaagaaacataagggtcccatttgtaatagagttgtaatagagagggtagatggagagactgttgaagtgaacaactagtttgactagccaaatcagatggagggttggctatgtgggtgtttggagagttcgatttggagaggctgttggagatgctctaatgtcacggtgtgacattcctttgatccacaccatccattctaaatacggtcatagattatttagcatgcaattaatcaaactaattagtagattatgtagttaaacaaattccagtagaccaaatatattatcaaggaggcaaatatcgctaaatgctacaggaatcggcaagtaactagcacatgacgataattaggtttaacttacctattagacgcaatgattagcatatgaacctgttaaggaatgaatctcgtgcatcaattttctttgtgttgccacatcttccataagaaaaagacaattctcttaatctacaagttggtgggctcatgttaatgaacatgaagggactactttagtgctaaaaaaatttcctactcattaagtatggtaatatttaactacataatctgctaattaatttgattacttgtatgccaattaatctatagccattgatttagtttggatggtctggattcaagaatatcacaccgtgacattagtgtgtaatatcagaggatacagttccagcacgcacatacgcgctagcaatttaactgtcgcgcgcgtcagttgggccccctcctggcgccctttttttcacgcgtttcatttttttcgtccgattttggcgtggtgtttttcttcaaaaactttctcctttttttatacataggtcgtcgattccacattggataaaaaagggcaggtgccgcttctttccaatttttttcaatctttcgcacaactctttacaaatatacaattgaaagtttttaattttgacttaaaagatttcaaatcttgacttgaaaggattcaaattttgtgttagaaagtttcaaatttgagttaaaagttttcaaattttgagttaaaagtttttaaatttgagttgaaagttttcaaatt

SEQ ID NO: 42724 - DNA, 1501 bp, Oryza sativa
gcagccaacttacctgcagaaaacttctccgacgtactatcagagcatacatcaggggtatactttggctgggctggactttcaacgcgaggtatatttaagatggtcatgagcattggctggaacccttattttgataacacggagaagactattgtgagtgtttctcaatacatcccctttcatgtttagtacttcagtatattagtttattctaaaagacattggtcacaggaaccatggttgcttcacgattttggtgaagacttttacggagaggagctgcgccttgttattgttggttacatacgacccgaggtaatttaggaccagactatttatactgcagaagccatcccactatatgttgatgcatgttcctgacttgtcacgttgttatgaaaatgcctaggccaactttccttcacttgagagcttgatagagaggattcacgaggatgcaaggatatcagataaggccctgaatttaccattatacgccaagtataaagactcgccgtacctaagaaattccttgaaggaggacaattctgctaacgggaaccagtcagtgatagattccaagtgattcaacgttgtgaagtgaaagacatgaagaattctctttcgcagcgttgttgatgcagaaagagcactactgttcttgtgcttgtactgctgcattatgttccatgaatacttggaacatgctcttgactacaatgagaataccagtaagggtctatgttcgtcagaaagttgagttagaagcagccaactactatcttctcaaatggtcacctactcctagaatggaatgcacaagatgtctgaaaatttgcacgtgtgttgtggctctgaccatgtgaagcttaggctgtctatctaacgttctgaattaacttttctaatatgcattgagattggtatttcattacagtgtgtataaagatatactataaagtactactccattctagaaaaatgcaaatcctagctacgaacctggacacgcatatgtttaggctcatagctagaattggattctttttggatggaggggtagaaagcaaataaagctcggttattgttggttaccagctacgagaacagtttcacaaccttcacaaggaactcgagaaaacacgatattgctcattgtcagttgcgagggcacacggcaaacggcaaagcttctcccacggcaacacacaaatcaggccaaagcctctttgtcagtagtagtcgcgttttgccacccggaagcagcaacttggcgatcgagagcttcgatcgcttgctcctcgatccgttgccttttgtgctttttttggcctcttctcatcttttgctcgccgtgaacgccgagacgaagctaaagccgccccggtgatgacgccgacgcccgtcgtgacgcgcgcgctgccgtctccgccatgggaagagcccgcgtgcggcgacgagcgatcgaccgcgagcgaagcgcgcacacgcacacgaa

SEQ ID NO: 42725 - DNA, 1501 bp, Oryza sativa
aggatgggatgtgcgaggcgttggagaagttgtggacagcatcaacaagcgggtctgcgaatgcagcagcaatggcactgccgagaagcaggagtcccacggctttggtgatgcaccagccagggttctcaacgctctcaactgtctcgtcagatctgtccaccagaaggtcgtgttcctgccttgttctctgcagaattcagacattttttcagcacttaaatctctagacgtctgagtcacattcctatatctgaatcttttcgtgtatcgcctgtctaagttatgctacttgatatagattttcagaaactaaagcactagaggaaggaaaatatataccgcatggtaatcagtgatgaacttattggaataggcaccactggtagggacgctgcgcttggcctcattaagccatctcttcatccccgagacaaactctgcctcctcgacgatatcattgcctgacgtgtcaaagtcatccatgatcttgtcaacagcgtcattcttgtcaaagtcaacctcctcaaagttgataccaatgataagtgcatgaagctcagcacgggacagggtttggctctcatccatgtcaatcttgtggaacaacctgcgtgtgaggatatacaaggttcatgtcaagttcacgagctttctgttggcatatcaagagaatcaaaatgtctaagcacccacttttttatgacatcttcattgggtgtgccatcctcattaagcagccgcccgagcgcttccatttgggcatgcctgaggattccggagatcacatgcttgtgttttgcgtatgcaagcttcctcttctgaatccatggctggaaaacctgatgcaaaacgcagaacctaacagtcaaaatctagagacaagagtttccaatctatgccatcgtttcaggaggctcaagtgtccttaaacataattgtgcttacctgataaaggcaataggcaagcacaagcgagaatgatacgataagtgccagcaagacagctaggcgctgtccgtggtgggtcttcaacattttggggaattgagcaatgataaagggaataacagaaatccccatgatccgagctgcatagctggtttggacatcagttgaaataccagtgcctgcaaaagaaaatttgtgcatcttacattcaatatatacagaaccagtaggtcaaagcagtgtaaaggtaaggttaacatagtggcttgtggtttttaacatgttaaccagaacctccaaattgaatgcatccttacaaagaagcagacaaagatcagtgtttgtaatttaaactccattctactttaggatttagatgtaacaggatcaacaattatcagaaagactacattaataacaatgttaaatacaagaaggcaatttaccagtcaagctgaagcccttgttgttctgtaaatcaactgcaacgccatttggaccaatgtcacacttgccaacaacaacacaggttccccacagaagggtgaga

SEQ ID NO: 42726 - DNA, 739 bp, Oryza sativa
agtaactacctgacaaatttataagtcttcttggttgactatattccctaataagccacttattaggaaataaaaattaatttatagataaaaattttatatatttattcttagcgacttaaaaaccaatgctgaaaaagaaactaagttaagtatatcttaaatcaacttcaaaattaagtttaaaaattcaaattttggcttttgctctagcttattagcccaacagatgggcctattgtctatgcagtgaacagttccatactacggcacagtaagataaaagtttacaaaggttaccattgtgatttattaaggcttgctgccaagatattattatcaagattcctgtttataatttgcttatttgcacacgctactttatcctggcaaatccattttattctgactgtgatttagtgatgcctatattttgttggcgcctacaatacaatgtagatactactagcatatctgcttatgaactacagatctgcaaatgcaatggatctcaaataattatgcccacggttcccacattagatgcgcacgagtaattaaactctctgcaaaatggttccagaaatgccaacaggacaatgaacaaagcctagtcagtttagcttcaaattcaaacacaaccaatttgcaaggaatagttaatttcggagcaaatactatcgaacaacagaactgcgcagaacattcttcagaggtagtacatggctgatcacaaagg

SEQ ID NO: 42727 - DNA, 1501 bp, Oryza sativa
aaactggtgactctcagatactagcttaagaaaagaattaacgtcgagctaatcaccgttatacgtgattggtcgccataactctacaataggggcataggtgctctcccctaccacaactccaagctactagccacccacgaattcctagtcgtccatgcagaaagggattgatgagattgagggcgaaagagaaaaagatccacacattcctctctcgtagtatcaggtgctcgcaccaaagcattattttaaaattctagttttttttcttttgtgaaacctcaaattatagatttgccttgttcacaatttttcaatgtttaagctcatggtaatttctgcacacaataggccaaaatatggtttcgcaccttccatagtttttatacgcgtatgtataacatgtcatagtttgattgtttgagtgtggttacttggaagagaaaatcccttatatacccctgaaattttacctaatcccttctatacccttgaattttgcttacttccttgtgtacccctaaaatttgattttgatcccttgcatacccttcccgtcagttgaccgtgtattttctataaaaatgactattatacccttggatgaagaaagaaattcatgaattacattattaaaaatataaaagcttctcgcatgagactattatagttatgagtttgttgtgcgatgtattatttatcccaaaaaatatttttagataatgaaatagaaaaatacgtatttatttttttaaaagaagtcataaaaatgaggggcattcatataaagataggactacccatgttcacaacattttttttatgaatgctcctgataaaaaaatccattgtcctattaaaatttcaaataaaaaatttaatttattacatttattttattttcaaaatttatgtcaaaattttctgcactaattatttagtcccattagttttataaaatacacatactgtgcactcaaataaaattttcaattgtttttgaagcttatatttaaacctaaagcatcaagggtaaaaatgacatttgcaaccaaacgtaacagtgaaatgatggaaaatgtaacggtgagggcatacaaggaatcaaattaaaatttcaggggtatagaagggatcgggtaaatttcagagatataaaaggaattaagtgagttttcaggagtacaaagggaatttactctagttggaaaggttaaagcgtacagatcgctaggtaaggaatgtataacgaaccactttaaccaaggcgtacatatgatcattggatccggctcttcagccagacagcctctccttgccgttgatccacacacacacaaaaaaatattactatattataaactagtagtactcctactaaattaattaaggaaagaaatacataaatcaaatatcgcacagatcgcactatataaagctacgcgcaccaaacccatccctacccgagaagcccctcgcctccggccgcctcccgcaa

SEQ ID NO: 42728 - DNA, 1501 bp, Oryza sativa
aagagccggatccaatgatcatatgtacgccttggttaaagtggttcgttatacattccttacctagcgatctgtacgctttaacctttccaactagagtaaattccctttgtactcctgaaaactcacttaattccttttatatctctgaaatttacccgatcccttctatacccctgaaattttaatttgattccttgtatgccctcaccgttacattttccatcatttcactgttacgtttggttgcaaatgtcatttttacccttgatgctttaggtttaaatataagcttcaaaaacaattgaaaattttatttgagtgcacagtatgtgtattttataaaactaatgggactaaataattagtgcagaaaattttgacataaattttgaaaataaaataaatgtaataaattaaattttttatttgaaattttaataggacaatggatttttttatcaggagcattcataaaaaaaatgttgtgaacatgggtagtcctatctttatatgaatgcccctcatttttatgacttcttttaaaaaaataaatacgtatttttctatttcattatctaaaaatattttttgggataaataatacatcgcacaacaaactcataactataatagtctcatgcgagaagcttttatatttttaataatgtaattcatgaatttctttcttcatccaagggtataatagtcatttttatagaaaatacacggtcaactgacgggaagggtatgcaagggatcaaaatcaaattttaggggtacacaaggaagtaagcaaaattcaagggtatagaagggattaggtaaaatttcaggggtatataagggattttctcttccaagtaaccacactcaaacaatcaaactatgacatgttatacatacgcgtataaaaactatggaaggtgcgaaaccatattttggcctattgtgtgcagaaattaccatgagcttaaacattgaaaaattgtgaacaaggcaaatctataatttgaggtttcacaaaagaaaaaaaactagaattttaaaataatgctttggtgcgagcacctgatactacgagagaggaatgtgtggatctttttctctttcgccctcaatctcatcaatccctttctgcatggacgactaggaattcgtgggtggctagtagcttggagttgtggtaggggagagcacctatgcccctattgtagagttatggcgaccaatcacgtataacggtgattagctcgacgttaattcttttcttaagctagtatctgagagtcaccagtttcgtggtggcgggttttttctttttttcctgattgtagcatttcagggttgtaattttatttttttaatgctacattaaaatgaaatctcacacctatcttgtgtggttcgtttcaaagagaaaaaaaaatacacgcatcatgtcagccatttctccgctatcttttctctctcttcacctctgatcccttctctcttctct

SEQ ID NO: 42729 - DNA, 1501 bp, Oryza sativa
tatagaaaagttgcttccgaaaatcatattaatctatttttcaagtttttaggctacacttaattaatcacgtgttaataagcaacaccgttttctatgggagtacttttcaggtcactcatgttccagctgattggcgctgcatgtgtccgcacagtaggcaccttgtttctataattaataatttggagtgatctgatcctgaggaatagatctaccactctcatccaacagatcagcaggttcatcagttattttattattattattattaaacttattttttagatcttaacttgtgccgttagtccaggacaatccagtgctccatccatccatccatgtgctatttcaaatctatttacaaataggcgagttatgtatgccatcttagcaaaacacaagtaaattcccaatcccgttggttattcttttcaaaaaatggattgttgttttttttcattatattttttttgaacaattaaaataaaactccctctaaaacatatgttgtttaaaacagttgaattgacctgcgcttagtagaatttgtgtgccaaaaacgacaattaatattcaccggaggaagtaactcgtctatgtaccaactaaagatattcacaaccatatttatgaaaatcaagctttaaatcccaataggtagacttaaggctttgttcgctactcttggttcccaactctcctatctcgttttccgtgcgcacgtttttcaaaccgttaaatggtgcgttttttaaaaaaattatatatgaaagttgtttaaaaaaatcatattgatctattttttaaaaaaaaatagctaatacttaattaatcacgcgctaatggaccactccatttttcgtgcgcattgtttgggttgggaaacagacctaacgaacgcagccacctacaaccccctaccacactttcggcatttccccggattaaaagagaagggcgaagcttagtaccaggatccaataaccctggtgtcctctatatgaaaccccttattacaagaaaagataaaatcatgagaattcacaagtagtgtatggtgagcacggttcaattcctcgtctacgcccccaaagagtttgttagtgcaaaagggttttctaaggctggcatttggttgctaaagttcgtcgtgcactctaaaatcttagtctaatgtaccatctgttctatacacacaattagctaaatcacagtttagcaaacattttctgggcacacaactgttgtatggcactctttgccaaaaagacaaaaaaaaagaggttaattggatccatgccactgcaaatatgccaattcgaaaaaatatcactactatttacaatatcggctacgtgccactggaatttgggaaaattggaatcatgccactcccatccagttttctgtcaacctccatcatctctctccctcttccttctttgcttcttcgccatggatgccggtaagccctccacctcggactcgctggtccttg

SEQ ID NO: 42730 - DNA, 335 bp, Oryza sativa
ctatagggcgaattcgagctcggtacccgtaccatttgtcttattcaattttttcacacaaatatatatatatatatatatatatatatatatatatatatatatatatatatatatatatatatatatatatatatatataaataaatcatgcttaaagaacatttaaagataaatcaagtcataataaaataaataataattactatattttttaataagacgaatgatcaaatgtattttaaaaagtcaacgatgatatatattaaaaaaacgaaggagtactatctctagcagtatacagtaagtactttggcagtttcagcttgcaagaa

SEQ ID NO: 42731 - DNA, 1501 bp, Oryza sativa
tccaaacacccacatagccaaccctccatctgatttggctagtcaaactagttgttcacttcaacagtctctccatctaccctctctattacaactctattacaaatgggacccttatgtttcttcctccctccagctggactactgcattctctccggcggagaacagcgagcggcggcggcgctgtgcggaggccggcggccgtagcgagcggaggcggcgagcggcggcgccacgcagaggccggcggccgcggtgagccgaggcggcgagcggcgccgcgcggggcggcgggcggcggtgccgcgcggaggccggggaccgcgaccagccgaggcggcaggcggtggtgccgcgcgcaggccggcggccgagtcagagcggaggcagcgggcggcgccgccgcgcggaggccggcaagcgaaggcggctagaggcaccgcgcggtggccggcgccggcgactggcttggtgcggcggcgagagaaggccggcggtcgccgtgctcgtcctcgtttccgtgctcctctcgcgcctatccctggttgcctcgtgtggggatggagccatggaggagtttggctgtgtgggacccaccattggccagccaaatagaatggccaaatttagctagtgaggagagggttttggccagccaatcggggttagccatccggttagagaggctgttgaagcacgttttttgggtgaatagctaaaatttggcttggagagtgggatggagaggctgttggagatgctcttagtgtgtaatgttagaggatacggttccacgcgggctagggttccccaagtatattttcaatcctaaatataaaattggttattttttcctaacttttaaaaccaaacaaatagcatctatttcttttattagttttgattggaaatggggttggttttcgtaatatattattatgcatgttttgttacatgtagatgccaattaaaacttacctaattgaaactgcaaacaaagtttcgtaattaagggagtataagtaatcaggattatttgtgcatccttaaagtgcagcggtggggatatttattccattattaaaaagcagcaaatttgcaatactacaatcgacgtcgcgagaaccccaacgcgtacacatcagcaaaacacatttcccggtgacataacacaaacacgcccggttattattatttggaaattaatgaaattgatccagagagctcgatcgagatgatcatgcgtcggcggcgcaggcgaggccgcagcgctcgccggcgacggcggcgtgcagcagcagcacgtagaggagctgcgtgaacgccagcgtcacggtgagcccctccagcgcgcgcatccgccacccgcgcgcggcgccggcgggccccgccgcggcggcgtcgtggatctccctgcacgccaccccgaacgccagcgcggtggccgcccacgcggcggtgccgagcgacgccgcggcggcgagcccctgcggccgccac

SEQ ID NO: 42732 - DNA, 234 bp, Oryza sativa
cccccccccccccccccccaaaaaaaaaaaaaagccaacatctggataaacacaatttggagcaccatattggcaaattgctattccaaccctgcaaggttgaaggcaccgggtcgccttcgacgatgtgtaccatatcatcttttccatataaactattccgtacactaattttcttttatcattgacaaaattttattggcacagcagacagatggtcctctgggacccaca

SEQ ID NO: 42733 - DNA, 1501 bp, Oryza sativa
ggtcacaaatgtcagagcaaggcagtcaagagctgtccgatttttatgtttggattggacgaccgattagaagcataccaaatatgaatatatgatatgatgattagaggttgggattttttttctttttgggctttattgtaaatcccattggaacgcatgggtatttagggcctgttcactttgatgccatttttaaccttaccaaattttggtaaagttgccaaaaaataactacatttagtttgctgccaaattttggtaactatataagaaatactaccaaaattttggcaagtggtaaggttttttttagcatcaaagtgaacaggcccttagctagtcacttaagaatgatagaatgtaattttgagtaaaaaactttcaaatgtaagtatagaataactaaagtataattatattgtaactatattatgggcctatttggggagcttaaaattttaagaagcagctagttggtaaccaatttctgagaatttggaaaaattgagtttcccagcttttggcttctagtttattttctagctataactacagcttctcagaatctgaaccaaaagctaaactgttaggggagcttctgattctaggagaagctacagcggctagaagctcccccaaacatgccctatagttgcactataactacgatataacttatattcgactatggtttgattggctagcaccgggatcttacgcttatatgtgtaaaaatttctttgtagcaattttttccttcatgcataaatcttgagatgattcgatggccacaaatctggaagttttgggagaaaaaacttgcaaaagtttctagcaattccattctttaaccaaaaaaacaaccatttgaattcatagtcaaatttattttttataatttgttgaattcgaatttaaaattagattatggagtgatatataatactaacccatcttattaattatttaaatttattagaactatttaattgactctgcatgccaggtgttgggcctcatcgtcggccgcttagtatcacacggccaggcccgcctccgcgcatcgcgtgaggcccacttctcgagctgctcgatcgcgattttttttcatttttaattttttttaatatttacagaaatagacccgcccaagtgaagagcaacaaggtgacgtggcagtgcggcacacggcgccgtgtgcgtattttgcattgaggtcccttgtcgaaacgcaattttcatcgcatgcaaaattcgtatgcccgctcagcggccgttagtggctgcagggtttacttatgtaaatatttttatcggaataatatttttataaatattaaaaaaataaaaagtttaaaaaaaatccccgatcgccgcctctgcgggtcggattcgagcccgtctctctccgggtcgctccccatccccactcccacgtctcccacccactcaccgtttccacccgaatcattccgtcccaagtcccaccgtcccctcg

SEQ ID NO: 42734 - DNA, 546 bp, Oryza sativa
acattgggaggcaaaggagtacgtgccgtgtagactgatagttctactatgtcagcggaaagtagctgccatagctttatatccttcctattcctatattgctgcagtgtactgcgttgaattatctgtgtggcaatatgaatgttgtcgtggcattgtcagagaggaattatttctgttaatgacaatcactgttaccctgcgtcatggtatatgcaactcatgggtatattgttttcatcatttttgtggggatagtctgatgcgatagaatttattggactaaagagtaaaagaccaaaaatatttactattgttagagctttatctacttgccaatcaagtagcatcattctaatttgcattgtactcttacttcagttcaaaataaatgatcatggacctagattctctagcattatttcaaagcaagtcaagtatctagctgccaataagagcaatccatttgcttagcattgtcttgtttgtggtagatggtataggatatgttcatccgcccctgattcttattccctgagagcaaca

SEQ ID NO: 42735 - DNA, 1151 bp, Oryza sativa
ttatcaaatttagtttcattcccttgtaaccttattccagttgtttcaactttctattgttcccccttacaaaggtcattgcaattgtatcttgtggaagcagataagaagttgtctcggtgtaatcttgttttgtggagtcaaatgtttgcttgtgtgttgcttgggaatattttatccgagatgctcatatttaccttgaaagatagcattattgttatatcttcttttacatcaagttatttcctttcgttcgaaaaaaaaatgcataaagttatttgcacgaagagacaggattatgtgaggtcggtgttggaagtacttaaggctctgtagcttcagtcataaatttttttgcttctgatagaaagaatgggaagagcatgtatgtgttgaatacttgaatctacgaacgtctaagcatgtactgagactgaagcactgtaattgcatcttggttattcttgcaagctgatgctgccaaagtgcttcccgcatactgcaggctagtactagagcacagatttccggcagatgtccagaaaagcttccttggacatgaacatacagccaaaagaagtgcttgtaatgctggagacagatgctttactcagtacttttcttgggagcttttaagtgtccaggaaagatagcatccttgattgatcttgttcgacatatcaacgctgccatctttcacatatcaacgctgccatctttcttgttgttcgatttgcaatgaagaggcaggattgtgtgggtgggtattgcaaagtaagaatacgtgccattctgtttatcaatagctcggtcacaaatatgtgttgtttttctgatgaaaataataatagaacacatgtaattaatctacaaacatctaagcatatatgtattgaaaatcgctgtctctgaataccgaagcactgcaggtggtaccttgatccatcatacgtcctagtcattcttgcaagctgaaactgccaaagtacttactgtatactgctagagatagtactccttcgtttttttaatatatatcatcgttgactttttaaaatacatttgatcattcgtcttattaaaaaatatagtaattattatttattttattatgacttgatttatctttaaatgttctttaagcatgattt

SEQ ID NO: 42736 - DNA, 180 bp, Oryza sativa
ctcctcaacactttaaaattttatcaaatccacccatcctcatccttatcctttctatcctctctctgactctctcacctctctatcctctctcactctctcacctctctcacactaccaggcgcagacggcacgggcgcggcaggcggcaccgcgcggctcggaggcgggctcaaggca

SEQ ID NO: 42737 - DNA, 365 bp, Oryza sativa
atgttcttataactaaattagtaagaaatcagaattaaaagcaaggttttcaagctttgatggaaaatgagtactgttcacaggcaatcagtatacatacatattaagcaatgtttagggtgatcatgaaacaattggaacaattaaatgcttcatatttccatatacgcgggcttgctattttgttgtaaaattggaactttgtttcaagctgagattgtgtttaaaattgctcctttggctgtcctcaactggtcacataagttcactcggtttatactaattaaggttacgaactaaatgatgaggccatgtcatcagcactagactgaattctacaagatggcaaaggcaaaatactggca

SEQ ID NO: 42738 - DNA, 560 bp, Oryza sativa
atcaacgtagtggaaatcctggctattgtcgtccaataaagtcataaatttatgcggattggtgatgacttggtgtttcagtgttttaaaaaagtgttctgcagagcttaacggcacccttttttttagaaaaaaaaacattgatttgatgaaagaatatcatatggatatatttaagatcagaacttcataaagattagcccatggacatatgtaagggtcaaaatgtcacttaatttagtatcgaatggtgcaagtttgtatctttcaaaacttcaggagtttgttttttttgcacgacaatatgaatataaaatattggtagagtttcattttgctaccaagcattcatattttatttctctattcttgacctcgcttatgtaggttctaaatttacagtctgtgtgagaatggagtttctcttgaggttaaaaatgatgtttcatcactaatttgtatttgataacctgcatatttgaatgcatgaacatacaatgcactctgttttattcacatttttctcaatcagctgagttttaactcttatcttccatatt

SEQ ID NO: 42739 - DNA, 1501 bp, Oryza sativa
tgttacaaaagaaaaaggggttttcaagggatttgtatgcttcaaaactcaaaacatataaaaatggcagttccgttatggaagagaaaaattttagaatcttccaattgctcgtcataactgaccatgcatatggtatctgaattccgaaagcagagacatacatactcacaaaattccgatgtatcaatctggaaatctgctgcctatttaaacatagaccacaaaacatgttcatgaaagaaaagaaaaaaaaatctctgtctctccggatttgagtcctaacatgctgcagcctgcatctgcatgcatagttggataaaaacccagatcgactaaaacaaaacaaaaccggatctggacgtgcatttgaaccgttttggaccgggtgaaccggacggttttcaggaccggaccggacgttaaaccggtgaagccgtcggttcacggtttgcatggtccgaccggttggaccaccggctcaacacgggtcaaatagattcacatatttattaaaatcgtcaacgagtgcatagctcagtggttgaagattgctgaaagcacaggtcggtagttcgagtacaccgcgcgtctctttttcccttaattttctcctctctcccatcccacgttccagctgcatgttaccggtttattctcccgtctaatgtccggtttttctccgtatcatacctaaaaccggcggttcaaccggatttcctccggtttgaatgcatggccgatcttttgactggaccggaccggtcttaataactgtggttttggcccgtctcctcaagtgaatgacagccattggccatttttcttttctgaaactgagcaccctgcaatttttcttcaaattctgaactacttactccctccatttctaaatatttgacgccgttgacctttttaaatctgtttgaccgttcgtcttatttaaaaaatttaagtaattattaactattttcctatcatttgattcattgttaaatatacttatatgtatacatatagttttacatatttcacaaaaatttttgaataagacgaacggtcaaatatgtgctaaatagtcaacggcgtcaaatatttagaaacgaagggagtactttgcagtcaaggctttaactcaacaggatattctacagtgcatttccaaggccacaagcgctacttctgaaacattgaacctactaattctaaggtcaaagtaaaagacatgacagatcatagcaagtctttctgaaactgatcaagatgccactgagaaatgctcatgaagtttcagcaaatcgtcagctgcctaatggtgcagtggttcctcacatgtggtatgtttgtatgaagggtccatgtatgattgggagaagataacatgatgcaaattattactgaaggctaatgatcagcactattatggactgttcaagttttcaaccatctgcacatgcacgcagaattatctccagggtttttattgaagttatgtttgact

SEQ ID NO: 42740 - DNA, 162 bp, Oryza sativa
tcgagctcggtacccattttccatccagcacaacccaaatccaaccaggcacatcacatcacatcccatcccatgggaatcccggcacaagaaaggcccgaagttaagtgagcctgtgatccagagagagagagagaatcgctagatgcacacctggggtga

SEQ ID NO: 42741 - DNA, 1501 bp, Oryza sativa
gcattgtcctaacatttatctctgaggttctgcacatattggcatcttggctgagaactgtatgcatgggataggatttcgttgcatgactatttatatatgttcattgcagatattggcttacctcctgttgtcagcatcttcagcagcactttctcgcaatgatgtttgggtgtctcggtttggagtggatcaatttgccaaacttatcaatgcttcagcctccatggcattcttagctttcgttgctcttggttttagctccataatctcagcgtatcatgtcttcagctcggttttttaaacccattgtacattacttgttgtaagtactatgtgctagtctgctagatgtatcttggtcaagccaaccttgattgttgcttcttgtttgtagaattgtggcaacgatattggactccgaaatgggaatacacggtgatctttttaagagcgtgtaatggcagttgggccttggggaccaatcggttctgtaataaaaattctgtagagcaaatcattcaaggatgcgacttttactggtattgattgactgtttttatggtcatgtactctacggatgcattatctgttctattagatggtcaggagtctatcagctaaatagattttgtcaggtataggcagcaaattccattctattgaggctcagctatgaacttctgaatagactgatgaacataacaaagagtcatcctcttgttagtcagccatgactcgcgatacaaaatcgcaaggacgcaagttagcactaacactacaaagccatttgcaaacttgataatctttgccaaagtgaagatagttcaactagttagatttcttgtagtagaattaatctacttgggtataagttctaaacttgttacgggtgtccgtatttactactaattattctctcctagattccttgtagtagaattaatctacttgggtgtaagttctaaacttgttacaggtgtccatatttactgctaattattctctcctagattccttgtagaagaattaatctacttggtataagttctaaacttgttacgggtgtccgtatttactactaactagcatggtaggcatcattatattttctctcatataatagcatatatgttttctcattatattattcaaatatattaaaatgacaacataattttaaattttgcaataaccttacaaactactaatgtgtaatattcatattatattttatatgtgtgttagttattaattatttttaatatcaaattttagttatttgtaaattatatatatttctatatggactctagactcgtcttttaatattttttttcttaattccgaattttctgtaaattgtatttctatatagactctatactcttcttccaatattatttatttttatttctgaattttcatattatattttatatatgtgttagttattaattatttttaatattaaattttagttatttgtaaattatatatg

SEQ ID NO: 42742 - DNA, 1501 bp, Oryza sativa
gattggagatggatgaagtcgggtgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaattttgctcaacaactaaaatatggaatggttggcctgggttggcttgggacgagctggaacccaggtcgggttgccagttcggtccaaatcatcgtaggccttgggttaaggcaggttcgtgagggttcacgaccttgtttaataatactgtgtagctctaggatcgtctttacaaaatggctttgggcaactaagtgacttttaaatgctgtttactgcaaaacctaacccctattattatccccttgtaccccccccccctgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcccttgtaataatgtaaatattatcgatgtaataaagatgtgtcttttatatcatgtttgtatggtgtaccccggcttttcctgggacggggattaatacactagcgttcgggagaaggcaattttcccggtcgcgacataaagcctggtgacaggtgggaccggtctccatggttgggcaaaaaacccaacggtctcaaaccatgcacaccggtaatggtaatttggctgtcaataatgggcggtctcttcaagactgccacatcacctgagcggcgcacgaatctgggcgagccgatttgcctcgcctggtgatacggtaatgttgcttcggtcggcgagcgtaattaacgcgcgcacgatacgatctatctcgactgccgcaaccgcatatccatctcacgcaccgcaagcgggcgaatgggattagtggaagcgtgggcgcgagaaacgagggggcgaaataatgggcgcgagaaacgaggagccgggcacagcgttggcaagggtataaaggcactgaggatgggatttgtctccttcctttcgccatcatttcctttgccttcgccgcttgcgtcctaactccttcttccctgcgcccttctttcgccacacgcgctcgctcttcatcttctcttcgtccggtgcca

SEQ ID NO: 42743 - DNA, 1501 bp, Oryza sativa
ccgccgccgccgagttccccggcagcgacgacgcggagaacgtgtggctggagttgtaccaggtgggccgctggggcttcggccgcctgtccgtctcggcggcgaacccgcccgtcaggccgtcctacgtggtggccaccgtccgcaacgccgactgcgccgccgacggcgacgtctcttgaccgtcgagacaaccaatgccagccccgtgccgtcgaatcgacgccatttgctgctcccccagctcgatcaattctcccgtgcgatttgtcgccgcgctgggcgaacgcaagtacaacctgtgagctgtatgccatggtccaagtagaaattggtcggcgacgttcgagagagcggcatgagtgattgactcgaacttcgaaggacttgagttcatgatttctctctctcttctccttttttgaaggaaatcttcttcctttttgttgttcagggagctcgaagtgtactcacaagtgtagataatttgtgccgtcgagctccttcctccatccaagcataatgccgtcttcggtgatcgctctgtacataccaccatttctcagataaattttatctgcgtgataagagtgtggcattgcgctccaactttggctcagtactatgttaatggatgtcagttctgtatctgcattgccagcgcctgcgctcgccaccgacgcggccttcctgcgcctgcgaggctgcaactgcgcactgcaggcatttgcaaatggcaaaaactaagagcaagtttaatagtatagcccactactggctccaattcatctataactaatctaatagctcatttatacaatagttacatactacactattaatatctggtctcacctgtcatacacacgctgcgtcttagagtccgtgctacatgtggctacaaatctgtagcccgctgcccttctgtctcctcatttatctgcttaaaatatatttgcagctggcttatagcctgctattgtacctgctctaagaggagctctattttttttaatcaaaagggtgggtacccctccatttctagtatcagaaatgtgcaagtgtataccaagatcgttcatatctgaaaacaatcccagataacgaataggcaaaagaggagccctactgacggaatgtatacgcggtgtttcaaaatgcaagttaacaagttaataaacggatgaggtttaaagttattttgaattttaacgaatcttatctgaatttcaccgtgtaggtaattggcaaaaccgctagagagcgattttctgtgggcaaatgttttttttgtaaaaaaaaatccggattccatgtaggagaatataaaagatctgttgcttcaggtttcatcaaactttcaatagaagaaagtactccctccgtttcagggtcacagtcaaactgttttaagtttaatcaagtttatagaaaaacgtagtaacattttcaacataagataaatttattatgaaaacatattcaattattgatttgatga

SEQ ID NO: 42744 - DNA, 1501 bp, Oryza sativa
tttttgtcaaacatttaaccgtccatcttatttgaaaaatttatgaaaatatttaaaaaattagtcacaaataaagtattattcatgttttattatctaacaacaataaaaatattaattataatttttttttaaataagacgaataatcaaacgttgaatataaaaaatgtaaaactacatttatttttggatggagagagtaatagactcaaccacaccctctccctgatttggccaatagtgtaccggcgatttataccagtggccagccggtcgcgttcccagcggcttcgacgccaccaccagccaacatggaaaccacggcccgttcgtggtcgcggcggatgagacatctgctcggtttggtttttttcatcgacccacacggccgcaccgctagctaataactcgattctccccgttgctgttctgcatctgcagtgacacacaattaggtgaactaacaacgtcgcacttgaaaaaaaaaaaggtagggaaacaaaaccacttggcaaaatctagcgaaaaagaggagaggaggaaggaacaggatagcacaagtacgggcacatgtcataaaccgtacacgattcgttcaaaaaaaaagaagaaaaaaccgtacacaatccgaaatcgcatttctagttgggtttctagaagcgccacctcccacatccccagctctccgggcccgacacgtgtcccgcacaacctacgaaatcaggcgtactcgccactgacaggtggtcccagggccgtgatggacccaccagtcagtgacacgggaggcggcccttatctactacgcgcgcgcgcgagacccggccataataccgccttctgttgttaatcggttagcttcgcgcgccgccgccaccggctcaacccgagccacgcgaaaattcgaaggaatccgcgaataaatccgaggaggagaccccaacccgagtaggcgaggcgaggcgaggagcgggagacgtcgttggccatggaggacagagaccgcgaccaccgcggcggcgccgacgaggacgccccgggaccagccgccgccgccgtcgcagctgtggacggggaggacgaggtggaggatgatggtgggggtttctccttccccgtcccgccgttcgccgcggacgcgttcatcgtgcccgtgtacccggtgtttggtcggccgatgtccccgccgccgcgggaggcggtggtggaggaggaggaggaggatgagccggagacggcaaccctgcgggtgccgttgggccggctgctgctggaagagcgggagttccgggcgaggcagcgggagagctcgggaacgtcgccggtgcagccgcagcggcggcggccggacgacgagggcgagctggagggggtgccgccggagagctactgcctctgggctccgggcgggcagccgtcgacgacgccagcgtccccgcggcggtgccggaagagcggctccacggggtcggtgctccggtggcgccgcatcagcgagc

SEQ ID NO: 42745 - DNA, 1501 bp, Oryza sativa
gcgccccgacccctcgcgttttctactccacgtgtatgggttaggtgagcacagcagggctcacctaaccgcatttattgcgcctcggctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcatgtcgtcagcacacagccaccttcccacgacgtgcccgcctcaggcagaagtggaggtaggtatgtgccgtcccgtcaggaggatgttcggaggacgaccgtgcaaatctccgtccatttatgaaaagagaaaaagtccagtttggaaagggaggggtgcatgtggtatccccttgaagtataaaaggaggaccttgcccatagagaaagaggttgattctttccagattcagagcctagaacgagggagaggtcggctcacactttgtagctccttcatacacagatccaccaaaacacaggagtagggtattacgcttctcagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagcgtgtgttttctgagctctcgtactcctccgtgggcgccaagcttttcttgttcagcctaatggccgagcaagcaaaggtgcacgacctctctccgagtgtgagcggcgacgacggggagccgaatccacgccgtcgagctcgtactccaccgccccctcctcgccaaagtcctaagcagggggaggcgctcgaaagggtcgaaagatccgcggcttcaccgatcgcgggcgatggaggagaacggcgagatggggagcgtcgcctcctcgtctacggcgacggcagcacgccccagggcgcgctccaagctgcgggcgcgctcttacgtcacccgcctgtcgtccctgacccggaatctccagcccaacgatggctggacgacgtggccaaattggtcatgacggcgcggcagcgcctagatgctggtgggcggtcctccgccaccaagacctctggtgctgctaccactggctccgcgtcgtcaagacgaagggcacgacgagcagcagccgctgttcgccgttcggtagccactccctcatcgactccttcgacccgagaaga

SEQ ID NO: 42746 - DNA, 1501 bp, Oryza sativa
gttgattcttgcatttgaatttcttgcgcgtgtttaatacttttatgtttgttttttttatttttttatccattgaaattatcatgaatgtagcgcgttgtgtgctagtaagcaaccggagaagtatgcaatagtttcttaattatttaggactagaaaaggacgaaaattttgattgcttgttctgttgtataattatgtgtgcaattccgaggaagggcaggacacctctcttgttcaccaactctctcctcatcttttgaagcctactgttttctttccctttccagcccatgttttttctttgatcagttgggtgatgccatgtacgagataaggcttacagaaaccttttttttttaggaaattcagctcttgacatcactctgatgagcaaaacactggatcgttttaacaaacaaatattcccaagtagtagtatgtgatgaggtagcctgttatatttatcatataacatgttgtcctaatattccaatggagcttctaaaatatacttgaaataaaatgacatttggtcaacatagtttactggataagatttacctcagcaattggcaattaaatcaatccacttcatgatttcacatgcacgaatgtcatctctaattatgtgccttatcatgctatagttaaaattgatctgcaaagcatcttggttggtttgacttagatatcaacattgatctaaagacagggagaggatcagagggggagaccagcatccttttctggttatcaataattggtcaagtgatcctctgctgcaaacagcatgtatttgagaatatgtggatgcttcttgaaagattggcccatatggtataattcagagtatatgtgctctgccccatatactgtgtgcttcatacttttccagaaaggggtgagctgaataatgaaaggatagacacacagatagctgacatcaatgtcatcgattgatgtgcttttgtaatgttttactagctgcatctaattcgatttcgtgtcttctatcagcatctggataatatcagggtccggctgcatgagttgactattttgcttgatgtttaattaataatagtagtagtttacgacttacagtctgccttgtatacttggattgcatgacttggactggacattagcctcttgtgctgatgctgatgacagttgacattgttgatactactatagttttctctaagactcactaggagcatacaatttggctattatttaggctcccttccctcttttcagtcattgctaatatctgatgctcttgaaaacaactcattccttcattttgtaatgtgaaataagtacagttcattctagggaacaaagctttacatgttagcatgaatctggatcatattttttatttaacttcaattggtgtttttttttcaaagaaactccactctgccgattgctatatcgatctgcagttactaactatcttctgttgcttttcttggttacttttttcaga

SEQ ID NO: 42747 - DNA, 1501 bp, Oryza sativa
attggtatggcagcaattgagtatcctcatcacgcgagaaaaaaagtttctttggtatttcatacaaagtaagttaaaaaaagaacttttttttgggtatttggtggtaaggacttcggttgtggtggacaccagccctcgaatccattctcataacttaagaagcaaaatgcaaaaattacagcataacccatgtcgttcttgggccaaagccaacatggcagctcaagctgtctaaccccggtccaaagtataaattaaagatggtaaatatatgtgatgttaaatgaaaagattggtttacttctaatccattgtgaaacttcagcaaataaagatagcccaagataagtactcaaaacaagattagtgcaaatatggaaaaaggaaaaaaaatagatggtactatttacgtcccaaaacttatattttgggtagaggagacgaattgaatgatgaatcaccatgtatatattaaagttatcagtgttacacatttaaaagtagaggtagtaataccataaatagttgatataaccaacatctgcatcttcaaatttcaacttttttaacttaagctgtatatcaacttttttaacttaagttgtattttaaattgagttttcttttgcacatgctttgttaactcaaacatgatcattacctgttgtatatcattgaaaccacacaaaatctcttgttccacttagaacattaatttggttttggaacagatccagttaattaattgatacaactaatgagtggtaattatgaagtggaattcatttggcagttgaattcaattctaagttgataaagacctgctcaaccttttatttttttaaaacactaatttgggaatattttttggcaaagtaatactcattacatagcaacgtgttgatcaatggatacatttgatttccaatattctccggctgcatataggctcccctgttccataggaaggtttgactacaacatattatatctggggtactaaataaataaatgtgcaatgaaaccacatggttggtgatgcaagtcaaccccagtattacacagctgctaaactgttgaatttgcaagctaagctacttaatctccatataatagtcttcttcctctactctagcaaattaaattaattaattaagctattctccatttaatccagctagatcactaccgacagaaactgcccccaagctgaggcagcctcatgacccactgacaccttggccccaccattacatgctctgcattagatccttctgttggacaccctataatcaaatgattagcacctgtaattaactaagacagtgtaattaactaagttgtggtccgaccaggttaacgtgtggtcaacgacgagaggtcagccatggcgctttgcaacaccataaaaagggcagcacccgcgagatgacgacgaggagacgaagcaattcaaacagccaagaagaaagaggaagaaggagctcgcgagatcgct

SEQ ID NO: 42748 - DNA, 608 bp, Oryza sativa
gtatacattaatacaaagattataaatgtttatagcatagacgatcagatagatctagcacgtatcggctagtactccgataccattactagaacaaatagaatatgtcaaacagaaagcctaatatactttattgcaataagatcttaatataaagggcagacttagcatatcaattaagcatataagatataaaatagctaaattaggtaagatcggctgaaaccccgatactatctctcttgataatcataaaagaagccagatatcataattatagatattacttaatagatcgaacctaaccgatgcaacattaagcataaagacaagtataagatctagacaagatgatgaaaacctacaaaagatggtatatacacgatacaatctagatcaataacaaaacataactctaccgattgcttcctaacaataagaaccaactgataacaagttatatagcgcaactaacatagattgcaaagtatatatgataactcgacagattacataatcaagattagagtgtcatagagatggaagcactaatcccgacaatgcaagctgccataacaagttttacctctagttgaagatcaaaacga

SEQ ID NO: 42749 - DNA, 1501 bp, Oryza sativa
cgaagttgacctccaagaattctgactctagtcaccttttcacatggtatcccgaccgcactagacctctgcttcttcctgagcatagtcccggtcctcaccattgtccaaggctgacctcaagtcacctgcacataattagacaaaataaccgtttctgggcgcagatatcacaacctgacccacattagtcacacgcactcacaccaacatccacacatctattcaaaccaattctttgattaaatcatttgtaaagccaattgttcatcacaaatattaatcatgacgatgatttcacacttacaagtctactccttagaatctaactttgatccacatgaaccagagtcataggccacggtaaatatatattggaagcagttgtagctcttagcaaccagtggcagccaaacctgcaaaaccaaacaatttcatcagcaaagatctcagatttacagcttatgtcagacaatatatacattaacatcaccagtgtggtgagattattataacagaaacacccaatgttatacattgtttcatcaccaatatttagtactagaaaagcagtcattcagaaaaaaatgaacaccaatagaagaacaattgatttctgctgggatacttcaagacaacagtcacgagtccctgtccgatgctatatatctactggtagaaattaatctaaaccgtcaattattatttttccaatgggtaagatttaattgtactaccactctaattaatgaaagtagaaacgtaggaaggtacgatagtcatagaaatatgagcgtggagtggtaaaattgtaattttcagattcgttaattttgttggtgcaactgctgacggattggctgacgaatgccgggactagtaaaatataatttttttcaaacaggccaaaagtgatttttgcttgcggacctccgggccgtttgcccagaaatgtctatgaaaatctctatttttctatgagggtggcgcacccacatgcgaaaatcggatttccgtgtgcggatgtttatgtcgtccacacacaaaaataaaaatagcaaaacgcctgctggccagccaccgctggatctgggcgggggacggccaccaccatcagatttgggtgagggacggcagccgctgccgccaccgcaggatctgggcgcggattgtccgcccgccatgcacccgccgcagcccctgtgctccccccgccaccgctgttggattcgcacggatctgggtaggggagagccggcgttgccctcgtcgcctttgacgcgtggggcgctcgctgccgcgtgccgaccggcctctgccgccgcgtgccccagagagagagagaagaatgttctctcccgggagtggggagtttgagagagagaggaatatgaggaggagagaagagaagaaagagaagagtgaaagtgcatctaggacccctcatttattttggtgttaatgacaacacagttagagggtaactaatgctttttgttga

SEQ ID NO: 42750 - DNA, 1501 bp, Oryza sativa
ttggcaactagggataaccacattcctttaaagggtctgggaagctagattgatctgccctatattttcctttacagcgaaagcaacttgttcttcgtttcgatggatttgctggaagatccggcgattacgttctagccaaacattccaccaggttatgagatctccaattattttcttcctcttggctatcggggaaaggttacagagtgtctcccaccagttcgacaaattgtttgtcgaggaaatctgtgatgctaaatcgtgtccttgccattgacaaactttgtcccaaactgttgctgtaagtgagtcgtatttttgaaagcatttctacaaaggctacagatccaatcacagggccagtgtctctttagcagaattttagcagtgaggattctttgatggagtaaaaaaataagaagagtaaaaaaaatattttggtacattaataattagagaccatattgtttcagctgttgtaagacgttagttcttagatgctctagagtttatacatgtcctaacgattgaattaaggctgtgtgcacacgaaacaaagggacaaaatgcaacgatcaatcagaaagtgacttgtatactgtggaatcgataaaaacgaataggggaagtactatctgttctaataaggattatattttttgcacggtctttaataactagtattttattatattctatgttcctaacaaatatgaaattagcatcacataaaagtacttcaaaatacgaatccagtgatataacatgtataatgcttagtataatgcttagtataatgcttagtatagatataattagtatgattattagtcaaaagctaccaaatttattttttttaaaaaaaaatgagacgtcctataatttaggacggaggtagtactaactatggcatgttcagggtttgattttagactgcgcaaaacgagatgagttattaatgtatgattagttaaatattaaagcactataaagacttaaaaataaatttatttaattttagaaaacatttatatggaaattatttacattgaaacgcaccgacgaaaaacatgctcattgatcttccattggacacaacttttaattcacatatttgaattttaacactaaaatccgtgctctattttaacctttcaaactaaagacttggagtttggtcattgccatttcaactcgagaactcgattcagtaacaccatttcaactcttgctgaaaagctggatactcaatctctctatctattataaactaaaagtctattaaactttctacaaacgctcccaagccaccacgtggtgctcctacaaacgttcctaggccgccacttggcagagtctaatcttaccgtcgattttcatttaaattgatgggcccgttattctgtaccgttagattagatctatacctgccatcagcggtggagccaaacaaaaaaggatgtggggtcatcactgtgaaccaatattaccgataaat

SEQ ID NO: 42751 - DNA, 1501 bp, Oryza sativa
ttatgttgttcacttcatactacacgcacgaaggaaataaaaaggtaaattgtacggttggttttaattagagaatgaataaaattgcttcttgctaatctggtaggaagtgcataggtgaaacatgagaaatcatgtcatgatttaatcatggtaataaataattgtcaaaggtaagtgtttgtgataaacaaaatatgtatccgttcgtggtcatttgaaaaactataaaaaaaaaattaatattgaccccacaaacaatcttaaattaaaaaaatcaactacaaagttgtatatcccgtcaagagatacaattttttatataaaatttgtcatcatccaactttatatgatgggcattgtttccatattagtgatgctcacaatattttactaacgcggaacatactgaggtgaacaatcatttttataaagagagcctcaagaaaattactgaaagacgattttgttccaaccggagatcaaattgcagacggcattttttttatttttacaaaagcattttcagtttgacggtttaaatattttaagtataagtagaaaagttgtgattgaaggaggctgttagataaaatgtaatatttcatgtgtatgttatcttgattcagaatgtaaatgcaatcctagagctagttggcaataccaatccagctgctcacgcggcaccattcttgtaaaaccacggcgatgcatgattgatatcgcccctatattaacacaggtgcggcccaagagagattaattcaacgcttccacagctcatccgatcgagttctttctttacacccgcccaagctcaaaggaattgtctcctatcaatgtatctgagagcatgcaagttggtgcttaaatggcagtggaatcaactcatcgttacatttagatatcaatcttatgttactgtcccctagtcattggtacatgcactgtagtgtagtgtcaataatctggatgctttggtaagtatgtacaactgtttaacaatgctgtcgttattttttaaggagaaaagtccacggggccgcaatcaagttaattaagcaagattaatcaaacgcatgcatgcacacatagacatataagtaaacaaataatccctctattaatatattggatgaagaattgaacaagtccacaagagctagcgcagtcaagtgcgattatattagcccagtccattggaactgagcaattaatatattacaacttgagtatcaatatgaccatatgcatggcttagtcgtgcgcttatatattggattagccagggggttcaaaatgaatccaactctgatctctcacttcaactctatgtgtaataggtagagatagatcgagcgcaatagatacacagatagctcattggctgtgtatacccactttgggtgtaacagactgggttttcatccattttcttaagaaaagatagatagatagatatagcataggtgagatatacggagagacagggagaacataa

SEQ ID NO: 42752 - DNA, 1501 bp, Oryza sativa
atgtgcagagtgttgcagaccgtgtgtgcaacagaaaattaagctgtatgcaatcatatatcgtaccaagcctgttaattaattattttgatgcagagcagccggattaggagaaggtattttgcaggctaaaacgtccagcgtgatccctgatttaagttaaacatcatgtgacatggaatctaagcatgttgctcctgaaattctcagtaggttttttcagtatatttgatcgtgcgggttcattaaaaataatctccgggatcgagccatgatcaaattaatctctgatcagcatgatgacaagtacttttgttatttctctaatttacttttgtgcagagttgacaatgaactgtatgatgttttctttcttctttttgttttaattcataaattaaaattatcattgcttatgatatacgttatttcatgtttttggtgtactcgtaaacattaaaaatatgtgttcactgggagagtatgccttcctattcgttcatagtggaatacgcgtgtacttttggagacttagttatatatataactaattaatggttttatcagttccatttgtcggcgagagaagtcaaactcgagagttgagtttcttctacatgatcaggactggtttgatgtagttcatatatatatatgtcaacttccattgtacagaatttgcaaataacaaattccgacacttatggtgatcgatcgatcgatcgtcgtctgaacactgacgcagctatgctataagtactacttcctccgtttcataatgtaagtcattctagcattttccacattaataataatgttaatgaatctaaatagatatatatgtctagattcattaatatcaatatgaatgtggaaaatgctagaatgacttatattgtgaaacggagggagtactagtatacacaaatgtatttatttgacatgcataaaaatctaattaattgacatataggagtatgttgttatacacatatccgatcacagttagatacaactgacaacagtattggacaccaaggtatatttaggttgtgttcggtactctcttttcccaactctcctctcccgttttcgcgtgcacgcttttcaaactactaaacggtgtattttttgcaaaaaaaattttatatgaaagttgctaaaaaaatcatattgatcctttttgaaaaaaaaatagctaatacttaattaatcacgtcctaatagaccgttccgttttccatgcatgggagatgtgttcctaacacccacctccgaacacagccttaattggtatacacgagatatattgagagaacatatattccgaggccgtgtttttcttcctgaatagtagaatagttgagtaactaaatgattttgtgttcactattcgagggtataaatgaatgacctaactattataaagttgaaaaaagtatttgaaacaatttttaagaagttaatatatagaaattaagtatttttttaatgaaaaata

SEQ ID NO: 42753 - DNA, 233 bp, Oryza sativa
tcttttgtattcgccaaagggcaaggattcgcattgcccgttgtttagttttgatccccggattaattgaactcggcgtcttcattcacgaacccccaatcccactcaatcccaactcttccagcccgatttctagaaatttctccctcgatccacgatcctagctcgcatcatgcaccggcaataaaaagatccctaaagccaagaaagaaagaaacaagaagcgccaccga

SEQ ID NO: 42754 - DNA, 1501 bp, Oryza sativa
gttattccctacttgtggttcagaatcgatgcaaaagtctcttccaacgccgaatcagaatgattttctcatgcttctgaaatgaagcaataatgtgaccaattaccactttgactgcacattccctgcataatggttctgcttttatctggaagaggaagtacagcaattttccatatatctatctctttaatgagatggtgcgcaaagatttcgagcattctcaaaagaccaaaaaaaaaagcataacatggtagtgccaaagttgcagatggttgaatgattgataagaatttgagcatctgaaaatctatctatctacatgtctacagaactgtcatctccagcaaagaagctgctaaagccttcagatatctctagctaagatatgaaatagtaggcacatatggaaacagtcacaagaggcaaaattcaggcacagttgcatggtttgttggtagcattgccacaaccagaggtagcacaccaaacagataacaaaaactatacacattatgcagccaagtgcccaagttgcacaaactgacaatcttttgcccatccttacccagccatcactcagaaagatctttaaagatggcctatgtttactacttccccaaacaaatcacgaaaacatgttgcacatgacagtatgacattccctatcagaactatctggaattcattgctcttggacccactttactagcttacctgctcaaactctgaacctatctaacgctgaagattacaccaatggccaatcaacagttgtatgtttttggagtcttcgttgtttttttgacaaagaaagtataactttcgatacctacaccagctaagaatacgcacaatcatatttctgaacatcagaatttgaacccaactggtggagtcatacatcaacatcttcactatcacaccgatgatgcctatactaaagtctttaggcctgtttaaatcccctggcaaaatttttcatcctgtcacatcgaatgtttggacacatacatagaatattaaatatagaaaaaaactaattatacagattacgtgtaaattacgaggcgaatcttttaagcctaatttggtgctacagtaaacatttactaatgacatattgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacg

SEQ ID NO: 42755 - DNA, 1501 bp, Oryza sativa
ttttttcttcaaagcaatcaataagtcaagctactactataatatgtaatttttttctaggtataatagcaaaacagtcgagatcttcctgtgaagttttcatcctataatatgtatgaaggaaaaatcagattgatagtgagatgttgccatattagttttcttatgataaatcacaaaacggtatatagatatatgcccatctttaataaaaaaaggccgctaatcaagtttattgttctcaaaagaatcgaaaaaggaaaggaaatggaagaaatgatactgaagtaacccaccatatagtgaacagatagaatgatcgcaaataaattctaggtatcaagaatggttgctagatgctgatttgaaattaaatagttggctatgttactatagaaatggtatgcagtcacatggtgactgctgagaattgaaatttataggaaatagacaatttgaggaatagaagaaaccaagaaaaatggtagcaactaacaaactataggaacggaaacttatagattaacagttcaatcatttaatatgtacacctaagtttaatttcctcgacggaagatattctcaaagcaccttgcttaacttctagaaagcataatttgaacaatataactaatcatacatggcactgagttcatgattaaagtaaacataattttgtggcatgtatataaaggccaaaaatacctgtctacagtcgcagagaaagttcctcttagaagaaaccggatctggtccatagtgaggccaatctggcaatcgctggtcttccacgcttgctccttttgctactgccttgagcggttgagagagtacacatagctgatgaatcagcaacaacggcttagcattgagtagctggagatgaccgagcttttacacaagtaatgaacgcatgcatgcctcagtgagtaatatgtttatctatcatttcgttgaatcgctttctgttgctgatgttcataacatatcgttgaatccagctaaatatattgctctcttagatacattactgtgagtggaataataataagggtccctaataataatgttaagtttgaattagttgcatgctttactgcttttagcttaatcaatccatgccacctaaattgaaatattcactttcttgtacctatatgatttagataaacctgtacacttagttattgtttttgtgagaattactaacagaagatggtggggatttgaaaattatcagacttgatcaatacgatctttcatgtccaaggggcatataacgacataccaaattaatctggacacctctggttagatttaaaatcatttgctctacagttgctacatataattaatttgcatgtatcataaaggagatttcatttggtctttttccaaaaacaaacaggaatgcagtgcacataaaattatctaaacctgcaaaatttcaatttcaaattccattgtattaagatccaatgccagattgattcgtgttaga

SEQ ID NO: 42756 - DNA, 1501 bp, Oryza sativa
cccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctcttggccctacctcaacggctgtcccatcgtagcgcacatgtctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaaccgttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcatgggtacaaggattttaagggtaaacaataatcaaggcatggcataatcacaagtaggacgttcatcattgcatgcaattttatttgtaaacaaaacaatttcgcaattaggatcaacatgttcaaagaatagtgatgacttgccttgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgcactattcgtgtttgctaatggatcccaatcatgctaaggctaaagtttcctaatctttctattgtcatcgtggcctatttaggagttaaccaacatagcatttatgggatacgtatatatttggctaatcagtggtttagtctatcaaatggctatggaaggattttggctatgtatgtatctatctaaatagaacggttatatactagaggttctgttgctagatggatttaggatcaatcaaacaattacagtgaatcatttgtattatttattttattgatggaggctttattttaattatgtacatatttcacttgtcaaaataaattataaaaggttagcaattaccca

SEQ ID NO: 42757 - DNA, 426 bp, Oryza sativa
tgtatatatgtattaaaataatatatgcaactttatatctaatttatatagagataacaatgtagttatagtgtagttacactatagttacaatgtaattatagtgtaactacaatataactagcatgtaactagaatgtaacttgaacaaatctacaataaacatgtgatgatgggactagcttgtgaaaatagggtttagatccgatagcaaaatatctcagcacaaatcttaacacggaatcaatggtaaaaaaatttgacagttttcattaaaaaaaactgtcgacggttagctacatggggtttggttttggcagtgctaggttttttttctttttcagtgaatcagtgtcagtgctaagctttgctcttgcctcagaatagtcaaagactcacgtgttcaactggtgcggtgagtaaata

SEQ ID NO: 42758 - DNA, 244 bp, Oryza sativa
cacattaaaagaaaactaaattctattttaccacctaagttgtttcttatcagtttaatattccctccattttagaacataaggtgttttggttttatcctgtattaaactttctgtaagtttaacccagcttataggaaaatatagaaacaaattgttaacgccaaaatttggtaagccccgaggtcatcatcggcctaggaaccgtatcggcttcagagttctagaatcggctaatgggaaa

SEQ ID NO: 42759 - DNA, 1501 bp, Oryza sativa
gccggcgggggcaccgttccggcgagtttccggcgaggagacggtgaggccggtgaaggggacggtgttgcagagccgagggaggcgacggcacggccggacgatgctccggcgaggagaggaaggcggctggaggtggccggcgcgaaggaaagaggagggcgacggcgggaacggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccggacttggcgcggccgttcccggcgattgggggcggcatttaagggggaaattagggggaaatgaagaggagtcaatggggattaatttcccctatttaatttgggaatcccatgcttgaatcgagcggatttagaggaggaagcgagctagggttcacgggagagggagagaggacggccgggcgggaggaaggggacgacgcccggcctgacgcgtgggccccacgcggtcgggcgcgcgtcgtcaccgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaagagggaggagaggaggacttcggactgggcttggcccaaaggaggaagaggagggatttttaggttttctttttattgaactttgataattgtttttgttgtttaataattatttctggtgctctgaaaattcaagtaaaatttgagggctctttttagaccaaggagaatttaacaaaaattctccgggccacattggaatttttcttgtacgtatttttagtgtttgccaatttctttccgaattttaattaattctattattccttttagaaaataaattttaaattttgggatgaatttatcaggacgtgacactttaggagtggcgtcacgcccggccgcttcccataagaagggcgatcgccctggcataacgccgggggctactgtcggtgacatgggaccgggagtatcatgactcgaggcttgaggcagacacaatcgcccacgtggcctggcaccctcgggggacgtcgggcccgagggtgatgtgtgcgcccacctcttggtcttcccgaggggggggtcggaccactccagccttgcccccgaggggcgaggcgccccgacccctcgcgttttctactccacgtgtatgggttaggtgagcacagcagggctcacctaaccgcatttattgcgcctcggctaagcgtgtcacgccgcacgaagtgcagtgcagtgcactcgattatccggtctgtgaccagtcaca

SEQ ID NO: 42760 - DNA, 1501 bp, Oryza sativa
cgaggcgccccgacccctcgtgggtttttgctccgcgtgtatgggttaggtgagcacagtagggctcacctaaccacatttattgcggtttggctgagcgtgtcacgccgcatgtaacgcagtgcagtgcactcatttatccggtctgtgaccagtcacagaccggtcaggtcgtgggttaggtggcgacaggcgatctgacgcacgcctcgccccatcccgtcaggacgagggcttctaggcgctcgtccccagctggagctagcgtgttacctcccagagatggcacgttagtcctagtcagatatatgctaggcttcatcctaaccattacaggcaagatgttgtgtgaagaagggcgaacatgcagattgttaaactgacacgtggtggacaagaatgaccgatttgtgaccggtctgacaatggtcatgtcatcagcagacagccatcttcccacgtcgcgcctgcctccggcggaagtggaggtaggtatgggccgtcccgtcagaagatcattcggacaatggcgatgcaaatctccgtccattaataaagaaaagtcaaattggagggagagatggggcatgtggtatccccttgagatataaaaggaggaccttgcccactttgagaggggacgggacttttccagattgggaacccagaacgagggagaggctggctcatactttgtagttccttcatacacgaatccaccaaaacacaggagtagggtattacgcttctcagcggcccgaacctgtatacatcgccggcgtcttgtatggttcctgtctcgcgaaccttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctcttgcactctttcgtgtgcgccaagcttttcctattcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggccgaaggatccgcgacttcgacatccacaggaggtggaaaagagcggcgagatggggagcgtcgtctcctcgtctatggtgacggcagcacgccccagggcgcgctccaagctgcgggcgcgctcctatgtcacccgcccgtcgcccatgacccggagtctccagcccaacgttggctggacgatgtggccaaattggtcatgactgcacggcagcatctagatgctggtgggcggtcctccgccaccaaggcctctggtgctgctaccaccggctccgcgtcgtcaagacgaagggcgcggcgagcggcagccgctgttcgccattcggccaccactccttcgtcgactccttcgacccgggaaga

SEQ ID NO: 42761 - DNA, 1501 bp, Oryza sativa
atagcagctgtatgaaaacatatatattctctagactgttatttagatttgtacagcctagattatatatatatttttaaatgcttgtgccttttgtcaagaaaaaggcccaaatagactagtatcgaatctagttgttggaaatatttgaaggttgaactgcaatctgtgccaagcatgtctgtcctccatcctcattcaattgtgctcatacatggtattttgcaagatcattgtgctttataaaggcgtgtacttgtttggaaattcggtattaataatgggaacggtattgtttttatcatagactaatcagaataatatgaactcttcttgagctgaaaataaacatgcaatgtatgcatcccctgtttcctcttttcctctgattgaatgcttaacaagcttacagtgacaaacagtgagtcggcataaattttggtacagttgagaagttcttgtgttggacatatccctcctcccctagaaataagaagctggtattagtctccttatttattttatgtacttctgctttcttctattgcataaaggaagggaacaataaacatctgccttttattctgtttctttttctgagaaacttttaccaccctcatgggccatcaaatacattatcttccttttttgtgtatgttagatggttagcgcatactgtgtgctattaaatgattctttgcaccatgagcgtggacactgaaattgaagtcttctctgcagcttaagttcactatgtctggaatgccatctgatgaggcaactggtcaagtgaggctcgaaggagatgtttctgacaaaaaggaagaaaaaactcaagagcagagcgaagcaagtggaatgccctcaccacaagaagaggtactatcttcatataagtccattcttgacccttgaactttatccagattctatttttcaccgtaaattcgtaaaccgtttattttcatcctgaacttctcaaattgttcactttacccccttgtgacgtttcctccttgcttcagtacatagtagtcaaggccacgttggctttgacctttgctgatgtggctgttggcttttggatgacgctggaaggcctctaaccattataagccatgttgtgagaccaaaaatcggttggaaatgatgcaacaccttatatagaggtgcaagccttctggtgttgtccacaatcaacagacacatcagcaaggttaaatccaacatgggctgtccactgtgtaccaaaactgggtggaaatgattcaagggaatagagtgaacagtttgagaaatttagggtggaaaatacccgattacaagttcagggtgaaaaatggagtcaggcaaagtgaaaaggatcttttgctacaccatttttcatgttactgtgtgtacttattcatgtggcatttattccataaatagtatgaatatctattaattagattactaatatttatatgcgaatatgttcaggaagcagccatcaagaaaa

SEQ ID NO: 42762 - DNA, 1501 bp, Oryza sativa
aatcatgaaactcatctacattagcatgtagtagtattgatctttaaaacctgtatttatgtgagaagggtaaatttcatgggaaataactgcaagtaaggtccagactgtgatcttacgcttttgcagtgccaaggagaatcttcatacggttttcccaagtaaggatgcccccactcatggccccatgaagccattgttctaggtttccattgttgacatattcatagacaagcatcctgcaggtgaatattcagaaaaggtcaatgtacagtgagaaacaagggaacaaggaaaacacatattgattatgcacaagggaaggaacagaatttccatcttatgaaatggataattcattttcccttttgaaccttaagaacataatgcttagtatcacaatgaacttgcacatggtggattcgtataaactgggctgagcagcaaagttaattatgcagaacaaagggaacagagaggaagaaatgatcacctgtgtatcccttccacacagtaccccagaagtcgcaccagattcttatgccgaacgtgaccgatggcttcaacttcgactctaaattccttctctgcttgccccctgcaaacccagcaaagaaatcttagctccaagttaacatacagtaaactcactaaggcaatataaacttacacattgttaaggatcttcttcacggcaacttcagtcccattcatcagtcgacccttgtagacaattccatagccaccctctccaaggacattactctttgcaaaccggttcgttgcgtactcgaggtccctcaaggtaaaccagtgaccccatcccaaatgtgatagctcaggcaacccaaccagcggtgaagcggacgcatacccatacgatgaactgcctttcctaccaggcccagagctgctgtaatcttcagaatatgagctcccagccttctctatgttgtacactgagctgcattggctgaacgcgtcgacatcgacagatctactctctgccaagtgcgaaacacccttcatctgttcatatttatcctgcactggcatgataggtgttccactgtcatgcaggctctgtgcatcaactctgtcaacattgatatctttcgacacaatagggatctccatatgtgatctcccgtcgaatccaaccgccgtcttctttttcctccgcatagagagccacaatgctatgatgaacaaaattgccatcagtatcccaatgccgatggcaatcaggacccaaactctcaagcgaagcacgggtgttgtctgtgacagtgctgaactgatggagttgctgtcggacgacatatctatccttcagtctatctaagatcaagaattgtatcagagatgctctcacaaattcagaatcttgcacggatttgccagctgaatttacaaacttatcctggtttgcttttatctgttaaaaaacaaaaggtactctattacttaactctgaaacctgaaccagcacatgaacaga

SEQ ID NO: 42763 - DNA, 1500 bp, Oryza sativa
accactccgttttccgtgcacaggagttagagttaggttccccgtctcccccatccgaactcagccttaagcttcttcttctctcctctctatccatccccgtgtacacttgtcgcggcggtgtgggatctcaaacgcgcacagaaacctctctcgctgacatggtggggacaccaccatctgggcccacctgcagtatgtggttcgctcgtgggtaggatcttccggtgtaactataggcgcgcacgggattgtctgctcggggaggcgagggctcgcgcggacagagacggaagacttccgccccgaggctagcatgtgggggcaattattcggtgggccccacgtgtcagcgaaccctgcgactggcgtggcctcggagttatcctgagcggacctgacgcgtggggccacggggccggtggtgatgaaagtgacgatgcgtttttggtttttttttttttttgtgtgggtcagtgggattcctcctcttttgcgagaagaatttaggcgggcagtaaacggagatctgtagtagtacgccccagtagtggtaagttagttgggtttttcctgatttggttagattcctctcctcttcttggatcactttattcctcttcttcctttgacgcaaaaaaataacaccagaaattcgttaatgtccagggttttttttaaacagttgttcttttctttttgtcgtaacattcttttccttctttcctttgtatagacaggaatattttccatttcgaatttgccgtttgcaccctgctgttttgtgggcttaattaaatatttacatttatgtttctcccgctaacaatcaatacatgcaatccaaacatgtacagtgcttgctttctttttttgcggccggggacataaaatgtagtgcatcttttttcttttcagaaagtggtccctccttttaaagaaaatacatgacgccattggattataggttgaccattcatcttatttaaaaaatatataattattatttatttttatataatttgttttattgtcttggcttatattttgcaaacctacacaacatttttgaatgaatacgaatgctcaaatgcgtacctaaaagttaccagcatcatatatcacaactgaagaagtactcgtttttacatgtactaattaaaatgtatttgctttaacatgtaaatagccaaagcgatagtacgtgtaataaaaaaacgtaaaaagctccacataacactaaagcgagtatgctactctatccgattataagacatagtttgactaagtttatagacaaatatagtaatatttttattaaattagtttcatcgaatcaataattcaatatattttcacaataaatttgttttgggttgaaaatattactacttttctctacaaacttggtcaaagttaaaataatttgactttaaccaaagtcaaactattttataacctgaaacgaatagagtatcacggaatctcatatgactttag

SEQ ID NO: 42764 - DNA, 1501 bp, Oryza sativa
ctgccattataacatgaagagttttagaagatgaatttgcatacaatcgaaataggaacgataacagatccgccgccatactaccctctcactttaagttgatgatatatgggttccacaactaacaggttcacatgtgagtaactcacgttagagaatagtacgttagagaagactcatctagccgaaatagtatggcgtcaaccgtcaaatcatgtaatgtgtctctaaagaaaatttagatgattcaacactccgaaggtgtttacaaattacaatgtaattatagctttccaagcgtttcttctgctggctatctggttttgcaatggggaagattggttccatgcataacatgaagcttcaccgtcatgagcatgacgcattacataagcatctggtcaaattcaggggttttatcaacgagaagagctgcatggaacccgtgcgtcacgatagtatgattggcacctgctaaccaaagaggcaagtcaatgttttgctaaaataaaaactgataaaaaagcgtgttaccattcttatttcattatgtactcacgttatacatcatgtatgaccgtaaatcgcccctataatgtcacatagtattcatgtggtcataatctacctgtattgtattgcacactaaattgattgtatttttcacacattttggtaattcatagctgctattccacatccgcgctaacgtccattacatatgaaataacgtactagcaacaaattagagaagacgtcccaatgcttcgctaaaagggcgagatatcgtcgtattgccaggttaataaaaaaatcacgtcaatgcttttataaaaaaaataaatacatgcgttacaaccccttacttcatcacctactcatgtcaacacatagcgacaagctatgtcaagttgttatgtgattatcataagagcaacatacgtaaaccatcttcacaactacacacataacatgcatacgaccaaatctacccgcccgatgtacgaggcgcaggctgcattgaccacacgtcatagtaattatagcggctactccacgtcaatactaatgtccattacagacgtaataacacgctagcaacaaaccgacgaaggcgcaccccgatgctctgctaagaaaaaaaaagcaagatattgtcataatgccaatagattaaagcatttgcatttccaactaagcaaaagataattcctcagcacgtttgacttccctcccctcaccctccacatgctggtctcaaccatcaggccattctccccaagcattaattaattgattaattgactgattaattaattaattaaatctcctcctccctcctaatttctttattagagtatttccaaataacaacctccttgcaattttctttttgattaatggctcctctctctctccttttccacacccccacctccccctttaattccaaatgctgcaacctcttcttctcctatagtcctctcccctctcccctttg

SEQ ID NO: 42765 - DNA, 1501 bp, Oryza sativa
gggcaccattgaggtcgccggtaccgacaaggaaaccaccacccagggccacgatgacctctgcaagcaatgcgccaagtactacgaggccggtgcccgctttgccaagtggcgtgccgttctcaagatcggacccaaccagcccttccagcttgccattgatctgaacgcccaaggccttgcttgctacgccatcatctgccaagaaaacgggcttttgccgatcgtcgagccggagatcctcgtcgatggccctcacgacatcgatcgatgcgcgtacgtttccgaggtggtcctcgccgcgtgctacaaggcgctgaacgagcaccatgtcctcctcgagggcaccctcctgaagcccaacatggtcaccccgggttccgacgccaaaaaggtggcgccggaggtcatcgcggagtacaccgtccgcaccctccagaggaccgtccctcctgctgtgccggccatcgtcttcctctccggtggacagagcgaggaggaggcgacgctgaacctgaacgccatgaacaagctcagcgccaaaaagccgtggtcgctgtccttctcctttggccgtgccctgcagcagagcacgctcaaggcctgggctggcaagacggagaacgtagagaaggccagggcggccttcctcgtcaggtgcaaggccaactccgaggctaccctgggtacttacaagggtgatgctgtcctcggcgagggcgctgctgaaagcctgcacgtcaaggactacaagtactgatctgcatcaggcgctggcctgctatggcttggctacctgatcgatttcccattctggggccgttacataatgcggttttgatatctagaggctctaacaggattcacaatttcggatcggaatttcagaatttttccctttccgatagatcgaaccctggagcacaatatatctgtggttatctaaaagccttgtcttaataatccagaacctttttttttcttgtaaaatatttgctgatgaacatcagctggcccggagtttttatttttatcaatcactttgtaactgtctgatttgcccggtgctgtgtgattttgttgaatgaaattaacttcacttctttgagtttagtcgattgagctgctctatttcaatatgaagctttgaagccttaaaattgttgaatttataagcctataacgatttaatttattccatatataaatcatgacattgcagatttaaactagcataaacgcatcattagatctacacatataaactagacaataaagcatgaacagggagcagtcgtgcgaagcgcttcccgaaaaccttattgccgccttctcctggtgctgaacgtcgaaggcggaggttccgaacttgatcaggacgcctgcacgatctccactcagcttatatagagatatcagggcgcctgcacgatctccgcttagcttatatagagatatcaggacgcttgatcaggactcctgcacgacgtacgatctccgc

SEQ ID NO: 42766 - DNA, 800 bp, Oryza sativa
aaaagaataacagaaacgctacttgagtttgatttaggacctgtttagtaaagttttcacttatcccgtagagctggagttatacaactcgggtattctactcctaaaaattacatataaacataaagcgacattcttttcctccaactttaaaataggagatgtactaaatggaccttaaaaccttcctcccgccacgagccacgcaccacatggcgtagcatatactatgcgtatgtttgggggagctttgtagcagttgtatcttctctcagaatcaaaagctttcccaaacagtccagcttttcaagctacttctctcagtctcaagcttttatatagctgtgcggctgtgttgggcatgtgagtgcgagggtgtggcatcatgcaagccttgggcttggcacacgacgcaaggctaagttcactctaggtccctcaatttgtcaccgagttcgaaattcatccctgaaccgaaaaaccggatataatgtatcctccaacttacaaaactgtgcaaacaacgtcccttggtggtattatcccctggtttttgctgacgtggcacatggctcctttgactaggtattcatcccgcatgacattggcgtggcgctcacgtggcagtttggtgtaaaaaaaatgaaaactaaaaaagtaaacaaatatgcgggacccacaattcagttaaacaaagaaaataaaacagtgggacccacatgtcagtggccccactttcctccatctcaccctgagatctctctaactggaggaggagacgaggaggctgaggccgtagg

SEQ ID NO: 42767 - DNA, 1501 bp, Oryza sativa
ccttgtgaaaatgaattttggcagttgcataaattgtttttatggtggtgtgtagattacaatttacatattaatgtttgaccaacgtctgacaattcgtcttatttaaaaaaaattatgtaattatcatttagtttattgtgacttgatttatcatcaaatattttttaagcatgacataaatatttttaatatttgcataaaaattttgaataagacaaatgatcaaacgttggtcaaaagtcaatggcgtcatacgttaaaatacggatggagtatatcataacctgcagctgtgagtaggaatacaaatcagcgtgtcattgaactaagcatttttttttacttgtgtacactacaagtacattcaagcaaagtgatgagaaaaaaagaacaaacatacaatgagcatcagttgcttcggcaacagataattatctcattataatgagaaacctagacctatttcttcatctttcaaaagcttggcatgatccacacgggcgccggccagttgaaccaccgttgaggagagactatctcatcggagctatcactgcccaaactatcccgacgagcacctttagagtcgtacatattagaaactattaagtgtggcggaaggggcggccgctgagctacgccacgtcggatagctacagtgcacaggatggatttttttcgaaaaagccctccggtttatttgtaattcggtgtaggtctctcggaacagtaccgctgagacgatattttacgttgtgactcttcgaaaagcaagatattccatgcaaaggagagaaaaaccgagaatcaggactgcgctctaaaatgttgaatccgaggggttttttcgaaaaaaatacgcccactaacccacccaccaccaaaaccctagccgccgccgcccaatccctctccctctgcccgctctctccctctccctctcccacgccgtcaccgggcgccgccgcctccgcctcccccttgcgccgtccccattgccgaccgccgcgcctccgcctccccctggcgccgccgcctcggcccccgccgccgtcgccgcctccccatcgccggccatctctgcctcccgccatccccatcgtcggccgcctcccccctcgcgccatcaccgtcaccgagtgcacccgtctcttcctccgccaccgctgtcgtcgtcgccgagcgccgtcggtgccacctccgcctcgctccgccgctgctgccgtcgccgagcactgccgcagcatcgtcgtccactgccgccgccatcgccgagcgtcgccgctgcgtccttcgccgccatcaccaacggccgctgctccgccctccgttgccgctgccatagaagaaacggcagtggtgacagaaccgacatcttcggcttctccagtttccttccacctcttcccctcacctcctcgccgccttcggaagccctagcgaagcgactgacgcgagcgctgaggcggcggcagaggaggaggaggagcgagcacca

SEQ ID NO: 42768 - DNA, 418 bp, Oryza sativa
ccctatattattatccccttgtactcccttgcattaattatgcatctccggtgtggcttgctgagtactgttgttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacatacgattcgccatgtgaaaaccttaacggcgtaatcaaatta

SEQ ID NO: 42769 - DNA, 770 bp, Oryza sativa
gtcaaccccaaaagcatgggcttgaccacatcaataaccttgataatcactacaaacaatagcctatagatgacaatcatgccacaaagtaccgcaagatccacccatcttgaatgacctgtttccacttgaaataactcaacaataactttttcaccactcactgtttcctgtcctcctaggttactttggaagactaaccctgagaactcattcttgtaaaacccctgcagtgcatacttgtgaaaggaaatgtagtacattgggtacttccatactatctttggaaggttattaggtatttggaagaatccactagtaagcatcataataccttgtataccagcacctgtgattatccccattaggaaatctggtacaatggttgctacgatcatcattagggcttcgactagcattgtgcatgcacaaagtactagcgcaaaatagacaaaatgttcaattttcccttgtaagccagtaagatagtatgcaattgcaccatgtactacagcattaaggagaaggtatggtatggatgacaatgtattggagatgacaaatgcggccacaccatagtgtccatttagtcttttcctgaagatctgagcaacatgagacatacaagagtttaaatttcattaggcaaaatttgatgcacaaacgcaaattcatttgataaatgaatgttttttctaaccagattgataaatgaatgttgtcttaaaatgaaatatttagttttggtcaggctgcagaatgttaggagc

SEQ ID NO: 42770 - DNA, 1501 bp, Oryza sativa
gagcaaatgcagtacctgttaagcctagcgctagtcagaagcaaccataatactcttgtatcagtaatcatatacttatgttttatagttgttccccgtcaatcatgtaataacagagaaacatgagattatgaaggagtttgataagtttatgaaggatccatgttaagatcgcaagtccggtgagttgtgtacactttgttgctgattagggagacccagggtctcatctccgtaagctcataatctattatgaatcaaataacctcgcgattgatggcgaagaaaatcaagtgatcaaccaaagagacatttgtttggactaagagtttcagatgtgtcttcttcggatcaaaggcatgcacccgttgtggagaaattggacacgttgctagcatgtgtctcacactctgcactccctatgaagaagaccatccaccaggggagtgtcccactcgcaaggtgacatgttttctgtgcgaaggagcaaaccgtgggcccaaggattgccaactcagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataataccttcagcattaaccattctctgcaccgacagcctcagcaaggaattgtcgtcgatggaaaaagttgtgtctctccccgacctactccaggccaagcaaagggcaatcaacctccggagggcgataccaagcagaagaccgtcatccgcttcaaacagcaatcagaaggaagcttctcctgtgaatgatagcaatatgcagtcctatcacataatcacagaaccaatcaaggatgatgcagtcactagaacaatgccagctatatctctccagaatcaaaatgagcagccatgtttgtggttttcagttcgctacttatcatggtgtaatcgaaagtttgcagcaatcatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgggattcttttggaagagatcggaaaagatgtttggttactgggaaaagaagtaggtcgaaaggtgattgataaaggataacgagaaccatgatttgtgtcactcgaggaagactcccgatagcaaacaaccctacaacagttgccctgtcattaaagtaggtgaattcacgagtaagagagatgaccgcaggtagaagtacttctatggggacaaggatggaaacttttgtgacatgaccaagaagtcaagaagtaaaacctgaacagtggaatctaaagctcggttcaaccttgggctttgtatcagatgct

SEQ ID NO: 42771 - DNA, 1501 bp, Oryza sativa
gagaatgagatgtcattctcatctcgagaaatagtccccttcagaggaatatatgtatatatacacacacatacatacatacatgtatggggtgctttcttttgtttgtgctttcttttgtttttccattctgtttctcatcgaatcatttctattaatgaaaatgaagctgtgccctttgctaaaaaaaagtttcccaacattcataaatctccaagcaattaaacggataatttttttaaggcataggcagcttccaaaacttcttgcaaattaaagtggtaagcaaccatatgcagaagaaccagtactatctggagcaaagtcctagagctaaataatgagaaccatccattattcacatttctcgtaataccaagtaatagtatgtcacattaattcttctgtttagcacaaattgtacaaaattaactaaacgatgaacagtcctagctaacaggtaatcacgtgcattatcagttcatcacagaaaccgagaggccaagacggtctgttactcatggacgtagatggaattgaaccaaactctggtgtacatgagaaagtttctcttttttaatatatcgttcctcttcgtctgttccaaatgaactctatagattcttctgttatttgtttgtccttctatctccaaatctaatttgaaattgctacatcaaccaactgtggcgttgtcttggtttaagaagtgtaactcatggcttctgcatatagctagaaatgaacacaaacattatacaaaatcggcagaggaaaagaaggtatgtgaaaaagaaaaagactgcctactctacatttgatagaaaattccctctaaaattttaggaatattgagccattaattggattgttttgattcgttggagaagttaggaataattcccctgtgccctcttcttcttccctacgccgttgccgccgccggagatcaacgagatcatcggagcgggaggtaaggtaaaggtgttgactattgaagggtccaaaatctgcaagacactgagggggcaaggagggatttttttgttgaatgaaggttattactccctccgtattttaatatatgacgccgttaacttttcgaacaacatttgactattcatcttattcaaaatttttatgtaaatataaaaatatttatgtcatgcttaaaaaatatttgataataacataaagtcacgataaaataaatgataattacataaattttttgaataagacgaatggtcaaacgttaataaaaagtcaatggcgtcatacattaaaatacgaatggagtatcaactagcaggaaaagaaacccatgtattaccatgcaaggacataatggaaagcaacggatgaaccaaagctaaagaattcttgaatggctgctagcttctccatcaaaagaggccaacagatgaaagcctagtacacgactcaagcgaaaatgttcagttaaattattgtcctcttaatttctgtcacggtgtcactt

SEQ ID NO: 42772 - DNA, 1501 bp, Oryza sativa
gcggcggcgggtgggagcggagcggaggaggaaagggcacgcggtggcgggtgagagaggagcgcaggaggaagggcacgcggtggcggcggcagaagggagaggagcggaggaggaagggcgcacggtggaggtggttgagtgggagcgatgggttggggatgggagatgagcagataaggttgaggagaaggtgtcaggctgggagggattttaaggatttttttttgtaggcggtgctcttaacctctgcttgtgaaatttcatttttgctgacggtacactaagttggccgccagcaaaaggaaatatattttcgctggcggtacattaagtgggccgctagtaaaaagggacatatttttgctagcggtacattaagtgggtcgccaacaaaaatggacatatttttgctggcggctatcttaactcggccttttcgctggcggtacttaacccctcagcctcattatatttttaatggcggtttatgcatatggccgtcggagaaaaaagtagaatgacgctatgaaaaattgattttgtagtagtgaattccaggcatgttagagggcgtcacatatggaaggttctgtactagtgataataccgatgtgacatgccaaaactttacgcctgtagatctaaacacccctttattttatttgtttgtctaatccccttcctttcattagtatatagtacttgcccaaggagtttaatgtgccagataagcacgcatttaatgactatattttagtgtgctccatgttcaagtaaaattcaaatcaaatttcaatacatgtttcttgcgtacgatactaaactaaatcttgtaactgctcagcacacacgaacggcagcacagaccaatttgccgaataaattttgacagggagttaattaattatcatcggttggttagtagtggcattagagcaggtacaatagcaggctattagccagctctaaatatattttaatgagataaatgatgagagaagagcagcggactacagatctgtagccagctgcagcacggacttcaagacacactgtgtgtatgataggtgggaccatatcttaatagtatagtaagcaattattatatgaattgactatttgattggctatagataaattgaagttagtagtgggctatcctatattagacttgctcttaagttaattacctcgagctaagtcccgtaagagaatgtctgtaagcacgatatggtcggcagttcatctcgcgcgcggttagtcttctcttctccggcattagcgtcctatttctgaccttgttggtgtcctcccttagcttgtcatgctgacaataacaaaataacggtgacagtatccatcagcaaataacgtattttaatagtatttctctcaaagatttattttggttttacagtgtcctacgagaacaataaagtcacgagtcataatgttcagcagcaaatttttcctatattacattgttggtgtatatcta

SEQ ID NO: 42773 - DNA, 1501 bp, Oryza sativa
gttagtaccatcagaaaggattctggcagtatgtcaatgtaggtatcattaagttattttgcttttgaaagaggaaccacctgtcagggaaaaaagactggtgcatgacaaggggaaaaaagtagtcgcaaagaaaattcgcaaacgaagttaggtttagatgtaaaaccacaattatggtctctggttgactttactaaaaaagatgagtggttttgttgtaagaatgttaactgagatttttctatgtaatgcttgaagcaagcacatacacacgtgttggccgcttactgatatttgaagatgataattctggcattcgcgtggtggagttgtggtgaaattagagaaaatgttgattgctggaattgtgcagagaacagcttgtataaaccttcgggatatgcaagtgcattttcattttacaaacttatgtagccaatgtaacactggtgcaatgggtttattattattctttttcgcaaatctaaatacatagttatttaaggaaaaaaaactattggggcatgagtttcttttagtgtaaaaaagaaactctggttaaaaaacaacttttgaggttgagtaaatgtgatttaaataaaaattagcttggctgcattttcttgttagattgaagtgtttaatactgaagaaactgagcagccacaaggaggctccaatggtatgatgtttgtgttatgcacttatttttatccttcaatttgcatgtgttattttagagctgaactatttttcctgtcgtacaggtcaaataaatcatggcaaatactcaacaaggagtctctcatctaaagagtactcgcagctaactggatttaactaataatgataccactgttgttggcattgtatgtatatgttggctttgtatgtacatgtttttcaacaagacaagtacaaattagtgaatgatccttcatctctagccttgtataaatgtgtaatatatgaaatctgcatgtttctcgttactgtagcacaattgtgtacaggcggcgcgccaatggcgcgccccatcatctagtactcatcatcgtcggtaaaatagacgtgatttggcagcagggcagggtaatccttggtggaaagacaaagggtgccattatgcccaatgaacaatgcctcatcttccaaggaatcgataggcacgacatcttggctgtcgaagtcaaccttgtatacatggaatccaaccgtacgcagttcttcctcctcgtcttctggcaaatgcgtcaacctccagacctgcaatgaccaatattttaaatagcgacctaagtcatttaacagttagcttctcaaacagctatagcgggctaaatggagctataacggctaaattgcggattgggatttggtgacattgcgccggtgacattccccgtgacattgagtcactgacgtgtgggacccacatgggtccaggcatatgtgagtcctacatgtcagtgactcaatgtcaccgattatagcgaga

SEQ ID NO: 42774 - DNA, 1416 bp, Oryza sativa
tctctctctctcccggcgctatataagcgttccccgtgctctcctcctccgtttccgccactcgccgcctctcctccccgtcggaatcgagcccgcaccgtcgcaccttctctccgccgtcgccgccgagctccagttcgccgccgtcgtcgctcgggacctcctccccactcggcgtcacctccatcggcttcgccgcgttcccgtcgacctcgtccgcgcctccgttttgctcgccgaccgccggagcaccgtcgtcctcgccgtcccgaaccgcgccgccgccttcttccgcttcggccgccgttcccgtcgtcgccgtcgaccggggtgagccgaagaccgttccattcgccttcccccttccctcctctctctcgggtgccgctccgccgcgccggtggtcgccggcggtgaccatcggggcgcgggcgcgttcccctcccgtcggccgtgccggcaaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggttgacgcatgggccccactcccgtggacccggtccgcgcgccctctccctcggctgacgcaataaatgagatttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccagcgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgaccatactattattgttattgatattattaccttgttcaccctagaataaacaaaaccccaactagtggacactctatttatggttccactagtatgaatttaggtagatgcttcgctgattaataggacaacattaggtggattttataattttagactttgggtatattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 42775 - DNA, 1145 bp, Oryza sativa
gctttaaatctaattcctcttgtgatagtaaatttattatcagtgtattaccataatatctacacaaataatagtggcaatcgttgtcgttgtaccaggttggtgatgggtggtaatagtggtgtggtggtggttgtggtaggtagtcaaggttacggataaaatatactctctatcttaggaatcatcagatatacggatacgttgtatcctcaagtataagaaagtatccatttgagttaaggaaatcagtgagttcttatggagatattctttaaggatgggaaatatcagagtactattcggaggggataaggaatgtatcatatcgtaaggggtccgttgtctctgtgttctggagagcaagatgatctgcggtataaacacatacctgtcagggttatggacccaccacataccatgtcctatacggaaacaacctgcggatataggagaagttacggataagaaaagacaagtagagttctacatggaaacgacaaggactactcggattgtatccatattaggtttccctagttctacttagacaaagggacacctatgggtataaatataataccccctaagaggagaggggggagccaccacaatcaacaatctacggaacaacaaaagccacaatgtacaagccagcatacgccaagacaagacgccggatatcgacttcagggataagcacggctagtcccctacggtgtctccggatactgtcaggagagacgaaagcgttatctctgatctcgccggatgccgattcgaggaggaaggctaccctgttgtcgactatgagtcagacctacagaccgccatgtgacaacagttagataggctatcccaaatattgtactggtgtgattatggtgaataagatcaataccggctttgcttaacaggatatagagttattacctgacaattcagggcccgaacctgtataaaaatcctcgtctatgtctcttttacctcagtctcgcgtataccctagtaccaacgatccccatactatgcaaataccggaatcgcgacatcaaacgtcgacagatttatattgaaaaaaagatttatgtgttggagacttcagtgcacaagcgttggttttcaggagaaaaattgcgtgttcc

SEQ ID NO: 42776 - DNA, 491 bp, Oryza sativa
agttcgaagaaaaaactcttcgattgccaatattatggcttatgtttctctgaatggttcctttaagagagccttagtaggtcaggatatgactaatggccatatttattgtgcttcaattgttcatattcatttgaccggggataatgatatttttagatggaattttcatcaaaagggtcaattctctgttcgttctatgtatttagttttaattaatcatggttatgttggagaggaataagtttatatgaaaacttaagatgcctcttaagattaagatttttatgtgatacctacttaaaggggttgtcttgacataggacaatttggctaggaggaactagcatggtcgtatgaaatgttgcttttgcatgaaaaatgagactattcaaacatttatttttggagtgtcattatgcaaaatttatatgctctacagttttcttgtggtttatatgctccacatagtatatctcatattttttaga

SEQ ID NO: 42777 - DNA, 1501 bp, Oryza sativa
ccacttagctagattttatttttttattaaaaagtataaagaaatttataaaatttacaatcaaagtagttagggtgacaaattaactgacaccgcaactacttcattatcccagtaaagatgtttgtagatttgtactaataagatgtaccaaaaacaccaaaaaattatatctctgcctcctttacacgtatagtaccattagttcgtacgtacttcacaaacagaagagtacatccattaatttagtttaaaaagttgacacaaatttacttggtacatatagaaaagtaaagggaaatgctaaataacaggatcccgtcgggacgggacaggatcccctttcgtccaccgcgtcatccaccgctgcagcacgagacgaagggattggcttggagagagaatggcggcgccgtcgtccctcgcgtcctcccacctcattgacctccaccgcgcaggcggcgcgtcgccgtcgccgctgccccggtgcatccgcagcaactccgcctcgggtgctctcgccgccacgcgcagcgcatcgtcgccatggccggatccggcaaggttgccatcctccttcctgcttaaaccagtaatacaagcaagcgatgccgtcctggaagcagcgtcggagctgggccagctccttggacacggcgacggcggtgaagccgtcaatggcgtgattgtacgagcagaccagccgcagcttgccgccggcggtggtgttgccggggaggaagggtaagtactagctcgctgcgcgccgtcgtcgtccatgccgacggtggcggcatccggccgcggcctcaggaggatgatgtactccttatactccaattgatcctacctccttatacctcccaggtttcacataatcctactcaagtatcatttgtgaaacccgcatgaaaccactgtactagacatgatactagataggatcatgtgatacttcacaagtatcacacataatgatatatacttttgaggatcatgtatcatgatacctgggtaggatcatgtgatacttcacaggtatcatacgatcctactaaagtatcatctgtgaaatttataggattatgttaccagacatgatacctaagtagggtcatgcagatcctcctagggtatcatctgtgaaacctgatgatagcagacatgatacagatgaggatcatgataccttccaggtatcacatgatcctcccaaagtatcacttatgaaacctggtgaaaccgaacatgatactaagggggatcacgatgcctcctaggtttaacatgatcctactcaagtatcacatgatgcctcataggtatcacttgatacctcgtaagtatcaccttctatgtggtaagaatcgtatgataccttacaggtatcacctgatactttacaagtatcacatgtatacgtgataggaatcgcctaataccttatagatacctgatacctcgcaagtatcctaacatgcatcaggtataaccatcaagt

SEQ ID NO: 42778 - DNA, 1501 bp, Oryza sativa
gaccaaggagaatttaacaaaaattctccgggccacatttgaatttttcttgtacgtattttagtgtttaccaatttcttttcgaattttaactaattctattattccttttagagaatgatttttaatttcgggatgaatttatcaggacgtgacaaatccaccccccttacaagaatctcgtccccgagattcgaggaggctagcaagaagataggttgggcggtcttctcttcttgtctgacttcttccgctctggactgcttggctcgatctcctgttgcagaagaaatcttctcttcacccgacttgtccctggttgcacctttaactgactcagactaggctgcggtggttgaggatggggcttcagttctagaacttcttatcattcatatctttggcgtcaacctcataccagttaccaccttcgtgacatgcgtcgacatcagctttgtcattactaggatatcatgtttggcaacttgcccctaactgcctcatattagctttcctggtctccgggtgctagctacttctgctattcgattccagggtcaaccactctaactataagttatgcttcccaagagaaccaatttatcccgcttgacatgctttgacgtcttcccgaatgactttgctgctggacttgttattgtctgatcgtgatcctgccagatctgaagcttcgttgttagaggtgattttaatctgacctctgtagactatcttcgaacatatcactggttctataactgggaatggctctcacgaacaagcagctcggattcactttctttatgttcagtttactttccgctattctcttcatgttgtcatcatttagcattcaacgtattcctgtgcaccttcagccttgatgtgttctttctcgatggatcgattgctaggaaaatgcgttgagcgatactattgcaagtgcttttattctagtagcatctgatacaaagcccaaggttgaaccgagctttagattccactgttcaggttttacttcttgacttcttggtcatgtcacaaaagtttccatccttgtccccatagaagtacttctacctgcggtcatctctcttactcgtgaattcacctactttaatgacagggcaactgttgtagggttgtttgctatcgggagtcttcctcgagtgacacaaatcatggttctcgttatcctttatcaatcacctttcgacctacttcttttcccagtaaccaaacatcttttccgatctcttccaaaagaatcccatggaacttgtctgtattacacatttctccctcattacatgaatacgaggcactgccttaaacaaaaagggacggtgcttaacatcggtacattgtatcctcaacatgaatcatccataagcatagcaagctcactgtttatagacatgaatatatttatgtattacatgattgctgcaaactttcgattacaccatgataagtagcgaactgaaaaccacaaacatgg

SEQ ID NO: 42779 - DNA, 1501 bp, Oryza sativa
tgtacaatttgtgctaaacagaagaattaatgtgacatactattacttggtattacgagaaatgtgaataatggatggttctcattatttagctctaggactttgctccagatagtactggttcttctgcatatggttgcttaccactttaatttgcaagaagttttggaagctgcctatgccttaaaaaaattatccgtttaattgcttggagatttatgaatgttgggaaacttttttttagcaaagggcacagcttcattttcattaatagaaatgattcgatgagaaacagaatggaaaaacaaaagaaagcacaaacaaaagaaagcaccccatacatgtatgtatgtatgtgtgtgtatatatacatatattcctctgaaggggactatttctcgagatgagaatgacatctcattctctgctccactattcatgttctggcaagacaacgtagaataaaacaacttttcccaacacaaagtttatctaaattgtcagcttttttttctaggcaccttgaacctaaaaaactcaaggggcactctcaaaacaacataaaaccagctttcattccatcttctcgacacttagagtcgattgttggtagccctcatgccaacacggttgtgtcttcgatggtacttctcctaacatagctgaagacttgctgtttgcaagagaagagttgtatgaatagggtttggccgggcctaagggcattcttgtcctcatgccgaacagtaaatagtgtttgcttgtaataggttgaagttgtcttttggtctcgtgtaaggtctattgtgtgtgttgtaagggttcttatcctcttctttcttctccttaatataatgataagtagctctcctgcgtattaaaaaaacgtttttgggatctctctagctaaacttggacttgaagatcttacttgtgacttgtctgagcagtcagctcgccctagcacaatcttccttgctttccacaattcaagggaacctataattgataaaatgtacagacatgttgtatatatgtgaaattgattaaagggagatatggaacacactatacaccacaacatcaaataggaagcgttgtcatgcgcatgggttccatgcctttgaaacataccttcatggtttatcatatatatatagttatggatggaaggcatccttcgaaacctctgcaacttttctatccaagataacacagctgtggcagataaatgctactgttttgcagcgccatgtttacaccatcatcatcttgttgctgccatcagccatcatatttcacaagatatagtagggaaacagtagggtggcaccacatcaaacaaaggagcagtgcaatgaatatacaaaacgtaaataacaattaaacatgatacatatacgtactatgttgtacgaaatttgaacaattgacaacttcacgtactgatgggagaaatctacactggtggagaaaggggctttactcctggttcgtaacc

SEQ ID NO: 42780 - DNA, 1501 bp, Oryza sativa
tgaaaaacgtgcttgtagaatacgagagatggattggaaacatagagagaagaactcagcctaagattgtgtgttggtaactatatagggtcttcgtatgggtcctgttatttaatggcctaagattcaatctgaaaattttaatttgtttttccccgaccactgaattgtctgtaaaattcatatgccacgtttggattcaagcgtacctagctggtcttccacgtctggtatgcacggtgatcctgcttgtagtttggttgcggtaaccagcgatttggttggatccaattaatggaatcaccctggtccctttcaaaataaaacgaacgtttaagaatctccaaatttggcagttaataaaaaacaacccagcattgaccctgacaaaaaattttaaaaatgttcaaaatttaaaatatcattgttttaacagcacgagtatagataagttacaactaaaattttaatattgctaatcatggtacttataccttttatagattacaaatttctcatcagatcatagaagaatattgtctggaatttttaagataataagataaattcgactagttaattcttttacataaattaaacaacgacgcaagtactacctccgtctaaaaacagtgtgcaattctggttattcatataaagaaatatatgcacatgtgcgtagccagaaatgtattatttttatgttggtagtataatattataacgtaaacattgagaaagatatacaatcctagttatacaaacgtccgtcctcaaaggcaaacctaatcgactatgatataaaacttctaaaacctttagtgagtagtactatctccatctcaaattacttatctttctaggtagtttggcatacaataaggtttgaaataaaatactataataactttatcaaataatttatggttgagaataaaacggtggttgaggggtataatatggaaaaattgaaatgtgttgtgattgatgggataaatagtaatagagaaaaacgagatacctgtccctttctacttgtcaccgagaagaatgctagacagtgaggagaagtgcggaagggggaccgaagagaggttgcaattaagaggtctttcgactacatgcacgagttgcgagagcatatttaccacgacacaatcatctttccataataaatgctctttgatcagttcagtgttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 42781 - DNA, 968 bp, Oryza sativa
gaacgaatccgagggagagagagagggaaaaacgggggaaacgggagagggaatcgcggggaatgattcccccctcattatggcgcgcagggacggtgggatgcggcggaatctgcggcggcggcggcgctagggcacgggcgagcggcgggagcggcgggaggaaggcgatgacaggtgggccccacccgtcagcgagggcggcgggcgggcccgcctgtcagcggcgcgcgcgcggggaggaggccgatgggccgcggggagaggagagagagggagggagagttgggccgagccggcccaagagaggaaggggggaaaagaagacttttagagatttttctttttataaaccttttcaactttgtttatttcttctcaattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagagaatgatttttatttcgggatgaatttatcaggacgtgacagtttgccatagtaaagtgtcactttttatcatgataaaataggatagatgtcggacatctatatgcggagattattggtttacttgacaaggttattggaccttggggcataggttgggttggacatggagatgtcaccccaacagcacaagagtcacatatgatgtgattagcaaggtgttgcttacctgttttgataattgtctagcttggatgccaaagctcactagacactaataaaatgaggatcttaactcactatgttactagagggaattttgtttcacaatacataatgggagtatcttttgttaaattgtttgatgaaaggttaaatgtaaacatggtgctgattttgcatacatatatttctattgtaga

SEQ ID NO: 42782 - DNA, 1501 bp, Oryza sativa
gtcctcatgtataatcaagttgaatattgagacagatgatacttttcaagtttgcaacggatctttggttggtacggtttgcttgttggcttaactttgcgtcttcacctatacatgatgaactgttgtctcagccccctcatctactgctcaaatataaatttccttttagctggtggtggtgaatcttccacggtgccaccaatcctctacattacattttctaaaaactagcccctacagtttttagcattacggattatagtccatttatatactgatttggcctccttaaattcaaatttagcagtcatttttcatcctttccactcttgcagatgcaccctaattcaaacagtggaacaacttctatttgcatcatcgacgactgcagaaccaatattgacaccttgggtacattctttcatccttaaaattatcccatttcttatatctcccgtgttattttcagcactccttccttttccttttgaaagttatgaattgtttttacctgtgcttgtgaactaaatctatgcttggcacagcctctgatgcgagcactcgatgatatggaaaatgccaacgcacaagttgaagtttctgtggaagaagtaacgaaggctcgcacccaaaagataaaggtattatcatgtgcttcttttccctagtccctaccaaataacatggcaaagcttgtgcgttacatattcatcgataagcatcatggtctcaattgcacattagatctttgagaatcgcgctcatgaagttgggagggagaggcaagtgttcgtcgatttcttcagcaaccccgagcgactcaagaatcaagtcagagagcttacctcccgtgtgaaagctctccaggaataaatagatagatagatatccctcgtctagtttggtaagcacatgagattcaatctctacccctgttgctcatatacaagccataaaatctcaccctctgtttctagcatttgtgtgccaggtcgtcccgcgaaatgggaagcaacagccaagctcgcaatgatgctgttgcttgcaaagtttcccttcctccaatgcgaagtttgggggaaccatcggttagtttgttggatgttgaggtgcacagctgctgttgttatattttggggatgcagtcgtgattgttgtaaagtaaccacgagcccgtttcgtcgtctgattgatattcaggctagatggtggttgtacatttgtgtactggtgttgggagactcgaaaactagcattgcttagtgtgtatattagattgatcttcaattatttgaacactgctaatgagccctatattagattgatcttcaattaaacactaacatttgatgccaatgtgcgctgtgagggttccttcatatttagactgaaaaataataaataattgggacttgttcttgctcgccggtggcgctggaagtttcatgctccgggattagagatcaggtgaccaaatcaaagtcaatatacctcagca

SEQ ID NO: 42783 - DNA, 1501 bp, Oryza sativa
atgaatttaattttagatgtattgtaatggcattgatacgaataggtgcataatagtagtatattttcaaatcatgtaatttgcaatggcataaatcaaattaacccaacaaattatgtgtatcatttttgtcaagttacataattcctgcgcttaatttctttttgggacgtagaatttttttctcgcattttccgttggatcaatttaattactaaattctaaaggaggcttaaacactttagtgctgatgacgatagctgaaaatccatggtacaccctggtgattagggtgttaattcatgctactcacaagtgattttagggtcgttgaatagatatcatattgttttctcttgttcttagcgccaatttgtggagccctctagcatctgatctctagttttcgtgtgcagatattaacagattccaaaatttttaatacactactttctcaaatatcgtaaaagttaaaatcacatattaaactatgttcatatacgtgttggctatgtatatcaaattgaatgtggtgaccaggtttaatctaaatccattattaaaagcgaagtgagcatacgtggtttaactagttagatcactcttggtggaactagtccattcggattcaagttatagatttaacattctttcaattataatagtgataagctcgtgatgatttagtcaatcccaagatatactggtccaatctttcaaatatattcatatggataattgatagggtgtgtgcgtgcgcatttctagtgatgagttcgcacagcgctatctgctttaatttttaataaaatccattattgaaaaaaatacacgtatgtgtgcacatagaaaaaacaatcaaatcaaagggcctttatgtaagactgactctgagactggaccaccagtattattggcagagcagctgaagatgattagtttgtgggtactaggccagttattgcctgatcgtattcagtttgagccaattggcaatctgtattgctgcctatgaatgccaatacgcaagtgcatgcatgtccctttttgctcgtttgtaattgatctgtttcatgtacatttatgtacgtctgactgtggaaaacatcgatataaaatgtcacaagtacttaactacttataccaaatagttgagacatttattcttgattttttttaatctatcgcaaaaaagccagccaggctagtgatttatattttttacttagaagtattacttgatatatgtgggagtaaattccaaggaaaatgtaactaggttcttcaaactttaatctaaatttacattaacttgaaatttagttaattttactttaattagcttgaaattttacaaatgggtgacaataattgtgcctagttttatcaaaatagtcataaatcacatatatttctaactagaaatttcgactttttcccaccagccaaacatataactctccactctccaggcacagcacgagaacgcctcttcaacaca

SEQ ID NO: 42784 - DNA, 560 bp, Oryza sativa
gtatctgaggtatgctctacccatgtagaggcactgccttttcttgcaaaatacttacattatattccctagttacaaaaattggcacttcatgagtctgtttagctggatgcatatgggtttgcgtgtcaattgatgaaatgtatatggttttcgacagagttttcatcaacgtaatgccacatccatttaataccataagggttgaattgcatacttgcatctggtaggatttaatgattcattgcagattaaattcctatttcagaagaaaaagtgttccaagcactgtcataaaatagctttcagttgtgaaatctctaaaccacgggcagctagaaattataatctgttatgcagatattagctttgttctgctataagttctcaggaaaaagaaaaacactcatcacttataagatactttcagcacttagaggataatatgccaatagtaattcttactgcagtgcatcagacatacttcttttagcatatggttaaaattttcccgagataggcttgtttttcccagtattcactcgttctccccctccaga

SEQ ID NO: 42785 - DNA, 211 bp, Oryza sativa
aatgacacctaatcaaaactaacctaagttgctaggcttggtgagggtcaactctaactaagcaactaagttatgttttgcaaacctagggtgatagtgactcaattatacctctaggaaagtaaatcacactcctatgtcaaagtttagcaatcctagggtgatatgatctcaagtatgtctctagaaatgtaaatttcacaaatataaa

SEQ ID NO: 42786 - DNA, 999 bp, Oryza sativa
aaagtgtgcccatttgggataatgaaaaaaatggattgtacaaatgtgacatatggcaatgccacatcgaaattctactggcatctccttttcctggcacaatggggctttagaagtgacctatgccacatagagatcatttatgatagtttctacgcttttgattccttgccaacctcattgaacctgcagctaaggttttcgtaggattcctgattttttacaaattcattttgatttgtcatcttaaacacatagcagtactcaacatcctgcggaactattgggcaaactctatcaaatcatgtgcggcattgtgttgaaaaacttggtttttactgtatcactatcgtgcatgagatgcttctaaatttacattttcactcacacctgcatttgtattgtgtaatcttggatgaaccaggacaatttaccattgtttggttgccatatttaattagtaacatatttgcatagatgacttctaaagcttcccctgcttcttttgcttgagttattctcaaatgacaaaatagattttgcattgcaggtatgagcaacttgtggaagagggtaggctgctagaggtatattcaccaagacctttctggaacgtataatttctgttatctttaacagtataggatgttgcggagctgctcctgtcagattgtgcaagcatggttccaacttccaaatgttggatgcctctaggacaggagttccagtttgtgaacaactaagatattaaaaaaatttcctagattttctggcaaaatataagatattagccagttttcaatggttgtcatgggatgctgaacctcaaggaactattcccatccaagatctgggactctgcttacaaactataaactcaaaattgggtttttgttctttacattctataacataagctgtattgtccacttgtgtttttgaacacttatatctgtgatcctgctaaaccttaaaactcatgctatcattggcattgtt

SEQ ID NO: 42787 - DNA, 1501 bp, Oryza sativa
atttctttcttctctcctctctaaaagtttttggggaacttttcatgttcagtttagtaagataatagcaattttgtatcaaaactctgatttgatattctttggctagttaaaaactaatgaaaaggttaattaaaatcttattgctctcgtgaataagctccaaaagtgtccctacgtacaggccctcaaacagcttccataatttctatacctattggtttgtaattgtttttttttgctttttcgtattttcaaactcctagtttattgtgttatatgtggctttgcttggcatggctccaactcatctcaaattcttgcagaaatagagtttacaaattaaactagagttatgcgcttaatcctacaattttagtctaaaatatgaataaattgtcttacccaaatgacttaatctatcaagagctccaacaccaagataaatttctgaacctagaaagaaaacctgctgctaaaaaaatactccctgcgtcccataatataagggattttggttctatatataatttgtcctacaatatacaatattttttatcccatttatcaactcttgtattagtttgttttcccatttatcaactcttgtattagtttgttcttccacctatcaactcttgttctaatttattcttcatctatcaaatattgtactattttattctcccatttatcacaatttgtactacatgttcttttgctacttccttaattcatgttaaaaatgacataatataatctcttatactgtgggacggagagagtagagttggagctatgttgataaatagtacagtatatatatgttcatgatttgaacttcgcactttcacttctcttcggctaaattaattatacccaacactcacagccattcatgataaaccccttatttatgcatagggcccactgcgccgccaactagggagcaccgccgcgcgtcgccttgccggcctcgccgggcgcctgcccagccacccgccgctctgcggccctcccggccgccgccgccaggcccccgccctcccagcctctgttgacggtcattatcgatcagtttcgaccgtcaatattaccaaaaaagaggagaactagtgattcttgcaatgcataaatatgttagaataataatatttaactagtattcggtatactaaccttttgcagagaataacaataaagtgaaggaggatcgacatcaactcaaacaataaatcaatcggacgatgtcgagaatcagacttatgcatgaatgggccaagaacttagaattgacacgatgaattgggccaaaattcacaagtctacaaagtgaagcaatagaggaggtcgccagctgaagatgggctggtttgggccagcccatggttcggccgaacccccatctccaccgttgaggccagggttcggcatggacgtccaagattgcaccccaatgacagttggagagtacttcggacaattccttccaaccgtcaaa

SEQ ID NO: 42788 - DNA, 1501 bp, Oryza sativa
cccgcaagcctcttgggaaagatcaacaccaatgacatgtataagttgaagaagaaggagatggaggaagcctcaccttccaagaagtgcattgctctccaagtcgaagttgaagacaagggcaagggcaaggtgaatgaagccaatgaggacttagaggaagagattgcccttcttgctagaaggttcaatgatctcttggaaaggagaaaggagagaggtagggactccaactccaataggagaagaaatagaagacccaacaagactctctctaacttgaggtgctttgagtgtggtgagaagggacactttgcttccaaatgaccttccaaggatgatgatggagacaagtcatccaagaaaaagagtggaggctacaagctcatgaagaagctcaagaaggaaggcaagaagattgaggcattcatcagggaatgggattcaaatgaggagagctccgcctcatccgggtccgaggaagaaggtggtgatgatgcaagctccaagaagaagaagatggccgttgttgccatcaaggaggctccatcactcttcgctccactttgtctgatggcaaaggctcctctaaggtaacatctcttagtgatagtgagagtgatgatgagtgtgatgatgtttcctatgatgagcttgtgagtatgtttgaggagctccatgcttatagtgaaaaggagattgaggagctccatgcttctttggaggtcttgtatgaggagctaaagacctctcatgagagactcaccatttctcatgagaagcttaaggaagctcatgacaacctcctttccactactcaacatggagctctcattgatgttggcatatcttgtgatttgcttgatgatagtgctacttgtcatattgctcatgttgcatcatttagcatttctacctcttgtgatgatcttgtggatgtgcctagctctagctctagctcttgtgtttctatttgtgatgcctcacttgttgttgagaacaatgagcttaaggagcaagtggccaagctcaacaagagtttggagaggtgcttcaagggtaagaacactcttgacaagattttgagtgagcaacggtgcatccttaacaaggagggacttggattcattccaaagaagggtaagaaaccttctcaccgtgccactcattttgtcaagagtaatggtaagtattgctccaagtgccgtgaggttgagcatttggtgaatgattgccccagtggtaagccttctaagacatgcatgtttgattctcattatatgcttaggaaggctcatgatggtagcattgttgctagatatgtgggttcccctatactcggtggtaaaaagaatgtcatttgggtgcccaaagctttggtctctaacctccaaggacccaaacaagtttgggtacctaaaagagcttgatcttcttttgtaggtgaactaccgtaccggtggaagccattgggtgcttgatagtggatgcactcaacaca

SEQ ID NO: 42789 - DNA, 550 bp, Oryza sativa
tagtcctagggcatccatcccttgtgcataacctatgacacaatcacaaggcccaaggcctaaatcagatttggattagatgagatacgtcacctattttatagatacctgataacttggcaggaattttacatggaaccaaaataatatgaaagtatattccataagctttccaacaagtattcatgtgcccctaaattccttctatatcaacggctaggtccgtttaaagttgatattgtaaggagactcggttccgaatccaaaacggcaatataatttcataagagaatctctttgagaagttttatgtgaaattaaacatattttcacaggcgggcctcttaaacggcagggaaaatgtattttcacaggcaggactcttataggtctgtctagaagtttcacttacctcttctttccctctcagcacacttcaaaacttttttaagtcaccatccttccttctctcacctcctctcctccttatattactcctctcttgtttctcaccttctctcctctctctccctcaactttcctcccaagc

SEQ ID NO: 42790 - DNA, 1501 bp, Oryza sativa
ggcgccttcgtcttcactgctggctgacttgtctgctgtcgactggtttcttcgccaccaatggctatgcgacttcatcacctttgattggtgtcattgtttttatcatcaccaacattttcgtcacctctgactggcgatatcatccccatgttcgtcatcttgccttcatgtcgactacatcagctattgccaatggataattttgactatggcagaaggacaagttatatatgctcaggggcttatgaactcaaacacgaggattatatcttcaatttggacttgttccggatacattcaacatgaatttatggtcatgagtcgatttcttatgctcaacgactggactattcattatttcccatgagggccatcagctgagtgcttgcaccagtcgggattcaattatcacatttactttggtattctccatgagggacaattacgcttgatctacatcacccaggatatttatcacttgggatcatattatttggcgtgttctatgcgtcatcctttaaagggtgtcgaaggcatattttttggcctaggcctaatatgtctgcagcccatattatgagatgtggcctgtcacgttcttttagggacttaggcactttttgcttaggccaaagtgcgcgtgatccagtgcccaataccttaaaatccttttataccgcaattactcaactttttaggagttggtacaatgcatcttaaaaggtgtcaaacagtaaagctttatatagctgccccgctgacttttttatataagtcaaggtgatgtttgagtttttaagcaattgattggatacaatatcgttgctttttgccacgtaagtgtgcatttttatttactaatattatggcttaggctgattatatattgtggtcattttccaagcggttggtaaatcatttttgagtttatttactcggatttcataccacatatgccatatatttccaggtgtggtgaaaccatgtgtcttttagggacttaagcacatctgttaaagcagtgtgcgcatggtgtgtgcccaatactttggaaattttttattcacagcatataagcttctttatagctgttttattttcaatgatgtagtcaactttaggttgcactcatcatattttacaaagcagtcggtatatcacttggatcatgttatttgggggattcacaccgcatatgctatatattgatatcaagtcatttggttgattacaattatcaaaaccactcggttggttggattatttattccttgactatatgcttagtttgttcagctaaccacatagtcgagggctacacctattaggtgcatctagtcgatgcacctgactttatttttcagccctccatagtcttcatatttggtaaaagtactcgggagaccatggcaaagatgattgaagaacttggctttggagtaatctggttcgagagaagattatcttttcgactatgaaggtctcaggggctctgtag

SEQ ID NO: 42791 - DNA, 1501 bp, Oryza sativa
ggatggcataatatagtctcatttgcataaatggcatttaataaatacttcagaatttaataaaacagtaaagtatttaattacacaatattaatccaacgctatacaacatacccgttgcataggcccaaccattcttaacaaccattcccagcggcacagttctatctccaaaccaggaatataccattccaaaccaggagctaaacaagttattaccaattacagtatcatttattatggtgagatgtatgaaactaatcacgaatgacattgttagacccgcccataacagcgggcacggctattcgaatagttttactctggccagaggtgtaccactgtacccacaagacacaacctcaacatcatgtcaaccatgcgtcgcgatacttaacaagtacccgaatagagattgtgacaatacccttcgcataacacaattcaaagcagtgcacccttcctggatcataatcacccccttataaacaaggcatggactccccagcgacccctgtgggcttatctccgccacttcacagtctggtgctctacaatgaaccatactatacaaaaagtaaagccgttgcccacgctggcttgtggttggcacggttaatgtttcacaaccgaaaatcgtgaactggtccttaattgtcatgagcacgaccatcaaaaccatgtgctcacaacccaccattatcaagttttagttggcaaattaattaattaaccaatcacgattaaccatcgtgagctatcattaagccatcattaaataatagtgaatcataagttatcccatttatatgagctaatgtctctaagcatggctaagcatcctaagcactttagctaaaaccatataatgttctagctaatccaattattaaccaaatgacaaagaataggtaatcaataacaaaaagactataacaaggcaataggttattcccacccggtgacattcaaaaataaatgcgatagttgaatagaaacaatagctttaaacgggatcaacatgctcaaagggttttttgggatctgtgtgacttgccttactggccttggaactcttcaaaatcttctcctgcaaaatcggactctccgggaacgtcggaatctaagcataaaagaacaaaatcaccaaaacagtacataaacaatcataaacagcacatgtggatatttttaacatgtagatctcaattttagaaaaatttagagacttgaaccaactaaatccaagctaagatgaattagttatgaatttttaaagattaaattggattaaatcatttatatagattttaattgaattatgacggaataaagaactatttttgaaaaggaaaaaggatttattgcgtcatcggctcgggttcacggtggaccgggtgcacagggacggtctacggaacgaacggccgagatctaatctaaacaaaacggacggccgagatcgattcgatccaccgcgggtctacggatgacgcggcgc

SEQ ID NO: 42792 - DNA, 1263 bp, Oryza sativa
tgcggctgtcttaagcagccgcatgcgataatggatcttcgcatgcggctcgtcgacccgcccccgggggggcgagttttgcaggcgccgccacaagtcgcctgcatgtaaactaatgacctgaaaattggtttcacaggcggtgtatgacttgagacagcctcaactattatcgtgacgctattttttccgcccgtaaaaaaccaagaagacctcaactattttgtgatgctacttttttccgcccgtaaatacctggaattttttattagtagtgctccttacaggggtgacactgcgaataatccatttgtacccagaagctgctcacatctcaataatccaccgtttatttctctattttaccattatataccttttttacaaataaataccatgccacattatcgcgttaaattaagttgtataacatgtacaaataagatacaatataattattaaactaatatgaattttgagtcaaaaataattataattatatggttttatgggagaggaaaggagacaatttgaaccatatatattgaatccaaaggctaaaactaatagagataatgtggcttaatgagagaagagagaaatagtattaattatatttagtggggattaactatataagtattagacagattatgttgcagaaatgaaagaaaaaggtgcacattgaacctttcaacttgaacgtttatgtcctgataatttcaccatgatatatacaagaaccgtaactttcagactagtctactttatgacttcatagactagtctgttctagtttgttcttatccagcgaatctttgcgtagtttagacctgtctacacggatgatgatggcgacactactatcaagtctctatactggtgatctaccttggaccaaagctgggtgcaattaaatttgagtaaattttacataattataatatattaaccaaaccatgataaaactatatatttaacctgatataacaaatttagcaataaacttaccagaaaattatatatttaaggtaaagtattacaaaactagtggttcaacaccaatttaatcacaaaatatggacctttattacacaaactaatattagtactaaaaatttaaaccctaaagtatgtagttttgtgatacttagcttaaacctgtagttttgtgaaaaaatatttttaaatttgtagtttattgatacactaccttaaatatagagttttatcataattttgattaaagcatatgtagtttta

SEQ ID NO: 42793 - DNA, 1501 bp, Oryza sativa
cttctagcctgtgacggacgctgtgcccgattgagatggggcttaccgcccgattgagatgagggtatcctttctagtgtctctgtagaaatatatatatggatctagttatttgagatatgtcagatctatgtgtgtggatgagatatgtcagatctatgtgtgtagatgatgctatatgggagtgcaatctgtgggagtgttcaaaaattattttgctttggtcgatttcattaacaaatgtcaaaggtttctcaaagtttttagaattttggatcaaactgtaacaagttttagaaataagcctaaggatgatgatgtttggttggatgtatcattttcgacatggtgcatcgaggaatgattcaaatacacagaaatgaacacggctgcgatagagctctagatttaagttactagggatcaaattttagctttcctaaatcaagttcatgcatttttagttttaggacagcaagattgaaagatattcctatgactgttatggttattgagtttgatattagagatggttcgaggtctctaaattcttgcatgattgaagctaacctatcatactaccccccttaaaatttaaaagttttagcaagcaggattgtggtatggaagatgaacaagctaggtggtttcaggtctgtcctaggtgtcaatctgctgaaaatagaagttaatgaccaacctagaaggcttgtaaattcaaataaaatttatattcaggttgcttacaaagttttctatgttctgggaaggaattgtgatttttggacaagtactttattttattcaaaaagaagaagacagatgatgcagttctggaacaggttattatctatggttgttgaatttttatctcttaatctacaggtgtaaaaatcccacgaaaaatcatgaaactttcctgacaagaatacaagttactgaccaaaggttttcattttatcatttatggtttaggagatataaaattgttaagtatgcaacctacagatttcagaacctgactatgcagactatatgaatttttacaccttgatgcagaggttcaaaaattctaccaaaattcatgatgcttcatatggtagtacactaactactgctaaaagatggcatgcttatcacttatggtttgggctacaaaatttcgtgaaagttgctggctataaatttcagaacacgtgcaactaatgcatttgaatttctatagcatgttttaagtttgataaattaaccattccatcataacatgaaaccaacaagattcagaggctataagatttttgggtggtccatctaagcattcaatctagtggtcataacacaacaattccatcctaccccaaatctacccattcaaggtcataacgaaattttgaaatgctgggatagaagagcataaaaaacccatcaaatttcaccatggtacagaagtaacatgtttatgtgatacaacctaacatgtctatcaaattttaatttattt

SEQ ID NO: 42794 - DNA, 268 bp, Oryza sativa
agcaccaaccggggctaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattt

SEQ ID NO: 42795 - DNA, 208 bp, Oryza sativa
gtgtgtctcgcatgtgatttacatcagtggtgggatgtaagtgcatgtgttcgtttgtttttgagtgttatgaagttggcgagtttagtggggtgagagtcttcagtttgtaataatgaaactcagttaagatcaataaaagttaaagtacttctctgtcctaagtagtttcccccggtgtctcttcttgtgccctgtccatgccaga

SEQ ID NO: 42796 - DNA, 1501 bp, Oryza sativa
agacacgaagattgacccctgatcagttgtaatagttcgaggaataccaaatcggtagattatatattcttgaacgaattgagtcgcatccccagaatcaactttcttcaaagcaatcgcctccacccacttggtgaaataatcagttgccaccaatataaatttatgtcctttactcaatggtgggtttatcataccgatcatatcaattccccaacctctgaatggccatggcttaataataggattcatagccgacgccggcgctcgctgaattgccccaaacttctgacaatcttgacaccccttataatatctaaaacaatcctccagcattgtcggccaaaaataccctgcacgccgaagtaaccacttcatcttatgagctgattgatgagtaccacaaattcctacatgaacttcgccaattgcaactttagcctaatcggcacccaagcacttaagtaacactccatcaatcgtccgataataaagctcatcatccaacagtgtatactttaatgccttatatctcaatttcctagaagccgattgagacggattatgcaaatactgatgcacatcatacctccaatcatcggctgtcattgctgcaatttcaaccttaacatctttgatcatcggcttataccccgttgccccttgggccaaatcattagcttcaatattttgttatcgagagacatgctttagagtaaccagccgaaactccttcattagttcttggcacttctcattataaaccattaatgtatcattcttgcattcatactctcctgccaattgactgattactatcaaagaatcccccatgatttcaatggcatcggcttcaacttccttgagtaattccaaccctttgagcactgcctcatactcagcttgattattagtcgcatacggtttaatagtataagcaaactcgaaacatgcccccctaggggaaattataactaggccgataccacaaccatgagtacacaccgatccatcaaagaataaagtccatggcagtatttcgaccgagccgattgaatcatcacgatgttccacaataaaatcagctatagcttgtcccttaatcgccttcggcgactcataccgaagatcaaactcggttaaggaaaatatatactttccaaccctccctttcaatattagagccgatagcatgtacttgacaacgtcggccttgcatataacagtacactcgttggatagtagataatgcctcaaccttgtacacgaaaaatacaaacacaagcacaacttctccataggggaataccgagtttcagcatccaagagccgacgactgagatagaatacaactcgttccttcccttccaactcctgaatcaagactgggccgattgacttctcaccggccgataaatataacctaaaaatattcctttctgtggaggaatcaaaacaggaggagagctaagatattccttaatattatccaaagcctttt

SEQ ID NO: 42797 - DNA, 251 bp, Oryza sativa
aactcacagaagatgatgtagctgctagtaatagctagctaactagtatgtatgtataaggacccgtttggtaaggctccaaacttcaactcctatctctaaacttccactccagtgggagctggctcctatgagagttgcagaacagctaaaaagtgtttggctagcattcagctctagatctgaaattgaaaaaaaaaatgaaagaaaaaaagaaaaaagaaaaaagaaaaaaaaaccgatctggacac

SEQ ID NO: 42798 - DNA, 913 bp, Oryza sativa
taaccttaaaatcttaatcattcagcttcaaattgagtgcaatttgcattattcttacttgtattcttcgttgattcacatgtagggattagccttctcggcgaggtcaatcgggtttcggcacgattgataaccaaaagagacatggtgattgcagggttcgaattgcaagtttctgccaaatcgatagttattaatacatataggaagatttggacctagttcttcatcagagatcaaaacaaaactcaagaatatataaggatcaagctagcgaatatcggagacgttaatgaaattttagagggcacgtagggaattttctgaaaaataaacatcttcctccacttgatcctcattgatacatatacatcatgaaaatgatgttaaaaaatttacaacatttgcatgggggaagaaaagataaaccccaaaaaaaaaaggtgtaaatctttcactaacaaacatacgatgggttttcaattgattggcaataacctcattttattaacctgtacaactgaatttctcagggtatgtcaaaatcatctctgcttttttaagcaaatgaaaagatgaaatttgtcctctgcatcgtacgcacaagactgcaatgcacacgtctcgcgtatgaccattttgtgttgtgtttcaaagaaaatatataaagggatttgaaagaagataccagtcacactcgcaagggtgacatatatgatatatccgctatttgtgaatcagaataattaggccctgctttgattcaggttatttaaaaaaatattatcatggattttctactataaattaattattttaataattaaattcaataaatagcttgaaacaagttttctttaaattcaataaatagcttgaaacaagttttcttaatgatattgtggaaggatgt

SEQ ID NO: 42799 - DNA, 1501 bp, Oryza sativa
aatcctaagttaatttcctggggagggtattcctccgtatttagccccggttgtatggtcatagcgggttgtcgtaggaactctgcagccagtggtggcttctcgaagtaccaggaaggcatccgatagagagtattagctcgtatatcagctagctagaatgtatgtatactatgtatattacaagtataggaaaagattttctttctcttttctatccacttaacttagatgatatattatgagaatgagtagttaatgcttgtgtgtcactctacccttggattatcttaacccctgcttagaatatgattatcacaagtaatatataaattattagtcaagctgtctctacatgatcttcccacggtgtcggtgatatgggaccgggagtatcatgaccagaggcttgaggcagacgcaatcgcccacgtggcctagcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccagtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaggtgcatgtggtatccccttgagatataaaaggaggaccttgcccatttagagaggggactttttcctttttggaaggctgaggggaaaggaagttaatcttttgtaacttgtccatacacaaatccacaaaaacacaggagtagggtattacgcttcgcagcggcccgaacctgtatacatcgccgtgtctcgtgtgtcttgcgggcgggtgatctttccacatacagagagagagagagagcttgggattgcaccctaagcccctggtcgaaccggcaaaggggggcttgcgcagtctcccggtgaggggccacgagctccgtcatctggcgcgccaggtagggggctcagtgtgtgttttctgagctctcatactcttccgtgtgcgccaagtttcccttgttctgcctaa

SEQ ID NO: 42800 - DNA, 1501 bp, Oryza sativa
tgatgacgaacccagttcgaccgaccattccttagagagagagagtgattgtgggggcgaagatgtaatttatctgtaaagccattgccttttcttttacttgtacaatgttgctgggtttaaattattcgatatatttttcttcgaaatcaataaagatgtgttttatttcttttcgctatttttgcattgtcacttcgcatgctttcgttgggtcggaacgtgtcggcccctttgcgtatattagcgaaataggtttttgactttttagctttcggctttcgttttcgatccgttttattctgcgttggaggaagcactcgtgctttcgttttgatcgagtgtaacggtgttcggttagttgtttcccgaaacaagctgttgtggtttcaacgttcggcgagtgatgcttcggccgattcgtttcgcccccttggcattttcgctgatcaggcgtttgccttggggtttttcaacaaattatcaatcacacaaataaaaagaaggcggaggacacaaaaattttatactagttcgggcctccatgatggataatagccctacatccagattttttgtcttttttcattttcctcttctttttttttgcattttcgtgccgaaatgcttacatagtgccgaaaggcttacataacgatatgtacatttttacaagttggtgattcgggtgccacccattctacacatagaaacacttgagagaggcagtgttccaggaatgctcgaactcttcgccttccagtgtcgctaggcgaaaggagcccatcctagacttgtgcttgatgaggtacggtccttcccacttcgattcgagcttgccgaccgccactgggttcgctttcctccttaggacgaggtggccgggtaacagctccatcggtcgaactttttttgttataagctgccaaagtgcctgcggcatatttgcgcatgtgttctagtgcttcgactttcaccccctccaggagttcgaccgacacctcgcacccttcttcgcccccagagaatatcacccttggtgaattagcccctagctctgtcggggtcattgcctcatcgccatagaggagcatgaacgggctgaacttggttggccttatgggggtcgtccgaagggcctagagaacagatagcatctcatccggccatttgcccttcgctgcccccttaagccttttctttagtgcttctaggatcttaccatttgcgcgttcggccgccccgtttgactgcgggtgcgcgaccgacgtgaacctgatttccaggttaagcccttcgcacaactctttgaacttgctagagttgaattgcttgccgttgtctgtgatgaacttttttggcactccgaaacggcaaacaaagtttttccacacaaacttctgcactgctgctgaagtgatcgctttgaggggttcggcctcaatccatcgggagaagtattggatggccacaattgcgaacttgtacccgtttcgcacca

SEQ ID NO: 42801 - DNA, 1501 bp, Oryza sativa
ttttctaaacatatagtaaataatccgtttcaataattcggtgattaataatccatttcaaatagtgaaaatatatagtgcaaaccacgtatgtaatgtaaacctggaaactatagttggatctaacaatggacgcctgagatttatccatatcactttgagtataaattttatttgcagattcaatcatgaatagaaattttgttaggaataaaaagtttactcttaatggcgtggataaatcttaggcgttcatttttagatccaacgatagcttttaggttccattatatatgtggtttgcactctatatttttccaaagaaaaaagctaaggagagagaagacaaagcatagccagtaacttgggcagtttacagaattactacacatttgaacacatgtggacgacaggcatatatatagggagtcaaactagatttttattttattttttgagaaatttgccatgtgcaagttgacatgataattactatttgagacaagctaaggcccctgctggaatatctggggaactacaaccaactgtgttctggaagcaaaggtacatgccagccctaatatattaattaatgctaatccctggttaactttgttgtttttttgaaagatctggttaactgtaggttattaagccccagttgacaatttggtcctaaatggcaattctagctccagcaaccttgacagcacagcatgcacatgcatatatatttacatataaaatatatgttgttgtcactgaattaatggttgaaatgatcagacattcatacctttgccaagctaaggaagagaaaattaagaaataagaaacgcgtgatagaacgtacagtacgagtcactgtcttcagatgagatgacaccagtgggccgctaaaaatggtgaagatgctgataaaagccattgctttaattaggaccttgacctgccaaaaaaaagagagagaaagaaatcagtagtattttctttgatcactggtgatattttatttttgatattgtaaatccatttcaattttgtcatgtgtataaactatatatgcagaaagcactgaacaggtaaattcgtgagtgaattaatagatagtatatattaagatggatgaattaattatttagtttttcgtatatatatagagcataacctacaagatgtgtaagcctgcttgatgcaaactttaggttaaaacacaatgacatgtttttttttcatctcggtctaataagcatcaatatatatataatttagagcacatatatatcgtcttcttcatgtgaccatctgaaattggcagtgtgtctcacctctgttcagttttctgtacggctattttggattgctaccaaaacgtgccctactgattctttagcaacttaaataatagtgtatatggaccattttggtttgatgtcttactaaaattttgatagtgctaaaacttgaacaaagtttggtaggataggatacgttagatgtt

SEQ ID NO: 42802 - DNA, 1501 bp, Oryza sativa
acaactaaaattggtaatatcggcatcgggaaagaagattagatcgaagcgaagtcgaaggcagagatcgagttcggaaacagagcaggaatcggctggagtccagatcagctacgattaggatcggctgagtctgagtcggactaggtaagccgatgcagccgattccgacaatacaacttgatgtatgatatcgggttgaattgaggcgcttcaaggtgattgctgcacatgatagagtcctgagaaggcaattgtatctattaattaggatgttttatgtaatttccttagagatacgcttgggcaaaagtctgccgcaaagacttatggtatcttagagtttgttagagatagtagtcgtgtctgttatggacatatcttgtaattcccgggtataaatagacccgagccctatgtaactttgaacacacacgttcaatacaatctcggcgcatcgccacctttttgctttagttttatttcgatgagttcttgctttcgggttgagctgcatcggtttcgatcttcaacaagaggtaaaacttgttatgatggattatgttctcgggattagtgcttccatctttatgatactctaatcttgtctatgtaattcatcaagttaccatatatcttacataatcttcgacaatatcgtcatctaaccaacaatcggctaacatctgtcaacagaagacagccgattaggttaaatagcgacgttgacctagattatataagatatctactattctatgaaacttccagcggcttgattgtctagatattgttcttcttttcatacttagtgctgcatcagttgagtttgatctattaagtcgtgcttagaatatcaatctctagcctgcctcctggttgccgattagaatagtatcggagtttcagccgatcttacctgatttaattatatttgctctatatgcttcaatgatacattaaatctgccctttatgtcaagatcttactgcatttaagtatattaggctcttgtttgatatattttacttgttttagtatcctgatatagagtagtatgggagtattagccgatacacgctagatctatctgatcggctatgctattaagatatataaggttgttatcaatatatatttcgatctaagtgattcatactgtctcggcatggcgactgatctatccctgtcacttgatttaagtatatatcggtataggaactatatattgttaatatctacagccgatcgaatagatttagctctttattgcctatttacaaccgccgatcgattcacctatgacatcggctcaaagataaatgatatgtcatcggcacctagccgatcggctatcatttatagatttaactgcggtttctttgcttctatttcttgttgattgcaggatcaaatcaactggcacgctcatacattcgaaggcgagctttggacctgcactggagttaagcatggtgggtaatttttcacctaataatct

SEQ ID NO: 42803 - DNA, 191 bp, Oryza sativa
cctcctcccccaccagcagctctggaccagacgacgtcgtcgctgcctgtcgccgtccgcgtaccaccggatgctctccagcacggggcgcctccacggcgtgctcgccgacaccctccgcggctacgccggcgccgctgcggtggcgggctccatcggctacggctccgcggccgccgccgccgccgcca

SEQ ID NO: 42804 - DNA, 504 bp, Oryza sativa
cccagctgggtttagccagctccacaactccactccagactcaactcctggagttatatttaggagttggagttgtaccaaacaggccctaactctcttagcaaatgttgttttggatggataaattgtgatttattgtttggtagggactgcggtggagttacaaattatgagaatgagctataagagaaggggtaagaatggaatatagtaataggttatcaacaacaggtgaattagtgaacttgtatactattgctatccaacccagttcaatttcatctagagggattattgctttccagtacatgcttctgatttttctgtaaccaaagtcagctccttgttttccggggaaaaaaaagtgagctccttggtcagagaggtaacaaacaaaatgctcatatcctaggctaggctctccaccgcctccactgaggtgcaattcaagtaccttaaatttatttgcaagcccatcctttgttgcccttcctcctctttagt

SEQ ID NO: 42805 - DNA, 1501 bp, Oryza sativa
cccgatttcccagtctcaaaccctaaccctaggcgatggtggggctggcgacggtggcggtgccagcgacggtgttgaggacggcgacgacggcggccactggagctgtgatgatgacgcagtaaatcgatccttgtggcaaacccgacgagtcctggcggcaagtgcgcggcgcggcggtttcaagccgatagcggtggacggcggagcttagtttctaaatggaggacacgttctctgcacagctgtcagttaattaactaattaagttgtcctttggtgacaaatatttcctggtgccatagaccaattagcttctgagtggattataaaaggagttgcatcatcgccgtgcaggattgaggtggaagaagcagccaaaaacagtaatggcgcaggcggagaagacgagcgagagattttctttgtatgcggaatctcctgctagcttgatgtcaggaacgcgccaggaacgggcctattcgcgtctgtgcgcggcgcgacgcggcgcgcacacgccatgccggcatgccgtggcataccagttgcgcaggggtggattggtcttttagaaaattatctgacctcttttatctcggaaattataaaatattgcctccggtgtctcacagccaatttcacaacattcataatgtccgtgggcaaagccaatattttgcagtgtctcacagccaattacacgattttcgggtgtcctgtagcaattttgcctattaagtactgtattaatttttaaaaatatgctacttaaaattttatttttaaaatctagattcgtagttaggattgtattttttatagaatgaaagggacactttctttgatctagtattagaatatatctcataaaaccaaactctattatattgtctccgtcataaaataagtttatttttcactcatcctactcatccatacttgatcaaattccgatacaattatttccaactttcacagactttgatatgatataactttaaaagcaaacttattttgggacgaactaaaaatgagcttatcatgggatggagcgagtagtttaaaaatatttatttttaaaatttaaaattaaaaaaatactatatccgttttatattataaaactttctagcattgcccacattcttttatatatatatatatatatatatatatatagatttattgacatctatatgaatatagacattgataaaagtcttataacctgaaacggtgtaagtagtaatcaaataaaatttcgaggggaatagtagctcattataacaagctactactactactactggtacccccattggtagcacgcaagccactttctccgagatcgccgcgatgacgacgacgacgacgacgagcgccatcggctccctcctcgtgctcctgcttgtggtggtggtgggaggggtgtgctccgcctccgtgggcggcggcggcggcggaggggaggcgtggcgggcggagcaggagcgggaccggg

SEQ ID NO: 42806 - DNA, 1501 bp, Oryza sativa
caccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagttctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagtacgccgatcactacgtcggcgctcaatgtcgaggcgggcatccggctcttcatgctgatcctcccgagtcggaggcgccgacgaaggagtggtagccgaatggcgtgcagcagccgccgctcgccgcgccctccgccttgatgacacagaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgcgggtttggctccccgtcgtcgccgctcacactcggagagaggtcgtgcgcctttgcttgctcggccattaggcagaacaagggaaacttggcgcacacggaagagtatgagagctcagaaaacacacactgagccccctacctgg

SEQ ID NO: 42807 - DNA, 1501 bp, Oryza sativa
agcgaggtattgtacgcatctttttttagctttgccactgtatagaacgaaagtgattgaacgataatactactttaatacgggtgagagatctcccgtgatgtttatttcgtatgactagcagtgttttaaaagttacatacaaagttacattgaaattacatacaagttacactataattatactgcagttatgcagttatatgtaagttacaatgtaattatactgtaattgtataaagttacagtcctatataaataaaattacatttgtaaatttagttgatatgacatgtaagtgtactgtaattttgataaaaatgttgtgtaattaaatatgcattcgttattttctataaaatataaaattacactcctatataactaaaattacatttgtaaattcagttgataggacatgtgagtatttaaaatataaaattacagtcctatataactaaaattgatatgacatataagtgtactgtaattttgataaagatgttgaataagtaaatttgtattagttattttattttgtagtctgttggatataaatctaagtgtagaaaaaatctggatgatttcttgttaaaaatcacccgacaaatgtataagcagttccacccatgtgtagaaatatgtacacccggggtcaatgtaatttatctctcgatcaatactactctcggcgcactgccaccctcttttctgaggttttacttatcaaccagaggaatttggtacctgatgtggggctgcatcggttcagttccatatccgacgaaggggtaagtcctgcgtttcgtcggccctagtgatactatcggctatattggtgttgttcaaggctgcatcactccgatctcttggatcgctctggtttgtttgatatatttgcctacctgatatctcaattctatctctaattacattgtatttagagacgtatcggtttaattcggactgtcttggttaggtctgatcttccgtcttaaccgatatatctctacaatcacaatgctgttataaatagatttcttatatccatcacattagacagatctatcggctcatcgagcattagactatcatttataatctcgtgctgcatcgattaggtccgacctactaaattattgttgataatataaatcttgttaagccaataggttcatgctagtgttttatcgggatgctagccgataagttttctagacgttgcatcggcttacaaagattacttacaagttagattttgccaattgcaacaaggtttcactgtttatctaaatcgattggattttatgacatcgaacttttagccaatgtatgcttttaactatcggatcgatacttatcctatcatattattattagccgagtgatttctattggattataatattgttatattttattatcatcagccgattgtctatatatatttatctacaatggatatatagccgattgctcaaaaccctatcgacatcgggtg

SEQ ID NO: 42808 - DNA, 1424 bp, Oryza sativa
cctgctacggacaagatatacaaatagcagatcaaagagccgatcggttgacaaaccgatggagtagttccagccgatgtcgatagggttttgacctatcagctatatgtccaatgtagattctgatacttgatgtaaataacgttggttgatggtaatgtaacaaaacaacaatataatcaagtagaaaccaatcggctaactatatgatagagttagcacttatctgaaggttaaagcatacatcggctggaggtccgatgtcattaaatccacaatatttgataaacagtgaaacctttgttgtgataggctaaatccaacttgtatataatccttataagccgatgtaacgtctagataactcatcggccgaaaccccgatgaaacccttattggcaatcaaaaagtaggctagaggttatggttctaagcatgactagggctgatgcagcgtaaagtatgaaaagaaacataatatgtagacaatgaagcctttaactgattttcaggatggtggataccatagctaatctaatctggtaaagcaatgtagtagataccgacaaaaaccctaaaatgaatctcagccgatacaagtaaattgaactaccaaagtagattaactaagatatatcatagataggtgtttacattgacaagatcagagtgtggaagccctaagccccgccaatgcaaacagccatgacaagtataaactcgtcgaaaaagtagaaaattaaaaagggtgacgatgcgtcgaatttgtattgatcgtggagatagtttacaatgaccccgggtgtacatatttatacccatgggtagatactagtccttgtaggatacgaaagaactttcctatagataaaacggaaacataaagtccttattggacactaaacaaactttcctaaagataaaaggaaactaagagactattgctaattaatagataactagccatgccgcatccttcttaaacttggtctcttctagataagcttctttgaatagattaatttccttaactgaacccatcaagaatctgacaaatggcgactgataatgcccatcggccgattccaggactctgaaaccaatactaactctaagccgatgatgacttcggggcttatcaaatttcactgttaacagaatgaaaaagttcaaaaagcataaaaacatgagtttttgacatattagaatggattgggcgcattctttttgaaaaatatctctgtgacccgctcagcgacattttgtcatataatgtcaatattggcacacgtgggtgcgatgttttcgtcggaacgaaaaagttcaaatagcactaaaacatgagttttcaacatattaaagtggattgggtgcgttcgttccgcaaaatcatgagttttccgggacttgtctttacctgatta

SEQ ID NO: 42809 - DNA, 1501 bp, Oryza sativa
tagtagggtttcatttgcaaaagcagcatttagcaaacatttcagaatttaataaaacagttaagtaataattaaacaatattaatctaacgctatacaacataccctgttgtataggcccaaccattctgaacaaccatcccggctgcacagttctatctccaaaccaggaatataccattccaaaccaggagctaatcaaattattaccagttatagcatcatttactgtggtgagaagggtgagactaatcatgaaagacattgttagacccgcccataaccgcgggcacggctattcgaacagttttactctgataagaggtgtaccactgtacccacaagacacaaccccacatcatgtcaccatgtgcctcaataccaccacggtacctcggaaaggagttgtgacaataccccttgcataacacaatccaccgtagcgcaccttcctggatcataatcaccccattataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaatagtgagctaatgtttctaagcagggctaagctattatacctaatatctagttgaaccaatataaataaagctcaactagtcaaattataataacccaaggtatcaaggaataaagtaatcaagatcaaaaagggctataacaaacaataggttaattccacccaatgacattcgaaaataaatgcaatagttgagtagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattattttggaaaaggaaaaagggatttattgcgtcagcgggctagggttttggtggaccgggcgcacggcggcggttcacgcgaacggacggccgagatcgacttgatccaaaacggacggccgagatcgatcggtccacgaccggctcacgggagaggatgacga

SEQ ID NO: 42810 - DNA, 955 bp, Oryza sativa
agagtttgtggaaattcagaaggttttgactgttggttccaacggtctgtcccctaagcaatcgaatgcaaaggttgtagacataatattggcaccaacagagggattatacagagcacggactaaattacctccaatgagacaagtaatggttgaggcagggcatcggatctgaatcgattcagatgagagctctccttcccttaaccattcgttactcatgatgatggtcaacttcttcaccgtctctttaagcatagctttatcgagaggatcattagagttgaccttggtcggtggtctcttctcacaggaataattcgaggtgttcccataatcttcgaaaagatcttcctcaaattggaatggaatttccagagaatgaatttcttcttcctccgactccacatgcagagattcctcatggataatcttgacctctgggacagcttcacttcggccgaagaaatcgttcactaagattagatctaagagttctcttccttcggcggttgtcttgtgtgcgaacgatcctctagtggaaatatcgagattttcggcagactccttgtctaacccataccgaaaattttgcaacaacacataatcaatgttgcaacaacacataatcaggtaaagacaagtcccggaaaactcatgattttgcggaacgaacgcacccaatccactttaatatgttgaaaactcatgttttagtgctatttgaactttttcgttccgacgaaaacatcgcacccacgtgtgccaatattgacattatatgacaaaatgtcgctgagcgggtcacagagatatttttcaaaaagaatgcgcccaatccattctaatatgtcaaaaactcatgtttttatgctttttgaactttttcattctgttaacagtgaaatttgataagccccgaagtcatcatcggcttagagttagtattggtttc

SEQ ID NO: 42811 - DNA, 375 bp, Oryza sativa
ctaaaaaacaccatgaatgttcaaaagcttgatagtttctggtttgttttgtgcacaatacgtctggtcctagacaactcatagttttattgtgggtatgtggtttagtggcacatatgtcctaaactcctaatggtctagtcacctaactttaagttgaaattatctggcattagagttgcagggagccaggaaatcactggcagagcccttgctcccaggagaaaaatctcacaagtcatatggctcattagctgtttcaggctacaacattctttgtgtttatcatttgtttgttactagatcaattattaatgttgtttggggaatctatcctccagttgtagcttctgaatctgtttgtgttcaatcagg

SEQ ID NO: 42812 - DNA, 888 bp, Oryza sativa
gtggcaaaaaaatcacttcgtgattcgcgcggcgaacttttgtcaattaatgtcaatattggcacacgtgggtgcaatgtttttaaccggaatgaaaaagttcaaaaagcacgaaaacaagattgtttgacatattgtagtgtattgggtgcgttcgttgcaagaattcacttcgtgacttgggcggcgaacttttgttaattaatgccaatattgttggcacacgtgggtgctatgtttttgaccagaatgaaaaagttcaaaaacaactaaaacatcatatttggacatattggagattaatgaaaaaggttcaaaattcaaaaagcatcaagacatgctatttggatatactggagtgtattgggtacgtccgtgtcaaaaaatcactccgtgactcgcatgggtgagatgtttttcaccggtatgaaaaagttcggaaagcaccaaaacatgatttttggacatattggagtgtattgggtgcgttcatggcaaaaaattaatccctgattcgcgcggcgaacttttgtcaattaatgaccatattggcatacattggaacacgtgggtgcgatgtttttcacttcaaagaaaaagttcaaaaaaaacaacaaatcatgatttttggacatattggagtgtattgggtgcgttcgtggaaaaaaataacttcgtgattcgcgcggcgaacttgtcagttaataccaatattggcatatattggcacacgtgggtgccatgtttttcaccggaataaaaaagttcaaaaagcagcaaaataagatttttggacatattaaagtgtattgtgtgcgtctgtggccaaaaataactcagtgactcgtgcagcaaacttttgtcagttaatgtcgatattggcacaca

SEQ ID NO: 42813 - DNA, 204 bp, Oryza sativa
caccacctatggatcaattcttaaccgttactttgaggcccttgcttccaacacgaggactcaccctatataggtcgaatcttaacacatgtttttatgtgggatcagagagagagatttttttttaactaggtctgaaattcaccaaggaacccaggaaaaaaagtgatgcttaagtgctcttgtggcaaagctcaccaagta

SEQ ID NO: 42814 - DNA, 155 bp, Oryza sativa
ggattttttgggttttgtttagataaaagtttagcttcgctacttttccgtgtaatcccgtgatcggttagatcgctggtttgctcgttacggaaccccaaacctatcatttgtattcaattcctatctgcaattcagattgcttttatcttgtt

SEQ ID NO: 42815 - DNA, 1501 bp, Oryza sativa
gtgaggagttcatttcagctttcagattcgctctgcgacagtgtaacatgtttagggttcctttggagtaattcctatataagtcatttggtttataggattgctttaaaggaaatttactacataggataggaaagtttcctccacttcttggaggaattttagcatcaggtctaacctctagtttcaaattcctttgagattttcaattcattttatctccaacaaatcaatatataatcttaaatctcctatggttttcctatgatacatccaaacacatgttttaaacgattcctgtagtattacttcctgtatgattcaccatcgtgtgacatctcaatccttgtgttttttatattcctgtattctcctgtgacttttgttgagaatgccttggaaggctgaaacgataggtggtactacgtgttgtttaaactgtgctgataggtagaccacaaattagaacttaagaattgatgtttgccagcagcctagcaccctagtcggaacttggaagggaccagaataatgaaatgatttgttggtcattaatagacagtttcttttgattgacagcggaaattactcgatattgttcttcaaattattagtggtatgaaccttttgagtgattgacaggaaacaaatccaccactatctgttaaagatgagagccaaaagtctgcagttggcctgacgatattgttctgttcatagtcagtcgcgtcttcttgtattggttttgttttaccctgattgcgtgaagtgaaactattattcaggttcgctcaagtcaataagattttcacatttctctttttaaaaagggataagattcagacaatcatttctgcaagtgcatattgttctgctgctccttttgcagattataattgtcgacgctatttgtgatcccgtgcatgcactttggcactcgtccatgcctcattttttccccttccgcagccactgcagatggttggtgatcataggttattcaacactcaagtcctgaacttcccttttccttaattgacaataccagggttggtgccgatattggcttttacctaatttaagtatctccgccatgtgtggcagggatttctcttggttaggattaacctaattaaccatccggcatgatccatgcatggcacagcttgtgggtctcctatttttggggttgatcttcctccttcctccccttggtattagaggacatcatctccctgtcccctctttgccctgccatttccttctccttcctcctgcagcagctgtcgtaagtcgtggcacgacagctgctgcgatatctatcgcaccaggaaggatccttccgaggaggaaaggcaaacggcgggacgcttgagccaacacacaccattgacaaaaacattaattagatcgtgatagaggaatataacaatcacagaagccatggcaagcagcggcaaggagcaccggcgaggtgttccacgcccaccgccgttgtcgc

SEQ ID NO: 42816 - DNA, 1501 bp, Oryza sativa
gcagcaagccaacaattcataaatcatagacctaaaatgcacctaagaactattagagcttaattaatctagtgctagtattacatcttgaaaatttataactctctaatgcaaagtgataaaatataaattctttcatctaaattcatcttagaccagtacctaaccacactagtaaactcatgcattttagagcattttagatttttacatgttttggcatttatcgttaccgttatttcttttagacggtgaattcgttaccggtgaggtgattggtcttatagctgatctcaagaaggtcttatatcaaccaaggcaagtgttgcccttcctttgaacacattgaatcccatgttttcgggctaaatgttttgattgtaaaagttgcatgcgtaattcgaactatcgaaactggattgtagatatgaccaaaaaaaaaaaaaatttgcatgaacccttttgaaaatcactcccttgctgttttgaaccttaggaataattagagtacttttattgtgctcatatagctaagttaagcttttataaaatgctaatgcttagccttgcttagtaataaataaaaacatggctatggaatcacttattatactatttggaaaacctttttatgtgatatgggcagcgatgtgttcgctggatatttgtgaaataaaatgagatgaaatgtgatttttagacttgagcggcatgtggtatgcatatggtggtagttgcatactgatagggggagtattcgcccgagtcgattaaggaccgaacatatcacccattatgtttaccgtacatccacatgtgctagtatgggatggcctaagctgattaatctatttaggactagccttgcattctggtaggccggtgtgtatgagttagtcgataattctgagaattttgtcgataacttagaggaactacccatgagtgtgtgtttgtgatgatcataggatgatacattccctatgtgtgtgtgtgtgttccgtgaggggtgtactgatccacctcacggcatgggcgtctaagtctgtccaatacaacggtattgtgccacgtggtgggttcccgtcgtgtccgccaccacggcattaagtttaaggcgtgggcccgccacttaacggttctagacatatttccaagtatacctaagatggaggaacacgtatcgtgctggtgcaaggctagattctaagtagtgtaaaggcttcgttatgacctctagaccgcactcaacgtatagagtgtggtggtgcatcgcgagcacaaaacaaactagagtgttgttcatatcttgtgggtaaagctgtacaaactctacagagttctaaaaactaatcgattagccgtgctcatggtcatgagcgacatgatgatgtgctatgggtataattttgtgatttctaaatgcttttgaaactaaaggaaaaagtacgaattacccccccgaactattgcggtcgtccgaattacccccctgaaccac

SEQ ID NO: 42817 - DNA, 1501 bp, Oryza sativa
ccggcgatcttcggcggatgacagatggcggacgggcttctcctcgcagctgcgaatcaaatggagacgacggcgaccgaaggtgacgacggacgacgacgaacggcgcggctggaggcacggcggcgacggcggcgctccggttcacgatgacggccaatctccggttggatttggcgcaaaagaaccagcggccgggatagagctcgactttgcggagccgcgggaggtggtggcgctgatcggcgacggccgaggcgacggcgcacggcggctggaacggctatcggcggcggagagagaaggagctcgcggggagggcgattccgacgacggcggaagatgagacatgaggggataggtagaggacgactagggggtcatttatataggcacgggagctcgggtccgagcccaaatcgacgggaaatctcgggaaagtctagggttctcgccggagtaaggaaagattgaaccgcgaaattggaaaggatttccatagaaacttttggggatttcttggggaaaaggaagaggagattgagaggattccattgccgcaactaatttggaaaaaggagcaacgaggtggccggattggtgggaggaggcggcacggctgcacaggcttgggacggctcggtctctgtctggaggttgaagatagagtactgtagcgccagggaagtcaaacagacttctctgcgggctgagaggagagaatggaatgggctgaattcggcccaagactaggaagaggattattattacttttcaaaataaattaaccaatgagatgatctttcaattgttaaaaatacttccaatgctcaaataattccaagaaaaatcttgaacatacttgaacactcagagtatttattaaaattgaaaccagctcatttaatgattaatttaatatgtgaataattactgaaatgttctttgtattattaaaattaggaattgagctccgaaaaatcttagaaaatttcagagagtataattaatcatggagaacttaatacaaattaaatctatccatgctttatatttaggaaattttatttcccacatttaacttcacttgtaaattaatgaacatttaatataaattatattaataatttattaaataatttataaatcctaaaacggaaattcaggctgtgatagaaggtaaccttgcatgagcatagatctgcagaagttaggaaaagctctaagaaggttaatcatgtttgtctgtacatgtatgggtcggatgatgatgaggacgattctgaaatagctgcagccgaatagatgaggagtaaaaaggtcataccatgtcaatgggtaaaaagttctggaaaagaggagaagtatgactttgatatgactaaagctgacaagatctttgatctactactccgagagaagcaaattcaacttcctgctggtcatataatcccatcggctgacaatacctaggcaatcaagccgttgactgattttcagg

SEQ ID NO: 42818 - DNA, 1501 bp, Oryza sativa
aacctatactttgatgttcgatctaaatatccaaattcctccttctgatctagccgccaatttaattcatgtggcttgatttcctcttcgtcacaagaacagtattattacaaatattgtgaataattgctcttgtgctaagaaaatagattttatcctcatgcaaatctcctattagccacaaaatatttctttaaacccataccacccatttgtggggataaaatcctatttattccctctctttatttttcctaccacatttccagaaatacagagccatattatttatggttcctatttaagtgcattaaacaaactcccactccaaaatattgcactcaaacaaattagaacatctttactttgaaattcatctccgcacataaatctctccgaattcaaatcctttctgaggcctagctatctaaattcccttcaaacacaaatacttctctaaatccaatttattcaaaccttagactttcttccttttaagattgggccgaattcccctttttactcctctcattcatgcagcccaagtcggcccagcctcagctcagccgcctcctctctcctcccttccttctgtgggcgccgccgtccgccatggcagcgcgtgcgcgccgccgccaccgccgccgttgtcttgccgtcgccgccaaggaatcgccaccaacattagccgccacctcacttgtcacgaccggaattaacccaacgatcattccatacgtgcgtgtattattccttgtcccaggaggcaaggtacaccaaaagttgatacaattcagagtttaacaagcggaagcgtaaatagttaatttattacatgggcgacgaaggcccagcacacacgaagataaacggaaaacagcggaagactagggcaacgaccacaggcacttgacggcaggcacgagctagacaccaaagtcttcatcctccaggaactcctcttttgggttagggaaaaattgagcaagattgagtacaaccaccgtactcagtaagacacacccacaaatgcagaataaatgcaaaggagtacaagggagttataataaaggggttagggtttgcagtaaacaacatttacaagacttttagttgcttagggccattttgtaaagacgatcctagagctacacagtgttattaatcaaggccgtgaacccgcacgaacctgccttaacccaaggcctacgatgattcagaccgaactggcaacctgacctgggtcccagctcgtcccaagccaacctaggccaaccattccatattttagttgttaagcaagttttaagaagtaaaccactaacttgggtacattgttaggcttgcccataaccgagggcgcggctattcgaatagattatactctgatcagaggtgtacatctttacccacaagacacatctttctcacgtgtaaccacgtagcacataccaccacggcatacggacgaaagatgtgacatagttcccaacctatccta

SEQ ID NO: 42819 - DNA, 234 bp, Oryza sativa
cgctccccgccccccgcttgcctgtgtgcgcgtgagacagagagtgagagaagagagagaggaaaagtgagagagagaagggagagaggaaaagtgcaataggagtatgacaggtggggcccacctattttttaataaataaattgctgactggactgccacgcgtacgccatgtagaccaaaaccaccactgattgggtcgaggggggtaattcgtccggtttgcatagttgg

SEQ ID NO: 42820 - DNA, 1501 bp, Oryza sativa
atcgactaactcatacacaccggcctaccagaatgcaaggctagtcctaaatagattaatcagcttaggccatcccatactagcacatgtggatgtacggtaaacataatgggtgatatgttcggtccttaatcgactcgggcgaatactccccctatcagtatgcaactaccaccatatgcataccacatgccgctcaagtctaaaaatcacatttcatctcattttatttcacaaatatccagcgaacacatcgctgcccatatcacataaaaaggttttccaaatagtataataagtgattccatagccatgtttttatttattactaagcaaggctaagcattagcattttataaaagcttaacttagctatatgagcacaataaaagtactctaattattcctaaggttcaaaacagcaagggagtgattttcaaaagggttcatgcaaattttttttttttttggtcatatctacaatccagtttcgatagttcgaattacgcatgcaacttttacaatcaaaacatttagcccgaaaacatgggattcaatgtgttcaaaggaagggcaacacttgccttggttgatataagaccttcttgagatcagctataagaccaatcacctcaccggtaacgaattcaccgtctaaaagaaataacggtaacgataaatgccaaaacatgtaaaaatctaaaatgctctaaaatgcatgagtttactagtgtggttaggtactggtctaagatgaatttagatgaaagaatttatattttatcactttgcattagagagttataaattttcaagatgtaatactagcactagattaattaagctctaatagttcttaggtgcattttaggtctatgatttatgaattgttggcttgctgcagtgaaggggatgttctcaggtgttcaacaaaattggtttcacatttttgtagagttgggatgattttactatgaattttacaagctaagtgatttattatagtagttgttaactatttcaaattttagacaagttttgggtactgaaagtgtcatattttattttataaaaactaaggtcatggttcttataacctaacaaactttgagatctcttcctttagactggtattaaattttatatgaattctagaagtttctataccatcttttaattttaattcattattcaaatttgagtgatgtttttggatatggtttcttctacagatttatctacagaacaaatgtatatgcttttatcaaactaacaaattttagttcatctcatttggagttaaaataaatcacttatgggttttatagtttctagattacactatactagttattttaccaattaaatagttggtgattattttaatacagaaagtatcaagttttagttcatgtaaattaagaacatggttttgtgagaatactggagcttggttcactccaaattaagttaagatgaattttatatgaattttctaagt

SEQ ID NO: 42821 - DNA, 1501 bp, Oryza sativa
agttaaaagtcaaataaggctgggaggatttttttatatttcctaaaagcctaaaatgtgtaaataaattttagtggaattttcagagcacaaataataattatgaagaaataaacaaagttgaaaagattttataaaaagaaaaccctataaccctctcccctctctctaggtctgaattcggcccaactccctctccctctctcttctctccccgcggcccactcggcctccctccctccctacgtgtgcgccgctgacaggcgggctcgtccgccaccctcgctgacgggtggggcccacccatcatccccctcctcccactgctcccgccgctccctccgcccgcgcctagcgccgccgccgccgcaaatcctgccgcccccgaccgttcccgcgtgccattaagtggggggaaatgttccccgtgattccctctccctttccctccattttctcatctctctcccatgttcaaacggccggatttgctcccgcaaatctcgccggcgccattgatgccgatagggacccccgcgccggtttccttcctcgccggccgccctctctcactcccaaccctatataaaccctcaccgcacctccctcgtccgtttccgccactcgccgccatttctccccgccagaatcgagctcgcgccgtcgctctctctctccgtcgtcgccgccgagctccgatccgccgccgtcgtcgccccggaccgcttcccatgccacctcggcgtcgtctcctccggctttgccgcaccatcgccgacctcgtccacccctccgtttcggtcgccgacggccggaacgctagctcggaggatgacgctactatcatgcacctggcacgcatggtggaggcgtacgacacgggccgcatcaacttccatcatatggtgcgccgtgggttggtcgaggacaacatgaagatcctggagctacgttaggagaatttgcagctgaaggacttggacgccgtggaggcgcagctgtgtcagctcaagattgctcagggggagatctgtcgccccaagcgccgccgcgtttgccgcagccagaagatcaccgcccgcaagagtacctctaggcctgagcttgttcgtcagttcttggcgtggacctgcttcgtggagactccttgcgtcgagcccgcgcccttggttccttaggaggagggagcctctggcgttggcagcacggaggatgtgttgttgctcaccttccgccctggcccgtcgcagaagtagacgagcagctagtaggcacgcgcgtgtgttctttttgtttgttttcttgcagagtcgtgtggggcatggttataccggtgtgtggtataattgtgtcggagcctgtctttattttatttgcataagcaacttcaaccttaatgaaccaatttaatagcagaaataaattcaagaattatggtagtcgtgggtggttagttttaatcgtcagctctttctgtttgctggttctgtgtggaatcttc

SEQ ID NO: 42822 - DNA, 1501 bp, Oryza sativa
tacgtgctacagatctccaagaactgctgcagatgagcattggcatcctcgttaggcttgccatagaatgggctagcctgcgccatcgtgatgaggttggacttcaagttgaaatccatgtctcccatgttgatttgcggcccaatggccatattgttagcagagagagcagcgaactcgcgaagggtcttgtcagccatagtcttgaaggttggttgcgctggtacggctggtttctttgtcggtagagttttctgtggagcaacgactcgcggcctgacgctctggaagaaagcttctggattttctttgaagttctccggcaagttgaaaccagtcatgcactacccagttttcacaacaaaagtaaaaacaatcaaggttagcctgcaaaggaaaatgattatacagaggtaaatataaaatattagttcaggtaatctctattatgaatcttccccggcaacggtgccagaaatgcttgttggtatttcttaacgacattactagaaatataattcccagcaatggcgcagaaatactcctggtatattatggctacagagtttatccgcaagcgcacagatataccattgtagcatttcacccgagagtattccaagggtatcgtatttattttatcccgtgggaagatcatgtagagagaacttgactaataatttatatgctacttgtgataattatattattaagcaggggttaagataatctaagggtagagtgacacacaagcattagccactcattctcataatatattatctaagctaagtggaaagaaaagagaaagataatctattcctatacttctaatatatatagtatacatatattctagttaaccgatatactagataataccctctatccgatgccctcctggtactttgagaagccacccctgactgacgacttccttacgacagcccatcatgaccatacaaccataccctccctagagaattaacttaggattctatataggcctggaggaatatccatactgagctgtcatcatcagcggcccacctctcaaccgcagcatataaccccaaataatgatatcccgtaatctagacaccacgtctaaactaccagatactactctaatatcatcgtcatgacatagagtaattgcataagcaaacattatacccgcaccaaagcatctcccagttaagctagccgtatattcagtataacatgaatataatgtaaagtaggcattcatatactcggaaagtatttcaataccataaatgtatacagaagagtattctaataaaagtacaaagcttacaaaagagaagagaaaagccactagagccatacccaaactcttccgaagacttccggactcctgatttctactctattcctattccaccagctagatactactgaactaaacttgagagaaatgagagagctcttgcttgaggtttgtgagtgaagtgagaaggtgaggggtttatatagc

SEQ ID NO: 42823 - DNA, 1272 bp, Oryza sativa
gccaccacgctgacaccgcaccaccacgccactgccgcgccacgctgcagccgcgcctccacgccgccgctccgctgccgcccctgccgccccatcagtgaacgaaaagcgaacgaacgtacgtgaacgaaacgtgaacttaacgagaacgtgaacatgaacgaaacgtgaacttaacgagaacgcgaacattaacgaacgtgaacgaaatgcgaacgcgaacgaacgtgaacgaaacgtgaatgaatcatgaacaaacgtgaatgaaacgtgaacgaaacgttaacgaacgtgaatgaaacgtgaacgaacgtgaatgaaacgcgaacgaacgtgaacgaaacgtgaatgaaacgtgaacgaacatgaatgaaatgtgaacgaaacgtgaacgaacgtgaatgaacgcgaacgaatgagaacgaaacgtgaatgaaatgtgaacgaaacgtgaacggtcgccttataggacactacgtgaaatacaatatatgttactttgcatttagactaatacatttttttgtatgttgcaaaaaagatgtcgtcgtcgtcgtccctcaagccagagtggtagctagcccgcaaaggaaatcgcgcaggcaagtgatgtaaagatatgattgttagatttttaatataattaagattattagattattagacttactaaatgtgagtgttagagattattattagagttttagacttagcatatgtgagtgttagagattgttagagatttaatataagattattattagacttagcatatatgattatttgagttctaatatatgacacttagacttaacatatatgattgttagagttttaatataagattattatatttttaatataggactaataatataaggctattagatttaatatacgacacctagacttaacatatatgattatctagggttctaatgtacgacacttagacgtagcatatatgattatttgagttctaatatacgacacttagacttagcatatatgattgttagacttttaatataagattattagatttttaatataggactaataatataagactattagattattagagttttaatacaagattattacagttttaatataagattattagatttgtaattagacttagcatatatgattatctagggttctaatatacgacacttagacatagcatatatgattgttagagttttaatacaagattagtacaattttaatgattatctagggttctaatatatgacacttaga

SEQ ID NO: 42824 - DNA, 1501 bp, Oryza sativa
gtgaatatcagtatatactactgtaatttcaatgagtactgatgtacttaatgattttttcctggaactgactatatactaaatttaatttcttgggacgagtatatcccgatttcttttctgaacaagtttgtactactcttctttgaacgagtgtactgatctatatactgatttctttcacaaattatattctccgatttcaggagtgaacatgaaattttaaagaatatatagaaagttatttcctcaatttagattaaattgaagcatagtccgatcccaagagaatttgcaataatccaggcagtatatggattcatacatttagccattctgaaaaagaagaaaaaatgaatgtacagtatacccaattttcgacctgcacaaactgctttggacagaattttcatactgccatatccacattttctacatctacatcagctaatccatgcaaccatgcgaatatactgcccggtgttggccaccatccatggtgtatttgtcatgcatctgtatggagcaaagcaaagaactagttaattaggagcttcatcattcttcagaagactaaataatacgctgggttatcaaataattttttttaaaatactagcaggcctactcatggaaagagggtgaatggggattacattcaagtacagatctaataagaaagggaatcctcgatctgcaggaagagaaaaatggaaagataataccttggcaggatgaataaggagtagaacagagtggttacggcctcatttccctgcacggcgcatggatttatgtgtcaaccgggcttggcgaagaaaccccgattgcatgatcggatgatcctgcacctccggccaaccgtcgttcttcgtccacaccggtggtgaggagtagtagcgtcgcgccgaggtgcagccaggccaccgctgcctccgtgtggacagcgtcaccgcacagcgcctacataggacgagacgacgaatcgatgactgatatcgtcgccgctagggcactgcctaggaacgccatgattgccatgttgctgcaaatggatctcaccgcatcccaacaaatcaccgatggatgccgccggcaccgtgcatggttgctcatcaatcgccaatggatcatgccgtccgctttgactctccggtagctagcggtcgatccgaatattgcggagagagcgagctattgccgtcgctggttaagtggttaggatggcagccggggatttatattatttgctcaggaccgattagtgtgggatagttaagcattaggtgattttttttttataaaaacgaaacgggtctgttgagtggatccggtaacaaggttgatcgtgtgcctcattactgatgaacggtggcaggtgtacgtactcccaggtgtatagaaccattttcatatatatatatatatatatatacatatatatatatacatacacatatatatatacatacatacatacatacatacatacatacatata

SEQ ID NO: 42825 - DNA, 1501 bp, Oryza sativa
tattcgcttattaattagagtaatatttgtactctattatcaatttgttattgtgtgcctcggctgattcctggacgagggttcacacacatgtaagcgtttggaattttggatagaaattccgggcgtgacactagccgttggcaggccccacacataggtgcctgttttgagacaaaggtgtcggttctcaacccaaaaccggcacctttgtttcattagtgtttttcatgtccgacggtgggccctacacaaaggtgccggttcttggtattacaagtcaaaggtgccggttctcgatccaaaaccggcacctttaatattctccctcctgcactagccgttggtgggccccacacataggtgtcggttttttgtatgacaagacaaaggtgccggtttttggtctagaaccggcacctttcttctaatagcacttttcatgccctacacaaaggtgccggttgggaatagaaaggtgccggttttaggtctagaaccggcacctttgttccaatagtgcttttcataccccacacaaaggtgccggttttttgtctataatcggcacctttcttccaatagggcttttcatgccctacataaaggtgccggtttgggaagacaaagatgccggttttgggtctagaaccggcacctttgttccgacagcagtacttatactccatcccttgctactcgagctgattgagcaagaagagagtggcgcctctccttcttgcccaatcagctcgaggaggggaggaggttttgctctattttttttggtatttggttaaagattgaagcctaaaggtaaatattcattatttctccctccgtttaactcttcgttgttgatttgaattgtcgtgtgcgtatgcatgtaaaatacgatatgggtgttatttttagggataattctttttatcttttttgtgtctattgttggatgaaatgctaaatttgtgttaatgttttcttccacctacgtcatggccgttactcaaattaatggttgtcaaactatgttaaggccacgaaaatatccattgatagcttgatttatctcaaatttatgttaggggtgcccatcgattcacacccgctcattgaattgaattgccatgtggtaatacatgtaaaatgcactagtcattaatttgtatggatccataagtcattcgtagatctattctcgggtgctatgctaaatttgaattaatggttttttcaatctatgccatcatcgttaatgtttcacattagccaaatattttttcgcattgtcgaaaaatagaattttttttatcttttcgttagccatgactatctagttaaggtgacgtgggtgtgtgcaaaaacctcaattttatcgtagggtaaaatggtcattcctcgttgtttttactctaatgtgcttgtaaattatgaaatcttcattgtttttttccttcacggtatgtaataaacaataataatcataggtacgcattggata

SEQ ID NO: 42826 - DNA, 153 bp, Oryza sativa
aaaaattcataactaattcatcttagctccgatttagttggttcaagtctctaaatttttctaaaattgagatctacatattaaaaatatccacatgtactgttcatgcttgtttatgtgctgttttggtgattttgctcttttctgcttaga

SEQ ID NO: 42827 - DNA, 1292 bp, Oryza sativa
ttggaggctacgtatacaagcggcgcaacatccttcaatctcctcccctgcgtccaggccgattctcagaagcttattttggcaccaatagtaatcagttaggcaggagtatcaactaaacttaaaattcagttgttttgttgacattaccaagcatctacacaatgtaggctacacaagcatattcagagagcaggtttgacctacctctgtaaaatgtgtatttcttgattgcaacaacctgtaatcctaactaaaattgctgcctttgtggaggtagaatctgtgccacttcactagaaaaatgtgccactttgaactctgtttcttaattggaaaaacaatgttaaagtaaaaataagaatttcttttaccaacaaagtaaaattaagatttaaccctagatccccaaagacctatagttaattaattaatagacctattgctttgtgagtaatgccagccggtccacaccataaacacgaacacgcatctcagccgaaagccagttaattaatcaacatatagcggcatacagctaagtactagtaattagtctggcctcagttttggggatttagcaactgcagagctattcaaagaatctctaactcgctaaacacttcaaactcattattattttttgaaagttaatagtatataaaatatagaaattagtagacaataaaaaaaaaccatgggtttttcatattctcatccgctgcttctcataatctcttgctttaaaacattactctaccttagattttactactagataactaagtagtactaatatatttcgatcaaatcgcgattaacataggactgtttcgctgtgtacgcgtgcaccgtacctttttgtacgcacgcatacatgatcacacgcagctagcactttaatcaccctgtctaacccactgtcaattatttatttaaccatttccatccctaatccattccgacggtcaaaccaaacatgtatatccacaccaatgggccccaactttcagtgagacaccggagacgctgagcccattcacgttgcgccacgtgtcctattcgcacgatgtcaaatacttggcgccaaggtgtaacggctgcggctagagcttatagcccaaacggtagttaggcagccatgtctcccccccttcctttccctcctttaaaatccccagcggtgtagcaaacgtagctatcaagagcatttgcattttgcacccaatgtcttaagaggttagaaccacatgctctcttcctcctccctcccatggcgcccgtgcccatct

SEQ ID NO: 42828 - DNA, 284 bp, Oryza sativa
tgagtgggtagcaactcaagatgatgaagacgacccgaatgagccttcaatcgacctccgatgctcggaagaactagagtgacttgttaagtcgttgtcttagatcgttgtgttagcttgcttgttttaagtttggttgtgtgtgtctcgcatgtgatttacatcagtggtgggatgtaagtgcatgtgtttgtttgcttttgagtgttaggaagttggtgagtttagtggtgtgagagtcttcagtttgtaataatgaaactcagttaagatcaataaaagtt

SEQ ID NO: 42829 - DNA, 1501 bp, Oryza sativa
agtttggaccatatccaaattgtaggaaccccaagggtgttacgtggaaaagaggcgggtgttgtttagctggtgctgtgggctggtggggaagcggacacgtgaaatgctgcgggacctcgcgcgcgttgcagcgttgggcgggtgttggtcattttcagtgggagagcctccgcgcatgggtagaacgtagaacaaattgtcaccaggcaattgtcaccatctttttaggtggtgtttggatccagggtctttaactttagtctctatatttagatactaatttagagtattaaatatagactacttgcaaaactaattacataaataaaagctaatttgtgagacaatttttttaagcctaattaatcaataattagtgaatatttactgtagcatcacataggctaattatggattaattaggctcaatagattcgtctcgcgaattagtccaagattatggatgagttttattaatagtctacgtttaatatttataattagagtccaaacatctgatgtgatagggacttgaaaagttttagtcccacgccttatccgcttcgttgcaacgtccagagtcttgcatttattaaggcccctggagctgtagtactactgttttctttttcccttttattttttgcccattttttgtggtggcacatggttcgtttgccgtcgctctggactgcttaatcctttggaatgtgatagtttggagggtaccccataaaccattttgtaggaggtttataagaaggtcaacatctttttttaagacgcatgcgagctttcacttaacgtgtgcttgttggtttatcagctagagacactaataattttttgaaacttagttttaaaggattttatgatttttattaacatagtctatttttcagcgttagtttctgaaaagcaaattgtttttttagtggctttgttcgtacttatccaaatggtatccattctactagggtccaaatagcagtacgagctactttttcatttttcgttttcaaaccgtttaacagtgtattttttaaaaaacaaatctattttttaaatttgtatatctaatactcccctttccactttatattataactttataagtcgtttgacttttttttccagttgacctaatttatagaaaaatatagtactccatgctatcaaaacaaacatatttcaatgttaaaatttaacagaactaatttaatattttagaagttgctaaatatttttaaatttgtttaaacttaacaatttttttttaaaaaacacttcaatatgaaactgagggatcgagggagtaacttgattaatccgtacgtctatcaactcagcccgaaacgctggatcgaacccctctacaagtccacattcatcttgaccatccatctccgatcggacggtcgatcatccatgttacactgaagtttgaacctgacgagaccacccatcgtctccctccctcaccgccgcgcgtgtcgat

SEQ ID NO: 42830 - DNA, 171 bp, Oryza sativa
ttttattcaaaaaatttatgtaattatcatttattttattgtgacttgattgatcatcaaatgttctttaagcatgacataaatatttttatatttacacaaaaattttgaataagacgaatagtcaaacgttaatcaaaaagttaatggcttcatatattaaaatacaga

SEQ ID NO: 42831 - DNA, 1501 bp, Oryza sativa
aattaagagctcatcactagctttgtacatacactaatgaactcattttcagtatctatacttctttcaaaataaggcagtgattatgacagtgaagttgccacctccaccaactattgacaggctatacccgtctacggtatttgtatagtataagaatcgttggtactagggtatacatgatattgaggtaaaagcgataggagacagagattttatataggttcgttcgaaccccctaactaacaggtaatagtcatactcctatttatcgaagccggtattgcctttatatatatatatatatatatatatatatatatatatatatatatatcaatcacacaagtacaatatatggtatgagctaatctagtttccatcagcctaacagcatagagtactcacatgtggtcggcgactagcgtagtcagctttcttaaatatattgggtagctctagattcatcatgtcggtctctattgcaccatattgggtttatctaggtatatattgtcttgtcttgtcttccatgttagtctctctcttaacctcctatggatgtcttgtatttatacccttaagtaccctcctatccaagtaaaactagggaaacaggtatgtaaaaactatccaagtagtcctaggactatgtttctccttctttatctggaacaccttctatatataagctgacttgattctgtataagacttgatatatagtgggcctcaccgagcctaacacaaaagtatttggtataatttatctgtaatactaacaaatattgtatagagtattattacttatttatattttttttacctactcttcctttgcatatttacatataaaagtcattttacgtatgattctacattattttatcttaaaatataaaatataagtttattatgcaaaggcatatacatgcaaagggacaaaattgtcaaaaagaactttcaattaatttgttccaagcaatattagcatacattcaatttaatcaggggaaactattctaaactataaggtgacgtcccatcgatatttgcatgccacttaaatagttatgaaaaaaatttaacttttacattttgcaacgaaaaaaattgactgtgaatacacgtaaactagttgtattttaatttgttttttcgttgtgacttgtagaagttgaattttaatttgcatgtttgtgaagtgatatatcacatgttaataatttttttcaaatttttttaatttattttatgacgtacgaataaccaggggacgtcccctccatagtttaaattaaattcactctcttaatcattagccgggtacttaaatagttagtcgatcgaaaaaatagaactcatcaattcttcagtgccaaaaactcatttggaattggaaactgtcagctccaccaaccacgaacttcgcctctatttaagcgaacgaaacacacgcagaaacctgcactaccatctcaccactgatcagtagctagctc

SEQ ID NO: 42832 - DNA, 349 bp, Oryza sativa
tgaaacctttgttgtcatcggctaaattcaacttatatgtatgtgcaatccttatgagccgatgcaacgtctagataactcaccggctgaaaccccgatgaaacccttattagcggtcaagcacgacttagtagatcaaacttaactgatgcagcactaagtatgaaaagaaacataatatctagacaatcaagccgttgactgagttttcagggtggtagatgcctaggctaatctaatctagcaccgcgatttagccgataccggcagaaaccctaaaacgaaaagcagccgatagagctaaattgatatgctaagactagattaacagagacatataataaatagg

SEQ ID NO: 42833 - DNA, 1501 bp, Oryza sativa
tggtttggcccctgcgaaaaatgtgattgggtcgcctggagaaacactttttttagtagtgacgaatccgggcgcctcgtcggcagccacttctgccacatcccggccgtcgctgatctcatgctctggtactcactgcgcgccgcattccacaccgcacaatgaacgctcaccgccggcgagttttgtggcatggtggtggtgcggacgctgtcgccgtcgtcgcacttcgagggtggggaatggaacaagggcggcgaccgccaacggaccccgcctgtacgcagcgggcgaggcgccaatggccggtggaggcgcgcaaggtcagccgcagcggtggcgttgggggcgggctgtgacggtgaggatgtcgacatgagagaggaggacggaaatagtaatgggagtggcatggttttaattttagaaattttcagtgacacctaaccgaaaataccatatttagaaatgcttgatgttttagattttttgtttgtgctttatttgtatgacatcatcaaattttcatagttatcttctatctatattggttttttataatttaataaataccataagattgttttatgcgctaaaaaggttgcactacgcttatgtaataataacatatatatcttgctttcaaattaatcttagaacaactatgacttgtagttggattgccagatttttttttcccgtgatcaacaaaattccccgtagcaacgcacggacaccctactacttttagaaattttcagtgacacctaaccgataacgtgaattgcaacggtatttttctaatatgccatatttgtattggcataaatcaaattaacccttaaacaatactctccatttctcaccatgcttctgtgggaatgttcatctcaagcaacttcgcaatcattcagtacaggaggcactctgcccaaggaaaggaaaaactagatgtttctccaacaacattcgcatctactccaatctaaacagctatgctggtataaaaccagccacgatagcacactgagaaccaaacgtggaagaaataccatagaagatccagacatcatgacaatatcgaggcatgatatttgataacggagttcagctgaggcctacatctccagggcactgattacaggtgctcctccctgttccagcatattacagcctatcggagttacaacaacacacagccgggcgccgccggcagccgctccctcttgctatgctaagccgccatgcggttacaacaggcatgctgtcagggttacggataaggcataccttctatcctatgacttatgaaatataccgatgaggtataccttcacgcgcacggatcgtttctgtatacgccgttaggaatctatctcaaattatgaaaaatatttctacgagttaagaaattaccggagtcctactcggagggggtagaatctctgctatatcgtgccaatttacatatctccaagacttacttggggtcaaggtaatc

SEQ ID NO: 42834 - DNA, 1501 bp, Oryza sativa
ctgggcttgaggtcgccgtgcacgaccggcggctggcattcggcgtggaggaacgcgagcgcgcgcgccacgtcgcggatgacggcgagccgccggggccagtcgaggaacctcccgtcgcgggcgtcgccgaacagcgcggcctggagcgagccgtgcggcaggtattcgaagacgaggaggagcgggcggtcgtcagcgccgccgccggggccggagtacccgagcagggagacgagccgcggggggcccgggagaaaacctccttttcccggggggggggggacccaaaatgggccccggaaaacccgggcccgaaaggggaaaagggggtttggcaaggccttccgtttgccggggggaaccgaggcatcggtctttccacggtcgggcgaagcgacggcgtcggggaaggtggcgaggtacaccggggaggcggcgccgcgcccgaggaggcgggacgggtggaacccgccggtggcgcggcggagcgcgcggcgggagtagcggcggagcgggcgcgcgggggccggcggcggcgagaacggcagcgtggggctgcggcggcgggcgcggcggctccggaggtagagcgcgacgagcagcaggagcaggagcagcagcagcgctgtggctgtggcggcggcggcggaggcggcgaggaggaggtgatggtggcggcggttgaggggaggaggcggcggcggaggcggcagttgctggagaaggcgggaaggcatggcggaggtgggagaaggaacgtggtgtgtgcgaccagccgaccagctgattgaggggcactgggtaggctcgtatagtaggcggggactgctcacatagctgcaaattgaagatgggaaactcatttcttagatgttagtattggtcaatttaaattccgtgaactacagatattttgatcaaattattaaaccacatattttatgtgtttcatctaaaacctacatattttaaatttataaatcattaaaccacatatttagcatataatttatcatggaactatagattttatgtgcttcatccaaacattgttattctaatataggcttaaaatccataacttctatagtttgtgataagataagctttaagatttgtagttttgtcataaagccactactgaatatgtttttcctataattcaaaagagcttaaatacgtagttttgtagtaaatttggcctccagtttgcagtgctgtggtacacaagttttaatttgtagttcttttgttagttttgccaaagtatacgtatattttataaagaaaattttaatcattttttagtcaactgttttaataaaggaaaaggtccaaattacctctgaacttaaggcgatagtccgaattattccatgaatgacataaccagacattttacaccctgaacgtctcaaactggacgaataacccctaagcactatttgtgcggttttaacatgagctgacacacgtggcgacaacgttgtaatccggt

SEQ ID NO: 42835 - DNA, 1501 bp, Oryza sativa
aaaaaacaaacaaaaacaaacaaacaaatgcgattggtaacgaaggggattttcgcaatcgatcgacgcaggaactgaggcggaatcgggagggggtggtcgccgaattgggggaggcgctaaaccccccagaaaaatcggaagcgaggcgaggaggattcgaggagtcgggtgaagtggggtttagggaagggaagcgagggggagtgtgtgaagggggagagaaggttttgatggcgctgcatccaataatacgccttcttgttaacgttagcggaaatgcagaatctctttcgagggtaaagtgtcccttgagaaaatctcgggcctatgtcccgtaaaaatcgattgttatattattttctgaaaaatacggtcgtttcactcgtatataaatatttaacgcatcaaagtttgaccaaactagctgggttttttaatatatgcatttgcataaaatttttaaataagataaatggtcaaacattttttaaaagttaattactaagaaaagagggagaacattttatttaaaaatttagtgcaaatatgtaaaaataaaagtcatactaaactaattttaataacaaaataggttaaaaaagtgatatttacataaatcttttgaataaggcaacggtcaaactatatggtctaaaactattgtgtcaaatggccgaagggagtaaaatgttaaacactactctatatttcacagttttttttttcaagtggtttttgcgaatgcagtatgcatatactcttgcttgattggattttacattaacgaaactgaactaacgtgagtttaagcaaaaccatggactgagatgctattgcctagttgcacatagaagttaataatgaaatactccctccattccaaaatataaggcataaccaccctaaccaaaagatcaagaaaataattattattattttgtagtttcgatcattctaataaatacaatgcatgcatccaataaaattagataacataaaagtagaggatttaaaaaaataataatttaatggagaagggatcacagttaattacctatatacatacatgttttatattatggaacataaattatgccttatattatggaatggagggagtactccgtagttctactttatagcgctgatgaataggttaagatcaaaacaaactacagatggtgggtcagtgggtgagaggagccatcaacactgccctgatctgttgcagatcaagagcatgtttagctctttaatactcttcagttcacaacagaggatcctaaacagcttggactctgtgtaaagttagctagaatcccaaatctttgagttcttccctccatgagcaattgagttcctaatttccagtagagatgcaaaaaatcaatcaagctggtttgctaataccatatgctaggcttaacataaaaaatgataacgaggcaacagaaatgaagcggtgaaatgaacatcaggatcattcgacagacgacag

SEQ ID NO: 42836 - DNA, 1501 bp, Oryza sativa
agattcataatagagattacctgaactaatattttatatttacctctgtataatcattttcctttgcaggctaaccttgattgtttttacttttgttgtgaaaactgggtagtgcatgactggtttcaacttgccggagaacttcaaagaaaatccagaagctttcttccagagcgtcaggccgcgagtcgttgctccacagaaaactctaccgacaaagaaaccagccgtaccagcgcaaccaaccttcaagactatggctgacaagacccttcgcgagttcgctgctctctctgctaacaatatggccattgggccgcaaatcaacatgggagacatggatttcaacttgaagtccaacctcatcacgatggcgcaggctagcccattctatggcaagcctaacgaggatgccaatgctcatctgcagcagttcttggagatctgtagcacgtacaccatcaagggcgtcagtccagacgccgttaggctaaggctgtttcctttctcccttctcgggagagcgaagtagtggttctatggcaaccgtgctgctgccaacacctgggatggacgactgcaggagtatgtggccacctgtcctcatcatgggatggacgactggctgatcctgcagaacttttacaatggactcaccccgatgtcccgcgatcgcctggatgcggcagctagaggagcattcttctctaaaacggttcgaggagccattgatttaatagagaagatggtcttcaatatgggttggagcgaggaacgactccagacccgtcagcgaggcatgcacaccgtcaaggagacggaactgcttgctgccaagctggacctcctaatgaaacgattggacgaccacgacaaacggctacaaggcaccatcaaggctttggactcacacgttacgtgtgaggtctgcagcaacacgggtcactctaggaatgactgctcggaaacccgtgaggaggcgatatacatgggcaacaacaacaacggtactgtccacaaggagatctggggtgaaaacaaccacgcccatattatcaaggaggtaacaacaacggtaacttttctaaccagccctccttgatggatctattctttgtggaagctaaaaccactgatgcactaagcaaaaagcttgcggccaatgacaagatcctagagaacataaatgttaagttagatggcttcgcttctgctttccaaaactagctgagcttcaataaaatgatagaaacctagctagctcagttagcatccttagtccctacaaatgaaactgggaggattccggggcaacctgactcctccgttgagaatgtcaaggcgatcacgacgaggggaggtaagtccactcgtgatccgccgtatcctaaccctgcaggaactaacgggattgcaaaagaagcgccatctagtgactcggctgacaaggaagttcagccagagaagaccatgctgcaggagtactgtgacacacgattgc

SEQ ID NO: 42837 - DNA, 1501 bp, Oryza sativa
ggccaaaaaaaggtactttcaaaataattttttttggttaaatgcaactagttttgagaaagaattattttaatctatgttcaaagagaatataattagattatattgtttagaagcagatacagaaacaagaaacacttcaatattgtcatgttatacgaaagcacagaaaaggaatatttatttgattccaaattagcaatgtaaatgagcttgcaattgcaggtttctgttttgttctccaatgggattgaacaaatatctctcagatgaaacaactcataagcaatcaaacaagaaggttcactgagcacactaaggagcaattaagatttatgcgaatccttgctattaaacaatgggagaaagagagaaaagcaatggccaattttgatgtaggatgtcagatccaaacatgtcatatggtgctagtttatacaacataatcggaagttcattgcttacctcactatggagcaacattctttcatcaaaaccgacagctgtagatactgatggcagcgctgcataaaatagtgagattgtgacaaattaagaagttgttggatacacataacatatgaacaaccgatgtaatgggacacattctgtgcttcaaactgcaagtgtaaagatagctacaagtgtaaagaagaacctaaaccctgagtaaagaatgtaaagaagcacctgcgtcagcagataacaaagctgcctgtgcaagatgagctttgaaagcatcatatccaactaccacagatcccttaagctcatcgcaattctagagtatgagaataaacatcaagaaaaccaaaatcaaaataatgtcactggatgatctgaactaaaatttctaagaaatcatacggcattcctgattacactgacaaagtaataacctttacctgacaatgtgtaaacccctccatgtttggcactgtacagttcaagcaaaaccacctgctcaaagcaaggcgagcagagggttcccagtcactgtcatcatcctcttcatcattaaaggaaaatagatcctccagtgtacccccaggctgttctttgtcagactcttgaagcagatcatcacaagccatacagctttcattcttgacatgcagacaaccatcatggcctgaactgtcaataagttccgaccttgctgtagaaactttggtcccatctactgataaaggattggcatggtcggaatttaaattgcatgctccagagttctctttcaaaattttctcatcattatgactcccgctcaacgaggaaactccatttgctttagcatgtgatggttttccatcattgccgcttttgcttttgctgtggcaagcttggtctgaaactccacaactctgtcccttttggctgttgagtgacctcatatcagacgccatcagagcatgcaacgcaatctgtaattgtgatacgacaagatcagcataggaaacacaagagtggataagaatttggacttccgacagggagccct

SEQ ID NO: 42838 - DNA, 1501 bp, Oryza sativa
tggcagctcaacctggatgcgctcaagataaagaagcagccgcaagaggagatgggggcagaagctgaaagatcaactcgatgagctcgaggctaacgctgagcagaacaagacagatcttggggctggttaattacgcttcggactacaggatgatatactgatgaaacagtggttcgactttgaggtaaaggtttaattaggagtagtcaagtacatctgagctcgtaatgagcagactgttacagtagtagatatctgagtttgggtagttcatagtccttcggattcaactcatctcacggagtcacggtacacgtatttgtatagattcacaatttccaatgtgattgaaaaaaaaagaccaatataggaaggactatattgattttaaattaaggagggggtgagtcttgaacccggaccagctagctcgcagcttgcattgctagctagaaagatcccgggcctttcccaactttaaaataatacagcaggtaaactttgtgaaattccttgtgatacagtaggagtatttgcacacaacattggacaggagaaaacccacacaggaagaataaccaaggcatttgcagagtttatcataatttcataaaggtggagcaggtgcctgtttgaattcatttgtaacaaaaaaaaaagaaatcgccaccaatgttggtctagctgtagcattcaaatttcaccagattattgttatgttatcctctctattgttttctcttaattcaaaattttctcgaatttaattaagtgacactagttaacatgtccaacactccaaccaccactattctagacaggaattcttttcatcctcacatatcatcaggtaaaaatgggacctgcagtgatcttaaaaactcttcaatgaagaaaatacagagggacccgtccttcttgtctagctggttgcaaccaagaactcgaacattgtgtgattagcataatccatgtagctagtgactgtcaagtgtcaactggcagtaaggggaaaaacttccaaaagagaactatcggacgtgaacctgaggagtaaaaaacaaaggtaacacaagcagccaaagctcataaaaatttgtcaaaaattttgtggcatccctagacttagggcctgtttgaggaagctttagattctgagaagcagctgtttgatagccagcttctgagaatctgaaaagctttaaaacccagcttctccagctttggcttcttagttcatttttaagaacaaaagttgtggactgtttggggcagtttctagcagaagcagcttttgggaaaagctgcagctgggacaaactcccacaaacagggccttaatttcatcaaacacttgagaacatggccttttggaggaggcgaagctgcagctctacggaggatgaccacatcggtggcgataacatatactacctccgtttcatactataaattgtttgacattttatctagtaaagctttgctaagtttgatcaag

SEQ ID NO: 42839 - DNA, 1501 bp, Oryza sativa
tgagtatcacaaattaacttactggtgagtgtccaatgtaaggtaacacacgtttaagattgacaaattaattactgggaaaatcatctcagccatagttccattacctcatgaaaatggggaaatagtggataactggtagaaatgctagcttaccacttataaatccgctcctcattggtgaagtcgaacgacttggcgacctccggggaggtgaacacatctctctccgaggcaactgcagctgcaacggaaccaaccccttcaccgaatcaacaccaaccaaacggaccaaacaaagggcagtagaagcagaagacggccggtacctgcgcagaacctgcgggcggcgcggcgcggggtccacgcggggcggcggtgggcggagaagaggagcgggttgaggcggcggaggcaggccgacgaggaggcgcccgcgagcgccattggagcggcgcgcgggctcgggataaaaccctagattgctatccagtccaggggaggaggggagctcgtggggtttgggtttggaagaggatggataacgcgggagggtgacgaaccccacgcaggaatgctactcctatttcgcgcatacgcgctaggaaccgaactcgcgcacgggtaggggtggacaaagagctcgggcttggctcagcttaaaaaccaaacgaaccgattatccgtagctcgcttcgagcaaagcccaaactgtgaaaaaagacaaaaaaaaaaaagacatacacctacatatgaaattttatcttttagccgtaaaaaaaaagacaaaatcataatagatttttaccctcaaaactgttagatttttcatgttttttactgctaaatataataaatttgaatatgagactttacatatatgtgtaatactattaggagtaaatgttcaattttttttagaatattttgtgacatttgttagtttgtgtgcacgggaagcttatatgtataggatatgtttccttcttatgattgatgttgccaaaacatgctgattaattaaagagcatttctcgatcattgacgatatttgatgagtatttacgccaatacacgatgaaaagacgtgaatattagggaatgacctaatatcaaataattagaaggggtaaggtttcgaacccagatcgtctagctcaccaccttgtgaagctagccagaagactcctgatatttctcacgccaatacacaatggagatgtagagcctaggcaatacctaaccagccttagagctggcttcaccgatgttcgtaattagtagttgctaatgacaatgccttttttattttcggggacttattacatattttttaacaagattattagtatgggctagatggtctctgatattctctactatcctggatttatttatttttgttttcctaatgattatcattcggaatcggacatgtattccgagttgttccaatcttggaacggaataggttttccagtgtctcccgtgtttggccccc

SEQ ID NO: 42840 - DNA, 1501 bp, Oryza sativa
gagcaatggattctttggatgtcaattctaacaattgatcttgcatcttgcaaaaacttagcaatagatttttaggatttagtttctgatttctttgtcagtttcaacatatttagcagaacagtactagtatttttgttgattgttatgtttgtacatgggagatccaaatccatcttatcatggaattctttgcctgtcaatttcttgatgtatcttgtttgcaaggatcactaaacatttttgtgtgatttaattgatttttctctcgtaatttcttcatgtgcctgatcttaataaatgaaaccttggtctctatcaaaggtggagaaaaacaaacgaacaaggtagtgagcaatcaagttgatcagatattttttcagtgctacatccaaattgcacagaaaaggaagaacatttgcgtactccttgtgtgttacgatacctaacatataggtcaaatacgatgcgtctctatcaatcttcagccaaaaaaataacaataatgatttgtagcatagaagtcaaccctttgtacatgaaaaacctttatgaaaaccaaaggtttggattgcttcccctcgcgacaaaattgaattctccaaaattctctaccggataagttggtttatgttcacaagcaaccgatcctggagaaatactacaattagtacatttttgctttattctcaatctatttgctgcagcaaatggagtttcctgtacaataagcggccagtctgcagattcaaaatcaggatactttcatagtctcaaaatgatcaaaaggggtgacttcttcctacaagtttcaaaaagctcattttgccaggcatccatggttggtgttttcagtcaattttcaccaaccacacatcaaacatggttggtgttttgttcttttactattccttccataaaggttttgcttacttttcctcaaggagataactacaacccaggaaaaatattcagtaaatttactccatacacgtgtgaaaactattcctgatgaagtgaagtgaatcttcttggtaccaactctgatcacttgttgtctgaagaaggaaaggcaaaaggattccctgtagaatttcagaaatcaaaatcaaaacaactccctcttctcctttcctagcatgtttcgtgggacgattatgcgtatgttttgttcatattccttagagcccacccgagttgctatgaacaaaattcattcatacgctttgtcgtcttgcgccttttgaggacttttttcacagttcattccttcttgagactttcatagctcccacaaattccatttcagtgggatggtccaaaagtgccattttgccctccaacaccatctagatggccctgaatcagcttcagcctttgattgattactgctgttggagatggtgtttggtgattgttgtatggtgagtccgtgggttttgcatgcactcaaaatgctgccacaatgttcttgctgtggtactcccactgccactgccca

SEQ ID NO: 42841 - DNA, 446 bp, Oryza sativa
gtgtaccttatcatcaatgcatcagctacctcctggagttgtctctccactatgagatactatctggaaatgcagagccccactgaaagtgaagttgtttgtgtggctccttgtcaagcaccgcctatccacaaagaaaaatttacagaagaaaaacattgttcccactagcacctgcgacatctccaatgaaggaacaaaaacggccagccacctttgttttttatgcccgtttgcaaaaagtttctaggataaaataggagtgcaaccgacaatttaggatgtgcatctgtttcatcaattgaagacggggtattgtgacatccagcccagggcttaataggattaatagaatactcatatcaacaagctgcaacttcttttccgcaagccgatctcgaaagaactctaaggttaagcgtgcttggccccgagcaatttcagga

SEQ ID NO: 42842 - DNA, 1501 bp, Oryza sativa
ttcaatttcttcttgttcttcaatcaaagaaaagtacggaattacttgagagtaaaatgaaaagaaaaatccaaacaacatcgtgcaagtttcaaaaaaggaagagaaaagaatttggaagaaaaaatgcatttttgcccgccgcaaactgccgccatcttcgccctcccacaagccactgccctgggtcacgagcaagccttgggagcccaaatctagctctaatgaagtggggacgagccatcagggtgagagagggatgacaaagtgacatgagccctcatctgccctcctccatcttaggaccaatgggttcaatgacatcctccacggctctatcctccccaacagccttatctcatgggctacagtaggagatctcgccagcttcttagtataggggagagaagtgcaccaacggtgagggtgagcaagaggtctatcgcatcccatccatggtgtagggcctaacacggctgtaacatcacctcaccgcgtagctgcatgtcgctcttgtcatggcatgtgttgtgagcccaacggcccaccctatagctagcgccaccaccgacaccaacattacgagtgccagagaagttgttgcacgcggatctcacctctacgcatctcgcaagaagttctcatctttctgagagagtgagtgaatagccatgatgacattggcgcgtgaagagagagagagaatgtgcgagtgggaagcggggatcggggtctagggagagaaagagagacagctcatgtgccaatcaccagtgtcacacgaagagagacggcactgtggccgagagactctaatatcatgatagaactaaaagttttcatttctccatttaaaatacttcttcttattatacactacatcaaataaagaatgtttacaaaattacacttatgcaccgtccatgtaaaagtacaggcgacttgcgagttgttatccagaagctgaacaactttcaatgcctccttttaggaaaactaaaaactgcagattcccctgaacagcaaattaaacacgcctttcctcttcgagaagtaaggcaggacataaacgaggaatgcacaccctaaaacgaagtttccagttaacagatgattcccaagttatggtcaaaacaaaaacaaatagtacaaggaaaaccagcatagaatattagcgaagaagagattctctcatagatacacgctatctgcgccatgttaaccccaagaagacgccacaacgtgacacgcatgtggccacaccaaacccccgggcggccatcacgcgtgcatccgccatatacccccggccagcactatttataccccctctctcatcgtttgtttcgatcacttcactacttcagcacacactgaacttgttgcaaagagagacatatagtatatagttagtagcttaatttgcagcgctaataagctctagctttctcttcttcctagcaaattataattaacactaggttctagctagcatgggtgt

SEQ ID NO: 42843 - DNA, 1501 bp, Oryza sativa
atagctcctcttatgtgatttgcatgcaaaaataactcctcattttttatcccctcctctctctttccctcaccactttaatttttttcaaccttctttctctccctctatatttttctctcctttctctgtttctctcctctcctctctctctcatctcctctcctctgatgacaggtggcgccgccgacgaggaggtgtcccttgggtgtcgcggtgggcgcacgacaagggcggtagatccggcggtgccatcctcgggacgaccagatccatctcgggtgcagctgcgtcgtctgcgacggtgagtggcaaggtgttaacaaccaaatttggtaatatcagcatcggagatgaagatgaaatcaaagcggaatagaagataagggtattttcggaaacagagtaagaatcggctggagtttggatcggctacgactgggatcggctaagtctgagttggactggttaagtgatacagccgattccgacaatacgacccgtgtgtgacattgggttcgagttgatgtgcttcaagatgattgccacgcatggatagagtcctgagaaggcaattgtatccattaattaggatattttatctaaattccttagagataaaatgtgggcaaaagtctgccgcaaagacttatggtatcttagagtttgttagagataagagtcgtgtccaatatggacatatcttgtatttctcgggtataaatagaccccgagccctatgtaataaaaacatacacacgttcaatacaatttcggcgcatcgccaccctttttgctttcattttatctcgacgagttattgctttcaggttgagctgcatcggcttcgatcttcaacaagaggtaaaacttgttatggcggcttgtgttctcgagattagcgcttccatcttgttaagatcttgttgcatttaagtatattagatttttgtttagtatattctatttgctttaatatcttaatataaagtagtatcgcagtattagccgatacacgctacatctatctgatcggctatgctatgaatatatatatataatctcattattaatatatatttcgatctaggtgatttatactgtctcggcaaggtgaccgatctatcccaatcacttgattcaagtatatatcgatataaggattatatatcattgatatctacagccgattgagtagatttagttctgatttgtttacttaacaattgccgatcgatttacacatgacatcggctcaaagataaatgatatgtcatcgtcatctagccgatcggctatcatttatgaatttaatcatggtttctctgtctttgtttcttgttgtttgcaggatcaaatcaactggcacgctcatacatccaaaggcgagttttggacctgcactggagttaagcagatctcccaggcctcatgttttctatcaacatgcttttggcacgcctggtgggaccgattagaagtcagaaggcagcctccttca

SEQ ID NO: 42844 - DNA, 1501 bp, Oryza sativa
atggcatgtagaaattagataatactatatatttaacctaatatgagataatatactgaaaacggcagcgatcgggcgcccgccgccgcccgcgcctctgcgctgtccccccccctcccacacacacacgcgcaccccaccacacacgccgttacaacaaatcatccgcatattacggaaacgttgtattaaggaaatccgttttattttttgttcatctagtaatgtttcagcaagtatactcgtaatatttcactatgtatagatcaaatgttgcagtgaatggaaacattctttcactatttgctgaaatattatttttatatagggtgaaacaacgcccgattttttttgaaaaccattgtttcgtacgttgtagcaaaatgtttcacaaggtgatttggttgtgtttcagtttttttaaaatattaaaaattttcgatctacttagtgaaacaattccgatctacttggtgaaacagtgcccgatttttgcaaaagaaaatagggatttgtaggtgcctccataatatacaccatgtcgacgggggatacccgtagaccggatatagagggtattaaggtacgctagtacgagaatctacgtaatacgacatcaagcaacaaaaacagggattatactggttcaggccccttagtagttaatagccctaatccagttgatatggaattatatgacagaaatcacatattacaaagggaatagtggaacttgatgataccgacgagatcgtagtcgagttggttcgactagatcacccagcgatttggctcctgtaggctccggtttcataggctgtggtcgatgtgttggcggtaggattcgatgccttaggtcctcccgggggatcccttttataccgcaggtcagttggtctccaagtaggacttggagacatcggaccctacacgatacagtgatgacccagttctatctgagtaggaatcctcccatctgtggactccgtgatgaatttccttagcgtgtacagagaacgtccgtatacacgcagatataccatatcgatacatgacgtatatccaagggtagagggtataccttatccgtaaccctgacagtagcccccgacttctgcttaaatgaactcatgtgaccgatcgcgacttctgatgtcggggttattgtcgttctctactggtcgatctcggtgtgagaaccgtagagacatggagtaatcgacaaccccgtgcgaagttcaacggtcataagtgaatttaaattgaagtccgaaaactgccacgcgtaacggggctagaaatttccggcggccatctctctcctttccttggaattcatactgtcggtagtgcgtctatttaagggagttttgaggatccattttgaagtccgcctgttgtgaaaaactttccagcctccaagcgctcctcgtcttctccgctcccgcaaaaaccctagcttgctcatctcagtcccttcttcagcgatctccggcggcta

SEQ ID NO: 42845 - DNA, 585 bp, Oryza sativa
tctaagatcaggagttttatagcgtagagacactttcaaaattgtatagaaaatttttactctagagacactttagaaatattttcagcacattttattagattttatcttgtagaggcattctttcggcactttaaaatgtgtctaacatgtaaagacatttgcttgagacactttaaactctgtagagacacttcttacaataaaagtatactaaatggctaaatataagtaacttaaggcataaacatatataatgaatgacatgggattgagttggttagtgccttgaacataagaatgatttgttcaaaagatcatgaattcaaggattgacagaaacaagggaaaatattttattctcatttttacattggtttcatatggttgtggtacaatttaatgtctctagaaaatgcctctaccaccttatagacattatataaaatgcctcttcgtttgtagagacaattcaccataaggtacttattagacattttttaaaatgcctctattgtattgtaaaggcatttgaaaagtgtctctatagtactagaaaaatgtctctacaaagtatttttcttg

SEQ ID NO: 42846 - DNA, 900 bp, Oryza sativa
atatatatatatatatatatgtatatatatatacatgtatatatatatatatatacatgtatatatatatatatatatatatatatatatatatgttacttcgcatttatcctaatacattttttttatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttaacatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 42847 - DNA, 1501 bp, Oryza sativa
catcttgttgaacatgtcgaaggcgagcgggaagaggcggcggcgggcgcagcagaagcggaggcaggcgttgaagagccggaggtcggggccgcacgccccggcgaggacgtcgtagacgaggttctccgcggcggcggggcggcggccggaggaggccgcggtcagcgccgcgaggtaggacgcgggcgcgtggcggaaccccgggcggagcgccgcccaccggaagagcgcgagcgcgaggtccgggtcgcgctcggaggagatcgcctcggccaggtcccccgccgtgaagcccggccggagccgcgcgacccacgcagcgaactgctcgtccggcggcgcgcggacgggggactcgggctccaccacgcccgcgggcactcctcctgcttcttctcctccagacgcggcataggagctgaagcggcggaggctgcgagagaagcggcgggcggcggcggcggcggcgaggagtgccatggcggtcgggctgctccggctaggcgcttgtggatttggagctgagctgccactgggccaggcccaatatttgttgctggcccactctacgtaacctgttacctgcagcctcctttaattggattcataacataaagggattttaattgggtagtactaatgcgcgggtgtcaccccccatccccctaaacacactcctctccccttcctcctcccctacttctcttcctactacaccataaatttttaaacaaataaaaaaaacaaacgttagaaaaaattatatattaaaaaatatttaaattcaaattgaaattcaaatttaaatcggatatataaactttgggtctataaactttaggtgtataatatttagatgtatagaaatactatatataaaaaatatttgaattcagattcaaatttgaatcggatatataaacttttgacttataaatttggggtctctgttaaacttgagatgtgtaaacttgaggtgcacaaactttaggtgtataaatttattaaaataggaaagtaatacggtgccaaaaaagaaaatcacatgaagaagggggtgatcgatgtggggagggggactgatcgtgcccagcgatcgatcgcccgttaggactttcgattttaattggatgtgtacttgtgtatgatgtatacgatccatcaaattctcttacttcctccgatttatcatattataagtcatttgatcaaatttataaaaagatatagcagtatcatcgacacaaaacaagcatattatcgaaatatatttaatgttagatttaatgtaattgatttgatattttagatattgctaacttttttttataaatttaatcaaatttaacaaagtatgattagaaaaaaaaatcgaacgacttatgtaatatgaaacggaaggagtaattttgagaccgagggagtatattactgcatcttctcgcattttgcattttgcaaaacacgtgacaagtagagtggagtagtagagaaaagc

SEQ ID NO: 42848 - DNA, 1501 bp, Oryza sativa
ccgttcttgtttggttcacaacgctgttgtttctctgcgcatgtacacaagtataatttgaggtttagagcatacatccttgtatgacgttggaagtacatagaaaatattactccaaatgttgtccccaacgtcatgcactagccacggggtatatttttgtctgcatgcgtgcaccattactccggcccagcccggccatctcacaaagtcttcacttgtctttctttatttgtctcaaaaactacatcttgaagatcaccaattgctttgaagttcgagaaagtgcatacaaatatattagatttttcagtcagagacaaattgactagagtttttaaaactagctagaaggcatagtcttaaggagtagtagcattgtattggtaggtgtgaggtagatcaaagtaaatgttattttaggacgaagttaattagtactcctctcagtccacgagtatatatgtagtattattttatcatacattaatcatcaattaacactggtactaccaactaacatgaataatctcgtactagtacataggccctgtttgaatcgggagggctattaaatagtccttcagaatcttgctatttaagagtattaaacgtagattactaacaaaatccattctataatccttaggctattttgcgagacgaatctaacgaggtatattaatccatgatttgctatagtgatgctacagtaatcagccgctaattatagattaatatacatcattagattcgtctcgcaaaatagcttaggggttatggaatcggttttgtcggtaatctaagtttaataatcctaaatagcaatattccggaggactatttaatagtccggaggatccaaacaagaccatagaatctcgtaccaactttaagtaggggttgactgacctttactttattggtagtggaaatataaatggacctcagcggaagcacccttgcttgtcttcttttaagatctttattgccttcctgatttttgatctttttgtatgttccaggaaaaataggaaaatcccgagcattgtggagtggtgctggatttcgcttaatgctacatttgggttggtattttttttccagattaatcaaagggactctcacttatatgtttgccagtcaaatattactctctctccgtttctaaatatttgacgccgttgacttttttaaatatgtttgaccgttcgttttattaaaaaaataactaattattaattcttttcatatcatttgatttattattaaatatacttatatggatacatatagttttacatatttcacaaaaatttttgaataagacgaacggtcaaacatgtgctaaaaagttaacggtgttaaatatttagaaacggatggagtaatatactagcatacattgtgtaacttggaagtagctataatataaaggaaaatgtatgtagctttccaaaacgcatcgggggttgttggatgtaacccctcacccatgcac

SEQ ID NO: 42849 - DNA, 534 bp, Oryza sativa
cagctctgacgataacaagttctgttgcataacattaactaataagatattgcaggaagctaatgtgcagtgctgcacgagtgttgtatcttgatcttctgaaccagaattcatttacagtgcagtgtctgattcttattttgactatagttgataatgatttattattttttttttgccgggtcggcgaaggagccgaccaaatttcattaagattgaaagggggaataagtacatattttacacgacattatactgtcggtccagaggttaagacccctggaaacaggagtggggaggggaagcaaagaaagaaaaactgcggtaatgctagggctactcctcacaactttcaaatacccccgcagctctccaaactgctacttcctctttgatgtctgccactaggtgctctgctgttttgctcttttgatcaaagactctagcattcctctttgatgtctgctgataatgatttatcacactatatacgtttttacgttctacttttggagtaacaaactaatgatcagt

SEQ ID NO: 42850 - DNA, 417 bp, Oryza sativa
ctgttgttgtttttttttaagaatttgtgatttattgcagtatcatgtgatgaatttgatttgtgtgtgatgtgaacttgtgatgtatttgtgatgaattttgtagaaacttgtgatgtaatttgatttgtgtgtattttttttaggatttgtgatgtaattttttagaactttaaaatttgtaatgtggacttgggatcttacttcgatttgggatatgcataccacccatattagggagaaaataaaaaaaaggatatgcataccacccagattagggagaaaataaaaaaggaaaaaaaacctggctatcctctttagtcgcggttggtaacaacaaccgggactaaagatactctatctttagtcccggttggtccatctttagtcccagttggtaccaaccgggactaaaga

SEQ ID NO: 42851 - DNA, 864 bp, Oryza sativa
taaaattttgacagatataattatagtgcaattatagtgtaattacactgtaacttatatgtaattacactgtaacttgcatgtaactacagtgtaacttatatgtaagtttcacataattttgaatcgttagatctattacaagatttgttttagtgaggaagaaaacaaatcatagcacacacatatgtgaaagaatttgttcccacgacctccaatttaccgaaataacatgttacggagagatttttgaaagttacatacaagttacattatagttacagtgtaattacatgcaagttacagtgtaattacactatgattgtactgtaattacatctatcaaatttttgggggaaaatttgtcgacaaatatatagaaaaatcgttggttggtgggatggggaggaatgcttggcagaaatccaaggggtccagggaccacccggagcacctcttgaagtcgtccctgattactcgaaaagatgtcttcttatttttcatgttctttataaagtcactaaaaaaatttagaaatatatatgtatatgatatgttactgtacaaaattcaacttatataagtataaaaaacattaaatttaacgtgtaattcgcggtcaaaattattgtttttgtttttaattgtacaggtcgaatgcgaacttgcctattaattgagagaataacatatcacatattgatttatcttactaaatatttttaaatgttttaatgaatttttagataatatggacaaaaggagaggggacatcctctagaagggggtaagaaataaaatccatctcactcttcttcctcgaacgtgctgtccgacacggcgccaccgttaccagaacatgca

SEQ ID NO: 42852 - DNA, 734 bp, Oryza sativa
ctgcctgtgagtggagccgtctgcgccgtttattttattttccgctgcttaaatttttaattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccttctaaaaatattggaaaagtagaactgttctcctccctttctcttttaattaaccaaactaatggcacatgcacttcataatcttttttaatggttctcattaaaaatttattccagtgttattagtactgtacatccattactgtactaatggctcattttaccagcaaaagttttacaatgttgttttatttaatcttgctgcaataaaataaatttagcatgttgattttataactttcttttatttcttttggaacctgttattcaaaagcacaaaacttgtgaccttatttccaactgtttcaacttatcttgcaagcttggtttactttatttacttacctttttactttgatttctaaactttattcaaattaatccaaaaacttgtgctattaattggataaatgtcttaactccctcctttcacttgtctttaga

SEQ ID NO: 42853 - DNA, 1501 bp, Oryza sativa
tgaatttaaccctagctaaaccatataacaataataaaattaaaatagtatttatccgtcgcaacgcacgggtattttttttctagtaattacctatgtgaaaaaaggagactggagagaaacatacttacgtacgtttacaataaacaatagagattaacaatctcaccaggaaaaaaaattaaaagagtgacagaaatcaatatttttttttcgggaaaaatcaatatatttttaacaaaatcgttataaattcggcttaattaaaaaaaaagttggtgttgagctcgaatggagctaacacttgagctcctcatagaacacatccttgaacttggcaaggctctcggggtccatggccacgacgacgtcgagccggccgtcgccgtcgtctcggcctggcacgaggtagacgaggccgctgaactggaggcacgcacgccccatgaacgccggccgcccccagccgaagtcggcgtcgtagagcggcagcccctgccagctgatcacccacaggtcactctccggcatcacccactcccccttgcggagccccgccgcgccgccgctcgccgccgccgccgtctgctccaggtggtccagcagcgaccggacgtagccgtcgtcgagccgcgcggtggcggcggacaccttctccgcgacggcgccgagcggcccggcggcgacgatgtcgctcaccttggacaccgccgacgcgcggaagatggcgttgccgaggtagccgcgcgggagcggcgggtgcaggcgggtgcgcgcgtcggcggtcatgtacagcctcgtcgccgcctccgttccggcgacggcgagcccgcgcgccttgcacgcgcaccgccacacgtgcgcgaccaccgccgtaaaagtggacagcctcttgccggcgccggcgccggcgcccttgagcgcgttgagctggttcttggacatggggaggatggccgagtcgaacggcagctttgaaccgccgccgcggcgacgggagtactcggcgtggtcgaagcgcacggcgggaggggagcgcgcgcggaggagcgtgcggtcgagccacggccgctgcaccgccgccgccgccgcctcgccgtcgccggcgacgtccctcgcaatggcggcccacgtgttgacgaagtccagcgccgcgaggccgtccgccgccgtgtgatggatcgccgcgcccaggcacacccctccacacctaaagaacgtcacctggaacatggccaagatgctggcagcggcgacatcggccgccgggacaagcatccgccggagctcgtccgacggggcgaggtcgcccaggtcgtcaatggtggcgccactccgcgccgtgacgaagagcacgccctcgccggtgcagctgatctccggcctgccggcgctgtcctgagcgaggcggccggcgagggggtagaaggggacgagcaccttggacagggcggccttgaggacgtccggcgagaaaaacgccgcgtcggagtcggggcca

SEQ ID NO: 42854 - DNA, 1501 bp, Oryza sativa
gttttttctcacaatgttcaatacctaagtgatgaatattttatgccaaagagcaattgttcattatacagatataaattgatattacatatatatctacaacaatcatgtgcccttttcatgtttcagaatgctcccgtgtatagtacaactcttatgtgaggatacaactaaaagttcagtttctccttcatatcaggattttgagtgtccaaaccctaacattgactctgcaactgcaagtaggaaactaccccctggacaagcaaattgtgggctggatatatactaaggatcattcatgctaaactatacttacagatagactatgtgatggaagcaacttcacagtccgacattagcaaaacgactttttttttttaactgtatcaagattaatgattttgtttttaaacagcaatagaagcagcaaactaatcagtgagtgaagccaggttatatcctctcttatctatggattaatacatataacatatttcttcagagatagtaccagttgtgacagaggtgccagttgcagtaccaacctaacttttgtctgaaaacaattgttgcccttggtctacgatacttgaggcgccaatctgttgttaatcagctgtgtcagtatgttatcatcctaatcgaagtgaatcagcataaaatccaatatattgctgagcatgtgccatcacagtatcccaccgagtttttacgtatgcccgttgtttgtaaatttgtatggcaatgaatctaacctgcgttacatggacacaatggatcatgtgtgcatctgaaagaaagaaaattaaacctccatttctcccacatgccaatcggcagagcctgcaatgaagctgcaatttctattttacaatccattaactcgaatggttcacattcgattgaaaaaaaaaattgtaccttccagttgcttgtgcgcagtgtacaccattttgattgaacgctagatcctgacccctagaggtaagatggttttcgctaatttttggtcaaacctactgtttcaaatttgaatatctgaaaatatatgaaatttcacttgaaatttgcttaatttccgtgtcgaaacctcaaaattttacagttttcgatcggctctcgtcgttcctgttgcacgttgttccgctctctctctctctccccccaattttgcagctttctttgaagctggcaaaccaagaaaccttcgacgctaagcagacgtcgtggcaagctgcgtcccgtcgatccgtcaacggccaatctaatatttttatttccgcgtggtgtgatcaaaactagtacccacccacgaaggaagatagcggtaggattttttttttttcgtttatttgttttccgcgaaacgcacggcgtcacgagtccagcaaacagcaagagaagagaagagaagagaagagaacgcgtcccgcttccgactccggcgagagcgagaccgagagcgcgcggcggcggcggcggccggaggaggagaaga

SEQ ID NO: 42855 - DNA, 185 bp, Oryza sativa
ttactattcttctaataccattccatgagcttaacttcatcaatgtcgcgaaacatttacaacctcgagttttaggcaccttagttttgcataagggatagaaataaactctcttttgtaaatacttgtcagtggccactgcagttctcagttaattgaggaattacattatgcccacttgcagg

SEQ ID NO: 42856 - DNA, 439 bp, Oryza sativa
agtatgtcttgttaccagaaataagtttggcttccccatatccatgtattgtaaatttgtgcatgatttttgtgcaccctaaaacttagatacttctaaacatctctttttaactcctttagttttgaatgtatagagatagtatctgaacctattagatataatatacactggtaacttatgaggtttaactgaaacttcaacaatattatccattaagagtgtttatgttgatgcttcaactctagttctgatcagttttaggtattgaaattttgtctctggtaaatctgaactttattttttttttttggaaaaactaatcttcattttttttttttgcaaattccactttaatttttctgcaaattccacttttaaatttttctgcgaattccacttttacaaggtatgttcaaatcctcgttgagttgggcat

SEQ ID NO: 42857 - DNA, 1501 bp, Oryza sativa
ccaggggcttgatcaagtgattggtgtgatcaacagagggcagcccagtggttgggcagtttattttaagcttggggtgagcacttggaaaggtgttgaagttcctcgatgcctgcattaggtgggataaaaaatcaggacggtcaattgaggcaagtatattctttgcaagtatatgaaatattatactattatataattttttggcgttatttagcactccatccattctaaaatataagaacataaaatcagataagatatttctgtccagatttatagtactggaaaatgtatcatctgatactaaattcttatgttttcggacggaggaagtagtaacaaaaatgtaatggtactgtcatcttgccacattacgaattagcgtcataaactctttataactaactacttatatattcaatttcattgtctaataaaaaaacaatactcaattgaatggacggatgggcgtgtggtgcacgaacctcagcggttctagggaagaggcttcttgttgatttagaagacagatgggaggccaatttaggaaacacgaaacggccggccatgtcgacgacgtacggctatcgatctaatcttcaaaaccagacgcacggacagattggattgaggccctccctgccgcgccgcctgctcatataaaagagggggccaaacacgggagacactggaaaacctattccgttccaagattggaacaactcggaatacatgtccgattccgaatgataatcattaggaaaacaaaaataaataaatccaggatagtagagaatatcagagaccatctagcccatactaataatcttgttaaaaaatatgtaataagtccccgaaaataaaaaaggcattgtcattagcaactactaattacgaacatcggtgaagccagctctaaggctggttaggtattgcctaggctctacatctccattgtgtattggcgtgagaaatatcaggagtcttctggctagcttcacaaggtggtgagctagacgatctgggttcgaaaccttaccccttctaattatttgatattaggtcattccctaatattcacgtcttttcatcgtgtattggcgtaaatactcatcaaatatcgtcaatgatcgagaaatgctctttaattaatcagcatgttttggcaacatcaatcataagaaggaaacatatcctatacatataagcttcccgtgcacacaaactaacaaatgtcacaaaatattctaaaaaaaattgaacatttactcctaatagtattacacatatatgtaaagtctcatattcaaatttattatatttagcagtaaaaaacatgaaaaatctaacagttttgagggtaaaaatctattatgattttgtctttttttttacggctaaaagataaaatttcatatgtaggtgtatgtcttttttttttttgtcttttttcacagtttgggctttgctcgaagcgagctacggataatcggttcgt

SEQ ID NO: 42858 - DNA, 1501 bp, Oryza sativa
cacggggataagatctggcattgaaaagacaaatatggcatcgtaatgaaacaatctcatggcgtttactacataaattataaaaagtaacatagatagaagacatctatgaaaatttgatgatatcatacaaataaagcacaaacaaaaaatatagaacatccagcatttgtagatacggcatttctaatggatgatcacctcaaattaaatcactccatattatagttaaaccctaatgttgttccatatagttaaataactaccctaatgttgtgaattctttatacactttagaaaatcttgtacgccgttagggatgttgctttcacactcattttgttggtacatcagtagatttagcaaaaaaagtttccttagctcgtcaccatcctgcacatgtatttaataagttaaattttggtaaatatataataatgtaatatatgaataattaatgcctgtcaagacttacattaattgccggcaaatgtggttctttattattccatgtacacatgaagagatgaacaagaaaacccgataaactcctaaggaaattgaagagttagcttccctttctctacacagttaaatttgttggtttgaacgagtttttaagaagataacttacctgctgtaaaccggattattgacaattacttgcctccacaagttgatgtcttcattccacctagagccagggcatgcctttctcatagctttgttgaagtgatcacaaatagttatcagttttctggtgtatctcatatttgggttatttttatattctggcataagtggatttgggtctaacacatagagcgtttgactttcttggtccactacaagcacgataaaacttcgagcatggcgtactggtataagaatctacaaaagatcaaccttcaagataatatataaaacacggccatataggatggtatcttagcgatcttaccgctttgcactgtgaaagtttgtaatgaatttccgaccaactaccgacggtctctgcaagatttatgttgtcatggtggaccgggtctttaccaaagccagtagcactctacatgatttaaaaaatggttcaattacataagcaatagataaatcaatatattcgatattgcgattataggtaataacatgagcaatagagaatgacatgagcattagaatttaaaaacttacccaaaattgcaagtccaagcaatgattcgatattgcttctttagttttatgaatcatctcgattttttcatacatgaacttacgaatagccatgttgaagcaatcactttccaatggctcatccttctttagtattgtttgaagctgtttgagactcaagctaatatagtgcggccttgaactttgtacccatattttcctgtcaatcaaagaaaataagttaatgcatatatgaattacgattgtgtatacaatgcattgcagtggcttactccatggctcatccttctttagtattgtttgaagc

SEQ ID NO: 42859 - DNA, 1501 bp, Oryza sativa
tacaccaccctcttcctagattaactcttccttctcatattttttacgctttattagttagaaagaaaaatcttctattatatactaaaagttcattaaacttcctacgaacgctcctaaattaccatgtggcatcctacaaaacgtttctaaaccgctacgtggcgttctaataaatcggtggatccgctatttgtttaataaattgctagactcactattttcaactattatatttatctttataaaaaaaaatatcccacaacccaccccttctctcctcagtaagtatgtatgtacgtaatacaatgccatgctttctcccctcttccaatccttctcttcctatttctagatgaaaattttaacatgaaaaaatattataataaaacatctaacctttcggtgaaccaactattttaaccattgtccctaaaaaaatattttaacgattatttaaaccggtgaacccattaatctatatataaaagaaacacttccctaaattttaccatagaacgttgtgctttgcatgaaaaccaaatataaacaaacattaaaaccattagatttaggtatatagatggtttaaaccggtgaacctatcaaatctttatataagaaaaacgctttcctaactttgaatatatactatttttctttgcaatgcaaccaaataaaaacaaaatattaaaaatggaaatatatattatggagtaaatttcacaaacccacgtagatatatctatctattatataaaagtccattaaacatcctaaaaagctcctaaactgccacgtgagattccaagaaacagtgcaaagatgacacctaacgctctaattaattcgtagaaaatctatggaaaaaggagaacatctaaccattggttttatttaatctgatggacctaatattttttttaccatcagataccattagatttatctttagtaaaaaacttaatatcaatctggcggtacgagtccgcccaacacatatacatgcttccatccatacgcatgataagagtctgtgtgattttttccttgctcgcctcccttttttcgatggtaattaagttaaggcttaagggtatataatatcttctatattagtaagttaattttatcatactttcaaagattgcatacacttgcaaatataggtataaataatatatctcatacatattgatcttggtatgttttataaataaataaagaatcttcaatagctgtaaattttaaattatatattcaatttatgatctgtttgaaccattgtgtttttttaattaaatcaatagtttaatatctataccaaccatatttaattccattgtgtttttttaattaaatcaatagtttaatatctataccaaccatatttaattgctaataaaattattatattttggacccacatccatacgcaaaaaatcctaaatgttctcattacaaatcaaaatatccaacttagttttttaataaaatcaaa

SEQ ID NO: 42860 - DNA, 1501 bp, Oryza sativa
cccctgaaactggttatagctgctctaacatagaggtgttcgccaaacagcgaaaattctatacctaacccggtatcatcttttgaccttcatatggttagttaacaaatatatacaccaagaattttccaaaaaagtgactttaagaagaaaaacaacttagcagtgcacttcactctagacggttttgaggagtaaaaatttcaaatttggagcagaaaattttcatcagataccaactgaatcaatagaaaaaatagattactcaaaataaaagatcaaatcaaaataacatctggtcgatcctgtacaatagcgagcttgctcctagaagcaattaattggcttgttgccacgaccatagcttgttacatatctttgaattgaaattctttctttttctttgttgaaaagtcaaaatcatttattggaagttgattactgagttaaaagttgaatcacacaattggaattcttatttttcttgtgttaaaagtaaaacccacgtaaatacattgttttagtcaaatgtattcatctagctttcattagtactagttgatatcccgtgctttgctgcgggatatttggatgaatacatattaattatagaaatggtagatatatatgtttaaataatatgaaaatgacgtagagataatggtttgacattgcttgcatattaagttctcaaaatataacaaaattgtaaattatatgtcatgctcgcatgatatttaaaatattctagataataattgctagtgggtaatgatgtggcatacttgtatgtgaattaaaatactctagaaaataattgctagttggtgatgacgtgacacacttgcatgttgagctttagtagttaggtctggtttagttcctaattttttcttcaaacttccaactttttcatcatatcaaaactttcctacacacacaaactttcaacttttccgtcacatcgttccaatttcaatcaaacttctaattttgacgtggactaaacacacccttagtggacatcaactttatagtaagatagaataagtgggtagtgtgccttgtgatggtgtggtttgtttcacaacggattacctaaaatatatatgatgatacttttattcccgaaaaatcatttactcccaaatgcattactaactttttttatttttttgagaaaggtattattttacctggtctctatatcttgttgtgcattactaacttggcccttaaaaatcataaaatgtaatttaattgtcaaatttaaaacctgttgtgcactaacgtgttgaaatatagataagtttagttatcatgtttctgttgttatctctttatccttatctcttgtaactatatgttgttatccctttgtaatcgccaaggtagaggctgtttctaccctatttaacacgtaccgcgacccagcgtgagggaatcgcgttccatctagttttcttatatggtatcagagccctctccctccagatcaatc

SEQ ID NO: 42861 - DNA, 1501 bp, Oryza sativa
atttagtttgatatactccaatccaaggcaagggggtggaaatcaatcatgagttcacgatggaccaccgaatacctgcaatacgataaatcaagtcaaagcattggtggataaatcagaatctaaatctgattaaggctgcaaacttactccggttaaaatgtcttttggaagctttggtttagttttggcgtctgtatcctcaactagtttattttccggaattgggcgaccaattttttcttctcgaacttcactgaatttggttccttccgtcttctgtttctgctttcaggatctcagaaagttcatagaaattcccgtactaaagtttaaaagtataataacataagaaaaatgcttaatgctcaatatagtttgtattatgtacaataatagtaaaaaaatatagaaggatgtagtaatattgttgtaaaagtacagtaacacgtcacgttactgtagaacacataggacattactgcacttttggcagtaacgtcgtagtaaaattgtagtagaccaggaatctaaacaaaaatatatgggttaaagcctcacatactaaccatatacttgttaatgtacaaaagtaagaatgttactacataatagatgcatgttaccacttccaagtagctatgttactacacgataatcgtagttttactacgtcatttttatgagatgaagatcgaataggtgggctataggtaaagtctgtaggtggctttgagtgaggtctgattgatgtaggagtgttttgaacaattttatgcatttggtaaaactatgttactgcatgtatatacccatgttactgcaaattacatattctgttaggagtgttaaagttcaaaatgccaatatttgaaaagcaatatctcacaagatatgtattattttctaaaaccattttcacaatgatactaaagtgttactacatgtggaggatagaacttcaaaatgcatctacatactcctctactcaagaaaccgttcttcctccctcttcttaagaaaaccggtcttctccctctaatatagtgttactgcatgcatgtatatgatgttactacacttttggcagtaatattgtggtgaattgcagtaaatcaggaattgaaacaaaaatatatgggtacaaagtctcaaatgctaaccgtatatttgttactgcacaaaagtaaaagtgttactgcacggcagatacacgttaccacctaacatttacacattaccgcatatttatgcagtaacactatcaagaactgcagtaaaaactttgttactgtaaaacaaatagatcgttactgcaccattggtagtaacatcgtggtgaaattatagtaaaccagaaatcaaaagaaaaatatgggttaaaagtctcacatgctaaatatacttgttaccgcacaaagtggaagtgttactacatagcaggtacacgttaccacatgtttatgcagtaacactattcaaaaattgcagtaagacgcat

SEQ ID NO: 42862 - DNA, 1501 bp, Oryza sativa
cagttcctaggccaccagaaatttttgaacaactctccctggattatggtacctggggaaattgtaaacaaggattagtacctagctagttacctaaccactttgatccattcttgtcataataatcaaaggcaagactagtataaataacagtaattaattcatggttgacagtgacaaatacggacaagcggtgtgccaaaacagcttggacacgaaagcacattgtgttggaagtagctctcacctctcatggtgaaagaaaaagaaaaacaatttgcaagttgtgccaaacaggtagtatgatacaaaaaacatgcaatgtaccatatgtactagtactggttagttggccacaaaagcacactactgagaccacttttaattaattgaacaactctatacccagcgaagagtagctttgatctgatcctgatggcttaactaatcacaatttggccagttcctgccttcctgcctgcccttttactaactttttttaaggataattgcccttttactactgttctagtcatactcttcccatgattgcacttaattaggatggacggacactacatctccccataaatcacgacgctaatccgcgcaaaatgcctaggtttatgatgttgacaggagatcagccacgcggttactcttccttttgttgcaaaaaaaaaaaaaaccctaatctccttgcttgtagccaggtaacactagtacaacaccggtcagaccacatcagacgagattttcgagcaatttccggcactaaatttgtccgaattttagctgaaaagttgtgggtttgtgcctggatcagtcactcacttgtgctctacacaagcagaaaaagcacaatgatcaggagtggagcgcatgcttgatagcgatttcgatgcagggttggtcaagaaagcgatttgatttgtgtgtgatttttttttttaattttctcttcagtgatggcctctcaaaaggctatcacactggcagccaggcatggccgagagcataattaatacttagagatagcgtaacccggagaagaagagccaaaattattaagaaaaaaaaataaaaaaggtgaaaaaaaagcactactagcaaaggagctgagtaaagaagagccatctgccatgcaatggcagtgcaggtgcagcaggggtgataaaaactggaaaaaagttggaacataatgatggtatggaacacactttaatcttctaaacaggtgattattagcacactttcaggacagtgcagggttttgcagctgcaatcatgtcaatgaatgagggagtagtattgctgtctttctttttgttaatttttgacagcttatttgaacatgtagtactaggaagcagtattaaaggtgttccatgtttgcttaagtatactacattgttcaataacagtgggcagagacagcaaagtaccaggactgctgctgctgcttaattgccatttctcttgcaaaacaagcacattgatg

SEQ ID NO: 42863 - DNA, 1501 bp, Oryza sativa
ttctgtccatatttgcgccatctatacccatcactcgtctttccagcctgtacaataatcttttgctctctaacagttctgagaactggagtcaaaggtgtgctagtttcaattattctgctgatagaacaataagatgtagaaaacaaagttagggacaactcaatgacaaaatatgaataaattagcctagtactacaattcaccttcgttttggctgaggctctgtgctaggatgatcatcttctgatttgttaccagcatcaccttcacaatcacttgagcaaaaaagctgctgttcagaagcttcagagacagcacccggctctaatttacatcccggtgacggggattctataatttcattgttcacaagtcccaaggtttcatcatctccagaggaagcagtaatatgagccactctctctttcacaaatctggtcttttgtggcggttcatgattatgtgttcctctgtaaatgatttccaccacgcggccatcaggacaatgctcgaccttctttttagccaagcaattagagttggtacatctatagtaactcctggaattttcactacttttcacttgcttctgaccatacttcctccagttgaagccatcaccaaccatgtttacagacacatgattgtgtggtcttgactgaaatgaggctgacttctctaacactgatctgcgaacactcccttcagttcctgaaggtgatcgctgcaggggcattacagctttaggtgttataggaaatggactgggcagcccttctgaatatggtgtggttggtgactgcaattgtatttgtgcctgagccgtcacactcgccaaagctgcttgatggctcattgaaaagtgaccctagtttccataatgattatttgcacacatgtaagaaaaccaccaaagtaaaatacagaacatatgtcgagttaaaagagagataatctgaactttgttgatatggactatattcaagtttgacgggatttgacgggattctcattggactatattcaagttttattatctgtgttcaactaaagactaacaagatagcatgcagatagcataacatagtgttaaataaacagaatagctactagtacaatattaatttgttcaatcataccttaacatgtaaacttatgccaattcaatggaatttcatgttccattacatcacacagcattatattaggcagtatgatgaaaaaaaaaatatatatatatatatatatatataatggaaatcagtcttgtaaatgttgttcaattatatgtaggaagttatttttcaataaaacaacgttacaccatatccccccacaatagcagtgcataatttcccacagttaccatcaactaagcttgcttcagatagagagtatcaagaatatcctaaatccaatgcaggtggcctcccaaaatctatcacaaacagacagaggggatacggcattgcaaacctgcccatttctagcgattcgt

SEQ ID NO: 42864 - DNA, 1501 bp, Oryza sativa
ttataaatgggcagagacctttggccgtcctcctcatgtcgggagaactccggatgacgctccgatgtgacaggacacacctacctccactccgctggagaaaaaggcgacgtgggggcacggccgcccgtccagtcagacgtgaccggcaacaggccggtgacagactggttagtcctgactgacgtgcgtcagtcggacggcaccgcatgtctgcccctaccgcattaaatgcggtgaggggcagttggggcgccgcgcgcattgatagcggttcagcctgggtcccctccccgctcgctccccctgccacatggcagtcgggcgaggtcctcggggcagggcagcgcgagggcccgaggggcatgacgtggcaccctgaggccccccggccgcttctgcgattcgcgaggtgcgggggtagggccaggctgcagggccacgtagctggatgggaaggtaaattcccctcactttacatacccccgggcccatatctccgacagatagctagataacatcaaattaagtaaattaatgtgatttatgataatttaaatttaaatagtatgtagaatggtgattcaaacgtaaaaagtaaggtggtatgactttatggaagaagaaaagtagggtagtttggaccgtagattaatcatttaaaggctaaaaacaattgatgtgatatgacttaattagaggaaaaaaggagaaatataatttggaccatagattaatcatttaagcactaactaagtgaggatgaactatataagtatgtacttcctccgtttcacaatgtaagtcataacatcaatatgaatgtgggaaatgctataatgacttacattgtgaaacggatggagtaggattttataaaatatagatatacattgaaacattgtgtgaattatgtgggatgataatttaacatgcttgtattttaaaagctcttaaattataaaaactataaaattatagataatataacatgtttgcatgatgtttaaatgtgatgatcgttagtggatgatgatgtggcatctggttaattagtggataatgatgtggcatctttgcatgttaagcttaaatgagttagtggggggtaattttatagtaagataggattagttcagctgtcataaagataaatcttctacaattactccattctgaaagatccttgtagaaactcacaagtataatccaaactccaaaagaattttcggagggattttgccagctgccacatcaacaaaaaggatgaaccaaattaaaggagatcgaggaatggtggcacaagaaaacaggaccaattggcaccatcatcgtgcactttatccttcctcctccacacatccctaacccaccacatccaaacccctcctccacacaccaaaaaacaaaaaacatagaaataaataaataaaaacaatagcaatatccaaagcaactcatcagcacactcactctgcaacaagcatgcagacgccaacca

SEQ ID NO: 42865 - DNA, 1501 bp, Oryza sativa
atgcaagtggactaaattcaaagaccaagcaacaatgtgaactgaatctcatgcatcaaattagaacattaattgtggccggcgacgatcgagtcaaacataaggcacgtatataattaatatgtacggagtattaggtatcaaatgaacgtctcttttttttaaaaaaaaaattagtactcctcgcagctaattaataaggccccagagattattaatcttaatattctaatcgtcttcacacatgcaccttccctaacatgcactgttactctgcattgatgatatccatgtgaatattaagatcactgcattgaggaataggacgacgtgagagaatagattaattaataagattccgagttcaatctatttgttaaatttgcagattaattaattttaagtggtttcacatcagatgacctgagtcatgtatgaatatcgatcgtatgtcatgcaagcggtagttgcatttgcagctaattaatagcctaatagcactactaaaaaccctagtcactcagaaccggcacatattagcctttcccatcccccgacctctaggcggctttaaaacccgcatatatgatgcagtactgatttattgaaaaaacgataccaataataataatataggtgtcaattttttttaaaaaatgtgacactgatatgtaataaaaccaaagtgtagtagttttgaaaaaacaacacttttaggatggagccaaaccgaggccgagcatgtagtgggaaaaatagaaaaagaaagccactaaggtctgatttagttccccaatttttttcccaaaaacgttacatcgaatctttgacacatgtatggagcattaaatatagataaaaataaaaactaattgcacagtttgcatggaaaatcgcgagacaaatcttttgagccaaattagtccatgattagccataagtgctacaataatccacttgtgctaatgacggcttaattaggctcaaaagattcatctcgtggttttcaggcgagttatgaaattagttttttcattcatgtccgaaaaccccttccaacatccggtcaaacatcggatgtgatacctaaaaattttcttttcgcgaactaaacacatcctaataagtcccccgtccattgtttcctccgcttcttatcctttcccaatctctctcatcttccatctccccctccggtcccaatctctcgtcaccttttcctatcttcccacccacacctggttagtggcacaacaaggcctttcttctccctgccatgacggccatcagatccagccgatgggatgagcagaaggagtctcctaggctgctccacttcttcctcttcactgtcgttgttccgcctctattacttcccccacgtgtgcaatgttgatgagatctgctcaggagggaccgagggagggaaaggtggaagagcatggagatacggtcaccacgtgcttggggctctagaacagcaaggtcaggttgctccatg

SEQ ID NO: 42866 - DNA, 1501 bp, Oryza sativa
cttgattcactgggcccaatctttgatgaacagacactctttcctgcctcagccgattactcctattatatgaccggcttgagctcccaatgatatcactacacccagggcagttttcaatggacggtaacctcatcccttcattccagcagaatctaaagaactcacaaccccaatgaggatcaaaaccatcatcgtgttcttcataatgcttctcctgctgcttgtcatacttcctctgatatttgttgattatcttagccgaactcacttgaaaaccctttgcacagaccctatcggctgattggccagctgtatgtaccatattaatagaaaaaggattaccatcgaccttcattggtttcttcgaatcatcaaacttgatttttcctccctcaatagccgtttggatttgctgcctgaagaccttgcagtcattagtcgtatgagacccagaattatgccacttacaatacttcttcttgcccaactcttcagccgatggaactttcctcttttcctgaggtctttacccattggcatggtataacctttttgctcctgacccactcggctgccgctatttcggaatcatcatcctcatcatccgatcttctgtgtaagatgtgacaagctttcgaaatcttcagatgagaatttttccctgatcggagcaatcatcccttgaaacgccaaatcggctaactgggcatcagtcaaattcaagctgtaacatttattcctcatttccctgaacctttgaatatactcatgcaccggctcatcatgcttttgcttgattgacgtgagatcagacagcttcatcacgtgaatcccactatagaaataactatgaaactgcttctctaaatcggcgcaactgttaatcaacccatgtggcagagaagaaaaccaagtaaaagccgacccagctaatgacaaccggagtaacctaaccctcaaagcatctactgtcgatgcctcaccacactgagctaagaatcggctgatgtgttcataagtcgatgtagtatcctgtcctaagaactttgagaagtctagtactttaaaccggttaggtaaaggaactctttcaaaccattcaggataaggttgtcggtacaaattcccagtctcatttggtttaagcccaaattgctccctcattacatcagctatcacatcggcccatggtcgctgctgaggtgatccttgaggttgttgtggtgtaggctcaaactggttgtagaactaaggctgaaccgatcctgcctgttggtactgaacttggggtgatggaggctgatattgataactcaaattgccccctggtaattatgaaggttcggccgaataccacgcgccaaatgctcaggaataacttgaggcaccaccgaaccatccggttgcacatgatgaaccaagtgttccgggaccacctgatttgcagggtactgcacaggctgaccaccaggcattgcaaacctagccgacgcattca

SEQ ID NO: 42867 - DNA, 1501 bp, Oryza sativa
aagcaaattattcgtcttccctcaccatggatggtagacatgttaattcgtgtctccggcagcatgctcacatcatcatacttagaagaaaaaaaagtgcccttcatgtatatacatgtaactacctcatgcccctcttttcattaaagaaaaaaagttctatacccatgcatgcacaccgggatgcaccggttagccctccaatttgttcactccatggacggtatgttcctttgttctagtgattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcgagagatataattaagttggttgtgagtcaataggtccattgatgctataattaaggttaaggttagcggtttataagttattttgattttattaaaaaactaagttggatattttgatttgtaatgagaacatttaggattttttgcgtatggatgtgggtccaaaatataataattttattagcaattaaatatggttggtatagatattaaactattgatttaattaaaaaaacacaatggaattaaatatggttggtatagatattaaactattgatttaattaaaaaaacacaatggttcaaacagatcataaattgaatatataatttaaaatttacagctattgaagattctttatttatttataaaacataccaagatcaatatgtatgagatatattatttatacctatatttgcaagtgtatgcaatctttgaaagtatgataaaattaacttactaatatagaagatattatatacccttaagccttaacttaattaccatcgaaaaaagggaggcgagcaaggaaaaaatcacacagactcttatcatgcgtatggatggaagcatgtatatgtgttgggcggactcgtaccgccagattgatattaagttttttactaaagataaatctaatggtatctgatggtaaaaaaaatattaggtccatcagattaaataaaaccaatggttagatgttctcctttttccatagattttctacgaattaattagagcgttaggtgtcatctttgcactgtttcttggaatctcacgtggcagtttaggagctttttaggatgtttaatggacttttatataatagatagatatatctacgtgggtttgtgaaatttactccataatatatatttccatttttaatattttgtttttatttggttgcattgcaaagaaaaatagtatatattcaaagttaggaaagcgtttt

SEQ ID NO: 42868 - DNA, 383 bp, Oryza sativa
caagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcatggtggaacgctcaacccagctgatggctcactggtcttcggctatcagatacaagaggctgcgcgacgactaacagatgcagtggaggcctcctctcagggcacgttccgaccagacagagatagggacgagctgacactcgccctgcagactccagagcatccaggacgaactcgagggaaaggggtgattccttggaagattggtttcaaggaggacatccacacgtaca

SEQ ID NO: 42869 - DNA, 1501 bp, Oryza sativa
attttatattgctatattatgggacaaagggagtatattcttgactaaactaatacaagtactatttgctagaacaatgctatacgtacgacgtgtttgtccgaccaacgtacgatcaaacggtaaaacaactccatacatggctgagtaaggtgacaacatggcttagtccaacagagattaacgtcatgaactcaggacattaagttcgttccaaagtcgaacaagtttagtcgtatatatagcattttcctacatactattgttccacccttatctagagccttgaagaacatattcaatccaatggtgagttagttgccacagttatcatccaatggtttgttttaatctaatgacgtggcatgcctaatctctttttagcaaaatatccaacggtgagtagactagaaaatcggcgtgccaaggcatgcctgttattgtataacttgcagcttatgttgtttagtaatgcttattccgtttaatgacttctataattttgtgtttgcataaggttggtgaaaaaaaaagttggtaaagctttatgttttgatgcggattgtttaatatcagaatgaaggtgcttgatattaccagtcaaaaaggcaattaccatactatattccctcagtaaccatctcgacgtgttacctatttatgctactccttatttaatatatgggcgtgtgttcatgaaaaaaaaggtgtgcgtttgtttacttgcactagtgcagaattgatcttttaccgtgatacccaaaacacaaatatcttggttagatttagaactggtactgaagatatttttaattccggttctaaaattccaagtctcaaaaacatctttagtttcggttagtgttactaaccagtactaaaaatatatctttagcatcggttggtgacaccaaccgtgtaagcgtcaggaggtgagcccatggcctgacgcgtacacgtgtcaagaaaattacggggcataggtggaccaatcaaactctagcacaacggctagcttgagaaggttagattccgctccatgatagacaaatgagctagttgagtggtggcctattttaattaggaaaaagtccaaataaccccctaaactttgggtggaagtccgtctagcaccctgaactttgaaactggacattcaaccccctaaactttacaataccgtttatataaccctctaagttgattttgcatagtggtttttactaatttgtatataagttggatgagtttgatcacatgtcatacactttggacatatatatatattaaagttttgacttaaatatttctttttgctccttattagctctcactcacaaataagtaccaacgtaataatagcatgttatcattgtataagaatagattgatgatttataactgatcatatgcaaatatattatattagttattcaaaattattcgtttaaacttccaaaatatgcaaaaccatcttttaaaaccaccttagggggtaaca

SEQ ID NO: 42870 - DNA, 633 bp, Oryza sativa
gacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 42871 - DNA, 702 bp, Oryza sativa
taaagatcccggtgatctttagccccggttggtgctaccaaccgagactaaagatcttaactttagtcccggttggtaataccaaccgggactaatgatcccggtgatctttagccccggttggtgctaccaaccgggactaaagtcccacccctatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 42872 - DNA, 1501 bp, Oryza sativa
gatgtataattggatagtgtagtgtgtaagaaacgccagcatgtcaattccgtgtgtaaataccgtatttgtttatacgacctttagcaatgatcagggttcaggacattagttcttaattacttttatggagttcatgtgtataaatttgtattattctccacagataaatagttaaatctgtactaatatcgctgaacggctatacccgtgcatcccgcatttcaattgaattcttggttcgcatgaacaagttgagcagaaaaagcgtttccaaattattgtactcctttctctgccatgcaagttcgagccctagaagtgtaatttactcttccgtggattaactacacagtgctcacaactgcatccacaatgtagtgctagagcaggtaataagcattaaataggggtttgttatcaagtaataaacattgtgacagtagtaaatagttactaccaggttacaagtttattgccggtagtaagggaatatgatgggtcccacctcacttttataagtcagaacaaggctttgtgataggttggttgaaggtggaccaatcttattcctccccccctctgttacatacacacattgctagatattttccctgacaacgggcccacccttattgcttggtttgggaataaacattgctgatgctgatgcccttagggcatgcttaatgtataatgtctacttgggtaataagatgggacctgatattaattatggtagttgctacaatatgctatgataagatgaggcattagcatagatcttactggtcccactcaattgtatgttatgtgagagagaaaagaaagtattgttattttattcttatggctaggcattatatatatatgaactactcctacaatgtataaggaccactttagaggcttccatagtttggatgactttcataactttcatagtttaccacaaaatatttggcacattatatggctaaaatttatttgccacaattgtggcaagttatggtaaaaaaattactcaatgacaagtgggctagcttgctaaaaaaaaaagtggtataactcacctgtggcatgaaccaaacactaaatttaattgtcacaactgtagcaaaggttggcgctcaaccaaacagccccttaataccccttgtatttctgcattgtggttgtcctaggtggtaagggactttaattttttagtctattaaatttgagaatcgcgttcaaaataggatgacctaaatttctattatttttgtctaaaaatatttaaagactagatagagttatcaaataacccacggccaacgggcattactggcaccggtggtcctgaaacggcgaattgatcgaaatccgtaggagctgccaatgccagcacaaggaggcagcggcagccgcactagctctctcgcccgaatctgttttttcaagatcacatcaacacacccgcatttgctgtggtgggcctgcatgacgacgcgctcaaagg

SEQ ID NO: 42873 - DNA, 1501 bp, Oryza sativa
acagctgcaatcactgatatgtgatgattatatctattgtacagagatgatgttgtgacattgccaccttctgggacatcgctcatgaagctatatatggactgtccattttatggttcaggtaactagacactcacatggtaacagattttttttccttgctctgtgaaaccgacgacatgtatgtcctccaagcaacaagctcaagcatgtgttctgcttgcagattcaatacaaagcaagtgatatctaaacaaccaacacctaattgatgcaatgcaagtgaaatgctaacaaactgctctatggcatcctcaaagggttgatttctgggtcttcgcattttgagtttcatcgatggaaaggtttaaactacatcgttctttttttaaagcaaaatttatatgaattacacatactccactgtacacatatttaacttaacaattatctttggttgcttgtcaaggatagaaactctgaaaaagctaaagctatcatatgactataataataatttggtatatcagttggtgacaagctgatagatctatgtgattatgtgaggaggacgaagggcaggaggtcagaagagacccgagaaagtgacatggcacctcattgagcaagctaggttgatgctgtacacctgtagcgtgccatgtaatggatgatgtctacattttttttattgtctcaaatagactaacagcttcaatatgtatatgttacaaatttaccctacatatgttttcagatttttgatgtattatacattttctatcatatatattgcataacatgcattgcacgtgcacgattactggttagctaaaaagtggtggtagtacatagaattttaatttattattttaagctttttaaaaaattttaaaataaagactctaaaaacttagttaatctcaactttaaagccataccttccatccaccacacataacgtgacattataacactaccacgctatgagtgtgggtgtcatagtaactggcatggttaaaatccttgccataacatgacaatactgctatgccaatgtgccacttgtctcgtggcatggcaaaatgtcatgtcaaaaagttgatatttaaaaaaattaaaaagtttaaaagtaattagaaaatcctagtacgtattgcggtatagtactagcacacttattctttttttttctctctctctcagggcagcatgcacacttattccttctagttcaacattagaacctcaatttctctctgttttaaaatattaataacttttatgattcaaattgttacatagtataaatattaatttctagaacactgattttaatgcacgagaattcaaacatttccagccaatcaagtgtatatgaaggaaaatccaaataattcaaaatttgatcgatgaagtgacatggaaaaaaacaattattctctctcattaaacctaaaaatatttatattataaacggagggagtagctttttatatat

SEQ ID NO: 42874 - DNA, 1501 bp, Oryza sativa
ggtaacaccaaccgggagtaaagatccctatctttactcccggttggtgttaccaaccgggactaaagatcgatttttagtcccggttttttacccgggactaaagatagcgatctttagtcccggattggtagtcccgggttgaaaactgggactataagggggttacgaaccgggactaaaaagcacttctccaccagtgttaaacattaatctcctgtaaataaatcatcctatttttttcaattcaatcgctaattagaatttgaatttggtttatagggaatcgttatggtgcttaaatcatcatggtggtaaacacgcatacagtgattcgtcttttagctttcttcatgcactaattactaacttttaccttgaatatttagtgtagttgaagtcattgtattttcttctacattctaaattacataaaactaacattgatatctgccagatcatgttattgacagattccactgtactttcttttacactcttttacactgatataagcactctttgtttttattttgagggattaagtgcatcttatttttattgaaaaatgaatgacctagattttagttaaaaaaaatgaaggacttggatttactgaattgtcatctgatgatctatattgttgcacaggggagaattttcttcatgcttattgaatgatggttaactaatcccatgccatatcttgatgcatgtacatcgatgaggtttattcctcgactacattattggtgcatatataggtcaagttgaagtcctgtgattaagctctcaatagatggtgccaacaagtggtaggaccagggtgaacacgattatattgatgttgaatcaatgtagcatgccgcatggtgtggaggccagtcatcgaggttagttctgtaaacatcatgctttatagttgatactctcataaggtgtactcgaagctctcagattgagaagcattactgtctgaaatatcttgtagctgcctacaatgtttaacttggttatataattgaactatggtttcttcatgcatgcttccaatccaataattcgtaggacaagaatcacacattcatttgttaatttattttaaatctgcaaataacaatcaatgacttgataaggaagttgtatggcataaatacaattttgtttgtgttttgggaggattagcatgaatatctgatattatcgtgcatgaatcaaaaactagacaatgaactgattaaaagaatgtgtgctgtacttttgttcttcttcaggacaatagtaatctatttttgaaagaaaaatgcatatgacagagcaccgattactttgtaggtttggttatctctttctgtcaaaattgatatcaggattacatgctaacaatcttttgttacaccactgcaagaaaattttatttaaaagaaagaaagctaccattaagtgagctacttatattcttagatttatcattttctcttgatatgtttgtgtctgtagg

SEQ ID NO: 42875 - DNA, 1277 bp, Oryza sativa
ttgtctgtggaggggaactttcaacaaatctctcctgatcatgtgagcgagtctctacttgtactataaatctttgtataatacagtagcatcgtgtatgtgtgatctgattttctttataatggataaatatctggcccctatatccacttgtgatctgaatactgcagtatatattggtagtaaatcttgttgtaatttatgaactgtctttttcctggacgatcgattgattccaaaatcgtgggatttgagtaccagtatctgactcaagcgatctgaatgagtggtggtttagcgttagttgggagaaaattatcaagcacggagcaacagcgacccattgaaagttgtagctcaactagtaatcctggtggcttattggaggcctaggtggttaggacttgggagatcgcactcagacgagtatactcgtggcagttctgtctgtataaatcagaatcactggtctgtatgtgacgcactgtcattttctagtagaccaatggagcagaaacaacggacattgttgctagaacaccaaactagcatactagcattcacgcgtaaatcggctgaaaggatggatttcgcaatcagacggcaataccgtagtgggtcgtgatgatgatgagatattgagatccatccaacattctccaaaccacttaatcacctaagactagagtagtagactgaagaggcttaagctcagctaatgctcgagtcgtcagaaaagaaaatcaggagtgaacagaatgaaagcttggttgataatgcaggttggcgttggtccacccactcaactagaagtgacagcttcttagggtgaaaatccaccaggcccacccaataaggccaccagcccaatattattaggaataagttcactttagatccctcaattgccgagtctaaaatttatccctaaaccgcaaaaccagacgtgcccctcaacgttaaaaaccagtgcgaatttcagactagtacctggtattggaagctgagggacgcgctatatctgtattgcggctgaggatgaatttcagacttgacgacaaaggacttaatcggttgtgctggctgcagccagcaagccattcacagctgccgctctttcgtttggattggggctgactggctgcagttgctgcagccagcacttccgattagggccaaattgagggatccaaagtgaacttatccatattattatacccagccgcgcgcagcctatactaattgggccggaacggcccatccctctggaccacagt
